United States Patent 10,407,724 (METHODS AND COMPOSITIONS FOR SCREENING AND TREATING DEVELOPMENTAL DISORDERS) - sequence listing, part 83

SEQ ID NO: 2410 - DNA, 429253 bp, Homo sapiens
atgtgatagtgttggaatttaatcacaggtttacttaacttggattccattgtcttttatagagaaaaagcatatttatgaaattagtattttaatattgtttgcaactaatactgtatgagtttatggtttctggcatatcaagatgaacaaatataacaaaagtacatttaatggctacatctttaagtgtatgaatatagaggtctttaatgactagttaaatccagaaaaaagagagtcaacattcttcctctataatataaggatgggtcttcccttcaaatgcagccttctttactttcccacttaagcacgaaatggtgccgcatataatttttaaaatcaataaatcacagttgtattaagaaatattttattaacaaaacagtaaattccacttgcttagcatttccaataatggataaattggccttgcaacagaaaaacaaacaaacaaaaaaagaagaagaaaacccctttgatacccaatcacacaaagcactagaagggtagggttatgtggcctttctttgatgtcttagggattgaccacttcacacgttattgtagtatttgttcttttaaaaaaggcaacacattacatggataaaaaagaagcataatcaatcagaaaagttacagtctagagatgtaatcaaatttatgccaagtcgtgtgaaatcctcaatcaactgcaaactatgcagggaaccctgatatgtttggtatgaagatacttgggattcaagtcattttctctttctaactctgttcctctcttttctttttccattgaggaaaaaataatttttgctagagtttgtgtaagccaataatattagaaataattttgctgataataaactatatcaatcattgcatgtaactttaaaatttacgctggggagaaacattgaaatcaatcccaaacaacacatttcatagatatactgcttaaaattaccattattcaatttattttctattatattttagaatctttccagatggaaactggttcaagcttaatagataaaatagaaaagcaatcttaaaaaaaaaaacccttcaagctgtaaattagtagttttacacttcccttcttatttaactggctttccctgagtaagactgaatgagacgggggaaaagaaaagactcgtgaattatttaatgtggcaaattaaaaaaaatgaaaatctagaaaagaagcaatggatattaaattttcattttataccttctactttctgggtcataaaaagccactaaatttctttgtacacaacaattacttggcaaccatagatagtggtgatttgctatgaattatacatatttctaaggtgctgtatgtctgaaatccaggccacttcttggcttttttttcatcaactaaagtatcacaaaagatgttttgcattttttgcctttgctgattaaagctaattggaaagatattcttctcttctacaaaattttttatcgttcttttagaaggtattcaagtaatgcaaccaatttttcctgaaacatcaacttgcaatgtaataatgcattttttgcactaccttctcatattagtaatttattgctgtgaacatcattgaataatatgcaaaacaagtgtataatctatacttttccactacttaatgtgttaaactaaaactatatttaatgatatatatgtaaaaccagaaaagttaaaacatagtcaataattaacagagaatgattttttaagtgggtagtaatacagaatcaaaaattactgaaaaatactttcttagtcgagagaaagtgtttactttccagaaatgttcatcatgcacatcagattcagagatatatatattattttattagaaagaaagttttcaattgcagcagccagagttaaggtgtagattaaccaattttgcttccataacctgcccacataatggttcttattcatgcagcagtatatcagtgatattctatttgataaggaaaggttcatttctttagggactaaaatcttcttaaggttacctgggagcaagatctcaatgaagcaaatcaccccatttgtcatcaataccttggcacaaccctcttccttcctgcttttcaatttgtcaataaatatttgctactgtatgcacgtttggatcttccagcatatctgatggattgctgtggattcgtgtgtgtgtgtgtgtgtgtgtgtgtgtgtgtgtgtgtgtgtgtgtgaaaatagtgaatgtatgtgggaatgtgagtatttcagggagaaaagattataagatacatatgtatatatgtgactttctaattcacacctttcatacaagtactaaaacttaattgcaacagaatgaaggctgtacatataagaaaagaagtagctgagtctttgtatatacattcatacatatcttccttagaataaacactacactgtaatttctttaaaaaataaaagtaattgtggcaatttataatggtggcaaaaaaaaagaaaaacccaactgaaataattgttgctctgatgtcataaaactccctatacttagcaacacttataacattgaatttaccaaaaatggctgaagagcagagatatattttgcattttctatacaacaggctataaaacgtcacttatcacagtccagaaagcacacagagatggattttatataaacatatgtaataacataataagcgtgcatgaaaatttcccaatgattgcatctatgccctcttgtttttgttttgaaattttgtgtgaaaacgtgccttatatttcacatttttgaaaataaggcctccatacttttttttcctctctcacaaccagaaaggggctttttgaatgtgttcctacacaagtcttcaaaaaagccagcactttgtttcaaatgcaagttccaaccactgctccagttgcaccaggcggcaaactcttaaaggtttgcaggttgagtcactcaaaaggacagtcttctctggcaattggactgacttctcaggaaagcgctagcactttggctaaatccaggatcataggtagcttcttttttgtgttatgttttgtgttggtttttgtgttgtgccttgatgctgtagtactcctttgctttatgaatgcgtgcggtcatcactgtcttttagaaatgttccagcaacataaagacaagcagagtaaatgaaaacactgtggatgttagggaatttattggcccctgttttttgttttttgtttttcttttttgagaaacaagagcatgagatacttgtttttattttttaaaaagtctttccttcctgattgcattccctgtcttcttttgtatgtgcttcataaaaaggaaagtaaataagtttatattatgtctcagataaaatgaagactatttctatacaagtgtccatttaagatcttgggatcagacataatactctttatccttgtttttcttatttttgttggagcttttcgcactgctgggttgtttctcctttacaacagccccattggactgtgctgagttactgatgtagtttcgactctcgtccacatggtatgagccttcatcccggtttctgtacttgtacatggcatagaggaggataaggatgcacagggcggcagcggctactatcccaacgaccatacccgtggtgctgctggactcccggatcacttctgctgagcctggatacggctctctgccgcctgctcgggttgggttggctatagaaaagaggatgagaacaaacacaaagtgatcattgagttcactgaataccagagagctatattaacatttattatctaattctaacagcacctatgctttaggaaaggtatgctattgataaatgtagccatccctttgcctcatggttactaaaaactagggactgtgatttaaagttctctgggagatttgttgctgtgtcttctttcttcacaaatcaattttgttcacagagtttggtaagcattgtcccaaataaactccaattagctctaaagggccatgtgggtgacttaagtaaaaaaaacccacaaacccagcataaagaaaagcagaacagccctaccctataatactagagggaatcataagaatcaaataggtgttgctctagaacataggtctaactctagactgaatcaggacaactaaatttaggattactttagaaatcatattccccttgtattttaaagaatacagtattgaacaataagataatccatacattttaactgtctgctttttaaagtataactttagttacatttttataaataaaaatagactaatttccattttgttggagattcatttgtttacataagtatgtgtgtattttattaattgattggggagctcccaagatgaactttggaggagaaagtaataaaatattctttctcagttttaaatacagtctagattgattttttggtcaaaactctgaactacctaatagattagataataatagaaggctggctagtctagttttattcaactgacaaaacccttcttcagtcttcccaaagtataaataaggctctttcttggatgagaccaatggattttggggtgcctacgtcttcttgaaggcctggtcaggcactgaaattgatgattgatggggaagaatggacctgagatttaattggtagatatgaggagaaggggcagctcttttcccctatatataataaacttttttgatataaaaggatagaaactgtagcgagagaagaagattctatcctactctgactgtaggtcattttttccttgtgaattgtgttttctgtttttccctgaatctctatcctctcgcttgtcttacataaaaatattacttttcagatgtaatgtattaaaaatgctacaactttcaaaacactattctttgccaattatgtataatgaacaaataatctcatgattccatatatattagataagaatgtgtgtgtatgagtgtgtgttcatgtatatgtaagaactgaaaactcaagaagactaaaattgtgcttttatttcgctactactaaacatcatttagtaattaattttaatatttctgcaaaagttcttgttaattactgggaatcattttaccaaacatatggctctatactgctttgtaattccattttcaaatatcaccaatatttcttttgcctaaacgtgtgtgtgtgtgtgtttttctgtgattttcttttccttcctcaaataaagccttaacaaatacagccatttccaaagtagtagctcttagtctcaaagtagcaataagctatgttctggtgctacaaaatgtagcaggtaaaactttttatgctgaatgtgtcattgcttgttttacaaaagcccacggagtgtggctgaataaaaagctttggtgttgcttctgtggacaaggtgaaaggagacaaagactataatccacagtatttgattacaggaattaatttcctctcatgaagaatagaatctactgcagtaactctgtcactacctgacaaaccaaaggcagcactttttcttttaaatacagtcatctttgccaaagtgtgccaattaactcagctgctttcactaaatgaaaactttcattttacagagcattcttttactatggtgtctcaagagctaaaaagggaattttgtttaaatgttacctaaatcattttttccagcctgatggaatgctttcattttaaacacattttcacaattacctcacttttactctgtctgccagaaaggaatagggagaatggagataacatttgaatcatttagcttatgacagtaaaatttgagaattttaatggagtggagggtttatattttgtatactaagaatagacatgtatttttttcaataaggaattgatatcgtaaatggactatcttatcaaaaaaattttatttttatctgctaaaatatttctgagaggttttcaaaacaactatgcacatagcatgataacagcaactttgtgttaaaataagaatgaggtcacaaagaccataacaaagcctgaaacacttcaactgtgccatatgcatttgaaaacatctcctgtttaaggaaaacactttcttttttgcaacactagccaaattgttgcttaagtcatatgaggcctaaaaatatctctacacaaaacccagatgtaaatcccagatgtaaaaattctaaatatcatgtttcttaaaaatataacctagaaaatctctaccaaaattaaaatctaaacccaataaacatgttatctttcttttccccagattcacattaaaattttaataaccatcatagcagatattattataggtatgttcggaataggtagttactccaatatctaactgattaattaatattctttttctatttatgcttcaaatctgaaggctaagtgaaatttttcttaacttttcttctgagactagaaatatttatgtgttggtcgggtgtggtggctcacatctgtaatcccagcactttgggaggccgaggcgagtggatcacgaggtcaagagatgcagaccattttggccaacatggtgaaaccctgaaatacaaaaattagctgggcatggtggcatgcacctgtagtcccagttacttgggggattgaggcaggagaattgcttgaacccgggaggcagaggttgcagtgagctgcgatcgcacactacactccagcctggcaacagagcgagacactgcctcaaccaaaaaaaaaaaaaaaaagaaagaaagaaatatttatgtattaatgggacatctctcccagatatgcaataacaggccaaagagatttaaatatattcatgaattataaatgtggcttctcttattgtcgctaatgctttattttgatgatcactgagaaatctctgatgaaattttatattaatgtaaatgtagagaatagtatcaatgactaatatggttaaatgtctttttatataatttgttcaaaatttatataaaaggtaaatgcagtcatctcatccatttactaaaatgtgaaaaaaagagaaacataattaatttgtatatttcatggatttaagaattttgcattccctctacactatataataaactaaaataagacatttttaaaaaattaaagcaatctgcaacatgtttttctcttagcagtgctgaaatgtgaataatgtaattaattaaaatttactttcatccttttctttctttgtcccagcacgtgacaaagaaacaagtgaaagagaataacttgttaaaaaagatttaacttgttaaaaaaagcaagtaaaagagaataagggagggggagctaaaataatggcatacacacaaataagcttaagtctttaagtcttgaatcttcaaagattaactccgacgtgtaggtaaaattaagccgatgtagccagttcattatattgggcccaggggcataaggaactcggttcaatggaaaacttcagtaggactgacagtggtctactacaagcaaggagagcaagaatgcacaccttcatcacaatacaaaggcttttgacttttgctggcatttttaacctataaatgatttggaagctaatgattattctagcaaggaaatagagcagtacaacagttatgacccatttcatatttatattcacttctttctcacttctgagattcatttagccaaatggctatagaaaaatccctgggactcttgcacttataaagcatgttaccttaaaggaccactgaaaagtagtttttaatccttcctctctcttctagcatttggtaagatacggtggtctctagaagttttccacatggtctgctttgtccctgtagatttatcaagaatcctatgaatcttcttgttttttgttgtctaatatgtattgtggtaacttcggtaaacacgagctatcaaatgtttggacagttagtaacctatttctgcactatgctctaaatcaatttgttcatatctgatgataattcagatgataattcattgtggaaaatgaacagttactactaaaggcatattctagtgccttgtcacatagaaaaaataaatgcaactgttgctctccattaaaaagtaaaaaaaaatctttaagattttaatttgtcttttgctgagatagttattttaaacaacaacaggaaaggaaatcgccctatgtattatttatttatttttgatagtctttgatacagtatctgtgaaagaacatcatttcctcaaattagaacaaatttagatccaattaagaaacacatggggaaaatatgtttgagacacattagacttcagtacagaccagagagggctgtcagtgcaggcttcatctcttaccagcttcttgcaccctctgttgcttcctccattctcctctgtatttctcctcccacttacccttctttattgcctctgtgccttgctcttccagctcctgaattatccttgtaggggccctccccacccccaggtaaatgaagaaggtcaggccagcaggggccaggactttttgcctcatgggttagcatattactcaggaaggtgttcaataaaccacaaaatttattttcaagttctgaatttcaaaacacaatgtaaaataattcttactggcacaaatgtctaagtgtgactatttcaccagaacaggttttgtgtttcatattggcatgattacttttaaatataactttctaaatttgtttgcaaataaaattgtatggtttggcaaaacaaataatatttgatcactaatttaaaagacttttgtgatgcatctggtgatatgatgggggcacattaagccattaaactttgcattgtatttatcagtttgcattgtttgattatatctaatcacaccttagcatatgcaaacagaagttaaagcttgcaattacttagtacaatgattcacaactgaagtgctaaaataactaagcaatttgaaagatagatacatttttgaatgttaataaatttttccaaggagatttccctttgcaatggtgacatccttcatttttctttttgaaattggaaacagcaatcaattattgtcattaaagaaaactgctcttgatctatgtttttgcaactctgcatgataaatggtgtttaaaatcctaattcctgatatagaatggggtttggtgggtggtgggaccttatctttctattgacaagttcaccaaggcattagcatgccatcagatggtctttttatcactcaaattgtcatttttatgaaattattttgtatacttgaatgagctgttcttccactgtaatcttatatatatattttggttccaaagttaactttcaaggtaagtttgtagtttctaggtaatttttcgggctggttttatttcttcagtatagactgttaatgtatgtgtatgtcgtcaactatgaacctggcacaccaaggataaagtaagagtatcattataacctgatgacaatggaaattcagcttttgagctttgagaaaaagattgtaagaaactaccaatcttaggaaataataaagaaaaaaacatgctagtggttaaaaaaaaaaacataggctatatatttaagatcaggaggggaccataagggatcattaaactccataatgcccagcacgcatcattctgctaaccagaattgttagatgtcctgtcttgcaatgatccttaaaaaaaaaaaaaactcttggcaagatgcatttactgaatttcttctcactaagagtttctgaccagtctttctggttttctcataaattaagcttaaagtaatagattttaaatttctgtctccaccccacctaggaaagagttgcctaaaatgatctcattagaccagagttctatactgtgtctaatagatgtggaagttattataattctaggctagacttgaaagtgattttggatttatagggggaagatttgacttttccaatactcagtttcattaatactgtgaaaagaaaattggaattgtagcctcctggggtgtttgtgaattgagattagcacacttttttcccccatttgaaaaaaaacaactcaaagtttattactttttcccatttttttgcttcaatacagtgtaggccagaagaaacaattatgatgcaatcattcacaagaagccatgtttaaatactacatttgtaggaaagcagggacacaatgatttatatgacatgcattaatttcgactcatgcggtggttttgtaagaagtgagggatgctgactgtttcaaattccttcccttctccctcccaccaattccacccatgcctgcacattctgaagtacacttacggaggtcagacaagtcttgagagaggacatgtctgacacatcttagcccttccccaatacatcggagatttagaaagaacttggaaatcaataaacctttgctacctgcctggctgctgtctccgatattttcctctgcttctttcaaaaccaccaaagcatgcatttgaagggcagttaaggggccaccactctgatattgagacgttcattatcttctccagagatctaggtattgaatgggaagggatgctagacacggaaaaactcatcatgtgcctgcatgatggagaaacccaactaggacaggctgctacctcatatggtaccacatcgaacagaagagacaatggatgtccacactctgtatgaccttggtgacactgaagacaaataaacagaggaacatgcacaatctccctcatctccaggggaagccataggatcatggtatttacaaatcttattcttcaattattcactatgttgtaaactatatgtccacagcttagtcatctataagcttcatagactttttacatagtcattgtatccttgtggtttgcatctattatggtgcttactccagcaccatggtccttactgttcccatggccattcatagtctgttcacagctacctactccaatttgtcttccatatttgtcaaaggaagttagagccataatattattgctgtccccaactcctcacataccaaaaagagttcaacctttatgccttgctcatataaccttttatctcctgcctgtttaaatagtacttatttctcgaagcttggctcaaatgtcccatcttttatgattttttttctctaagaaaatcccctccttctatcaacgagtatataatgagctatagttaacattccagggactatatgaggtcctgagggtataggagataacgaaacaaacttgatgtatatgtcctcatggaccttaaaatatagtgaggcagagaggcatacaagaaggaatcacacagttaaagtaacagctgggatatgcatgatgaaggaaaactgtaggtaccatgcaggagtaggacaaaggtttctgattgcaactgcagaatcagatctttctgaattagtgacacttatgataaaaatgagtagagagtcgtcaagtgaaagtgggtagagaagtctacgaaaaacatgtcgaatgaccttgaggaaacaaagtttacttttcaggaattaaacaacagttagagtggttgtagcacagtgagatttaagggagagtgagaagaaatttcaaggtggacatgaaatttatcacagagactgtagactatggaataaagtcataataaaaagatgagcgtatttaaccccataaataacaattttatgtggcaaaagccataatatcattaacaaaatgaaaatgacaaaggagggaaatatctgtagtacatatgacggaccaagagtaaatacctctaaaatacagagtgtgtgtcaactgataggaaaaaagacaaacaacctaacagaagtatggagaaaactacacacaagcaagtggagaagagatctcaatgctggtgagaatattcttaataattatttgattgttattagaaagtaatccaataacatctattaaattttttaaaataaataaattctctcaaccgtatatcacatcacaaattttaacattaattctatactattgtaaaatctcacttaaatgtttcatccaatagttttgtcttttttcaactagactgttggtcctttgacagtttcctgtgactctgtttctctttcttattagttctctcaccttccaaactctaatgaagattgaacacactggctgaaaactgcatgttttatgtatagttagatgaaagcttttgtaacttgataaattttcaagggtaaactaggttgaatctaatcattaagaaagtgtgaaagtgtgaaagccaagaactgtgtggctcacacctgcagtcgcagcactttgagaggctgaagccaggtgttcaagaccagcctgggaaaaagaacaagatactgtctctagaaaaaattaaaacaaatattagttgggcatagtggtgcacacctgtagtcctagctactcgagtccgaggtgggaggaccatttgagcccaggagtttaagaatagagtgagccacgatcatgtcactgccctccagcctgggagacagagcaagaaagtgagagacctttgattttaaagttttgagtaaaggtgctaagcaagggggttgaacactgacattaacatctcatatttctttaactcactacttctctaaccctcaacctttgtaatatctgcagtaaaaacgataaatgtaatatttacttcattaaatcagaaatcacttcttctgtgctttggagaattgggatcaatatacaataatgaaaatactgcatttgctttccctatgcttcaaggtaatatgtcacttaatcccaatgactaaagtcactaagctatttaaagttaactgagtcatcagtttgattcatttggatgccttatttacatcaacatcatctgacacccacagtactgcaaatagttgacagctaacttgagctcttttttcaattcagagtagttgtagaaatttctagggtgcttttcagtcctgttgctattggaattgaaaagggtctctttactcaggcccaactttccataattgtcaagcagaagaaagccatataggcaataattgagaaaatcagtttcaaaactagggaccccagagagtctgtatatgtttttcctcaaaatgtattacattccagaaaaatgcaagaagagttatattttgaaatgtggatgatactccttattaactgatttcaactcaactgagcttcttgataccaaaatagcttctcttcctgggagctcattgactacaacacccaaaaatatatacatccagaaatcacttttcttaagatccatttccttttttatatatagataattgaataatctatctttacaaaataatgagatttattccacagaattcttaaggcctgaaactagaaatttttggaaaacctggtttatagtaagacaaaaatggcaacattatagctagagtaatgaggagtatgtgtgtgcatgtgtgtgaatgtgtgtgcatgtgaatattgcagcattccttccaattctctctcagaagttgctgagtttgctgggcatggtaattcatgcctgtaatcccagtgctttgggaggctgagagaggagtattgcttgaagccaagagttccagactagcctgggcaacaaagggaggagactctgtctctacagaaaatgtaaaaaaattagcctggcatggtggcgcatgcctgtagtctcagcttctggggaggctgaggtgggaggatcacttgagcccagcagtttgggggtgcagtgagccataactgcagcactacactcctgctgggcaatagagaacccaattaaagaaaatgctgaagtcattcttcttatcctttcctttccttttcgctttccttttccttttcccctttcacctttctttctcctttctcctttcctttccttcctcctttccaaattaataggtaaagccaagctattaaatagttccaggaaacctttagcaataacttgggggtaaacttacttaactaagtaatcaaaaccctcatcaaaaccttctttcttacattcttccatatattttaacattactcaattgtcaacttatgcttaacagagctactatgacttccctgtaacatctatattttgtttcttattttatgtagttaacagctattatttttactattattatatggtaattgctgtgctatacattttacacataaatttcatctaatttatttctcataacactatgtggtgtaggtattatcattacaggaaagaaaactaagtctcaaagagcttagcctatttagactttataaatggcacagccaaaattcaaactcaggtctgtctatggctactaatattttatatactcagtgtgtctgcatttatcactgtggatcaatttgttattgcttctgattttattcctgtgttaagtgtaaaaacacttagcactttaggtgtattttctttttttgtttgtttatttttgtttttgtttttgtttgagacagagtcttgctctgtcgcccaggctggagcacagtggcgcggtctcagctcactgcaagctctgcctcccagattcacgccattctcctgcctcagcctcccaagtagctgggactacacgcacctgccaccacgcccggctaattttttgaatttttggtagagaaggggtttcaccgtgttagccaggatggtctcgatctcctgatctcatgatccgcccgcctcggcctcccaaagtgctgggattacaggtgtgagccactgcacccgggctttaggtatattttctaagcagttgcccagttctagcccttccagccacattcctcttcacctgctgccaactctctgtcctttgctgtgggagttaacattcccacagaatcttagaaaagcagtgaagagtggtaaaaagaatatcgaattatgcattaggttctagtctaggtcctgtccttaactttttgagtgacagtttgcagttcattatcctctgctaacattcctttatcagaaaccatgataatgacacataaattatttatatcccaggggttactgtgggcatcagatcaggtagggcattcagtatgaaagtatctgaggaggatgaggactttgtaaaaacagtgattatctgattgttttctctacatcttccacacagaaggtactgaatcagcagctgtcccaacaattatacagttttgcaatatgcactgcacacagtgtctcaatcagctgtggcagtgaccatcaaggacattatctccccgggagtagttgtatttgaggacttccctttcatgaaaagaggccttgtgaattcaggtggcaaaaatggtcctttgcattgtagggcatgttgtttcaggccattaactgtggtgctgcatgtggagcttgtttctgtttttctgtgagacattctatctttaatggatcagtgctctctggctcctatggttggagtgaattacatttctctctctttcaaaattttattatgatattttatgttttaggtgtcataaaatcaatcatctaagactattctttggtaataaatagctgacagcaaggcttattatgttggtaaaaactcctttgattaggtttcattgtttctttctaaaattgttaagtcaattttcccccacttccttccctgctctggaattgcacagtgtactccggatgaaatccaaaggagactttccactgcagaggtgcatgctgggtcctaggtgcacccacccctccaccagggtgcccgcacagcatctatataaacctgagtcattctgtgtaatggggcagtgtacaattttcctgatttagaattgggtctctttgctttgggtgatcatctttatattgctgtcatgaggctatttctgtctcaattttcttttgttgggaaaaagatcagattctttttggtgaaaatgcaatagctaaggtgaaagattagataacttcccctctgagcccattagagggaagtgtgtcaagtctagcattaggaaatacgaaagacaaggcatccatcatggtggggaggctgtgtgggtaggtgtgcctggtaagtcatgctgctgggagtattcctgagtgtcttaggaaggaagcaggaaagttaatcatttcttctctcgaaagcactctccctttctctctctctctctttttgtttagtataaaaagcccaatttttttccctccaaaaataaagtaagaagagcagatgatacgtgccctcctcctaccataggaacctaaatttatccagctaaagcactgctcctgtcttagtggtcactgagaaaagttttatgctgatagaatttagaaatactttgaaaaacttgctagatgctgaagtatccatcattaacatttccctttcttgtttggggatatttccatttatgatatggtttactatttagttagtttgctactactactaataaaagctaatttatgttatcaaagctttcctgtggtagactatgttaagtgctttagatgcattgtctcatttttatcagtacagcaatgtcatgagtattgaacattattcctttcattttgcagatgtaaaaagctgagtacacagagattcaatgacttgcctctaattacacagtaggtggccaaattgagatttgaacacaggcattgggatttctcaagtttactcaataaaacaaaatattttagtgtgctcttagatgtgacaacgtcagtatttttctttctcctatttttttttaatgtaattaatggcctctggctatactggcatctttaatacaccatttttaacctggaaatgtaaagtattctggtctttgctattatattgccagtgtcaggcttcttataacattttgtttatgagtaaggagtaactcatgatgagagtgatctaatcgacaagttactgtgttgagatgagagctgaaggctaaagccaaatgtagcatttgctgccccttggagcatatgtgccaacaatgaaagcatattggctcctcatggaggcagcatgtcctctagattggaattcagaatatgcttgctggcttacctctgatatcatctgagcaaatgtaattaatgaggtaccaagagaacgccacaggaagccaatttcattatcaaaacaggtatttgacacaaattacaagacaacgtgactttatccttcctggatttcatgttttcataagaggtaaacttaccttatatttttctaaacctgtgctacattcctcccttcaaggtggttaaatatttcagagcatggatgtgcatcttgttatcttcttccaaagctcaacaggacatgtgccatactgttaaaaggctattatattttagcatcttccaataaaaaattgtgatgtgaaaccgattattaatgctctaaggctggatacatacaggctgcctaaaaacttatgctgtactcactactgaacagagttttctgttgcttattgtaggaggtttctgtatcagcagccatctattttttacagacttcaagtaaatgcttaatctcacttagcaaactcacttatatgctaagtaattattataagtggccaatcatatgttagttaaaacattttaacagaacccactctgtctaatacctaaagagactgtgctgattttttactcagatcaaatgcataatgccttatgagcgacctcactacaaggcagaataatgcctccattggcacataaccagtgctagtagcagtgggtcctccacctgtcattggatgtgtgataattatttgttaaacccttagtatgtggtatgttccagacactctgccaagcattgtgtatgaatcctctttttccaatctcataattaaccgtattctccccattttacagactaggaaactgagcatcaaaactactaagtaaatttcccaagaccaggaaagggctgcgtctcaaattagttctatataattccaaagtccttgccataactaatattcatttctggtggcatgtcacagttcttttaaaatgttgttaagagcttttctaaagtgtagcaaccattatattgttaaaaaaaaaaaaaagttcaaacctcagaaaagggtcaaaatagttcaattaaatacaaattgctatattctaaaaaacaaaacaaaaaacatatgtacacacacacacacacacacacacatatgaaataccttttgcttgtgattttgttttctgctgaactcctagtagaaactaattttgttgaataaaaactggttgctgggaaagttgatgtcaagttgaccaaacaaagataggcttcttcctgcctctgggcccctggccttccatttcttagggcatttgtaatttcaaatactttatctgtccctttgatgtgtaaatatggaggacttgggagccatctcttcgtaatataaacatcagagaagatagcgcccctatctcctaatttctgtggaaagggtgggagcctaactttagtgggctccatgctccaaactgtaaaactatccccctgtcatgaaaacatgagatagtttgtttacatttcctttgggtgaagcccatttgcaagcacagttggtcccaaatccatccatcccagcacttaaataccctccagccttttttgtttgtttgttttcagtgagttgccctcgggctgaaatctggcccacctctcctattgcaatagccttgactaaatcttccttgcctgtttaactttgttcaatataatttttattctgacattactgccttcagaaaagcaggggaaaagtgagtaaaaatgatgtgtgataaatctcttctactttaaccatgtactacttatttttattccagtgttctggacaattaaatttatatggaaaaaacatttcctacaccagcacgttgcacactgaaacccagctagcacatcagtttccaactccagctgccccatcccgcacctgaatgatgagctgggccctcagcgctgattctagcctggtacacaggagatgctctcgatgttccctcaaatggaacactcattgctactgtttttctggctgcagctcaaaatcctccattttgacagcaatgtgttggctattacggactaattaaagtcacttttgaataattacataataaataacacacatttaaatgtagaacaaaattattttctaatcaagctctaaaaatatgacccagcaagacagtccttgaaatgattgtgatgacttatttaatgaaaaggtgcaccttgttcaatatacatatctttattcctaatgtgtttaatggtatcaattgaatagaaatcccttgaccttttctcaaaatagcacactgaaaaaccactgaaaattgcatggtaattgcaacaaatttagcttaatagtaatacatgtaaagaatatgacatgaaattatttaaatgaacttttgaaaaatcgattctatatttgtgaggtgcctgaattttagaggaaaaaccttctgtgttccaagaaactataagcccaccttttctaaactagagaatacaccagctctctcatattacatgacataacttaatctctctgaatctctttagctatgaaaatgcttcatagtttcataaaataatgagatagaataatgtttgtaaaggactaagaacaatgatggagcgcagaataaatcttcaccaaatactagttattattgctatttatcattgcttatgtaatctgaaccttgatcaacatgattcctctgataggcaatcaacagttgtcttttgagtggttgtactgatgacctcacctcctgtgttccagctaaagagatgccacaaaaatgggtgatccttttcttcccccaatgactaatgagatattttattattcaatggaactcttcttttcctagttttacaaaagtttaattgatttgagagtggcctaatatcccattagctatccatcccctaaccactcacagagaattgacgtattattcttagcactgtaaatctaacaggaaattgtccttcctaaacagggctccagaaaacaggaggcaggtctggttccctttgtaacaaatgataaattagagttatttattagggagctactacagcaaagagggtctttatcttcatttaggatcttgaatatcaacataaaactcacctttttaaaacttcttcaggagttttcagaaagggttctatttggaagagggcccccaaactaagagatactgacatgattaaagaccttcttggaacttaagtggttttgcagtgttgccattttgtcaatttactaagtggatctaaaatgtaaaatttcaaagacattttataaaaacttatatttgtgtgaaaaacaaagtcttggaaaatatgtgcgtgtgtgtataaaaataacaaatactaataacaggaaacactcatatagcacttattttgagcaaaacattttttctataacatacttttcatatattaactccagcaatcacatagcaataactatgctggagcaataactccagcaatcacaatttttttctctaggctgagaaaaatcacggaagctgtaaacgttttttgagaaaaattatgaaaaaaatgttatctatctctcatgtgtctacgcttcttaaactgggcactttaggacaacactggcctgtaacattgttaccaatagctggttcaggtttctacctgttcactaagagctggggttcaattagccctcctccatcacatagccaacattttgtattctgaagccatccttttgtattctgaaactgatcatatcaatgtgaagttatcatccaatgctaactgtgcaggacagtgtggctaaaatcaagtataattgagttccatgtgttcccacccaggatgttgaccctgatctagttttaacatgcacagttcccatcaggaggcctgagtggtttcatcagttgcccaccaattttcagccaggaaaagtaacagcattatgtaaaagggaaaatagcttggaatattctttttgtataactgaattgggggaaaaagccaccatttatgttctacattatgccagacattgcaataaatgtcttcaatatattaattaatatagaactgaaggtataaactttctatttttgctcccagagcttagcagagcagtaggtatatagtgacactcaatacctgatcaatgttgaagctgataacccaccaaatatataacttccctgttcattaagagttctgaatggaaccacaggtaattccaatttatcaaacatttgataaaaggaataatttactagtactcaagatgatgctagatttttcctgtttcttccattaacagctttaggaaggtacctaaataaggaacataggacattttcagagaaaaagccattttttgaaggtgggggagggtcagagtgattagaaaactcatgagtaaatacttagggagagtgaggtactcagaagatttgggcaacgcatctataaaggtaatggtgcatctccttacaaagatttgctctcacttgcccaaggactagcaaatgtgcatagaagatacatctgtttcagaatatttacctcaatatgttagttttataaaaagccagtatcccaaaatatagcctaatatgtgaaataatttttatttaagtatttctaacatctaatagcagcagctagaattatccaatgtctaataacagcagcagctacaattattgttatattattttatgtttgcattcaagatggattgcaagcaggaaaaagaaatttaagaaaaccagtacattaggaaacaatgacctgcaggaggggcagcccatgatgaaacattattcagacttaaacaggattcaaaacaaaaacaaacagaaaaacacaacccatattccaagaaaaaagttggaaaataggaaaacatcatataaactaagaatttcattagaagctatcacataaataaaaccaatttctgcccaaagagccaccttcatatgaagcattaaagacaggcttgagaaaaaaagtaatagggaggtggacagaaaaagctaatgtagaaagagatttaacatcagaaatcgaaagtgaaacaatttatggcatatattatcaagaccgggggagataagatcagaggacaggtttacagtgaatgatcccattaacacaaaataatctgaagttcttgttttaacaggaattgatgaattgaaaactgaagagtgaggagggacaaactgaaagagaggagaaaaagttaaactaggcttggtacaagagtgttaaagtagctgtcgttagatagaatcagtagctggtgtgttttgtattttgggtaacagactttggtgcagtagaacagaactaaaattgacagaacaagtccatgcaggcagcaagaaaaacagggttcctgcttcatggaatttaccttgtggggagattcaagctatacattaatgaatgaaaaacaaatacgtaaacatgattgtttcagatagtgatagtgtggtaaagaaaacaaaggtagaaagattccctggagtatggcaattaataagctgctactcacttttcattgtgctatgatatttaacaaagcagacaaaaatcgggtgaacaagcagaagacgatggcaaaagggttaccccatccgccttttctctcctctcctctaccttcttcctccaccatcttgttcttaggtctagtgtcaccagagcaaaagacagacagtaaactagtccataaggaatggttaatcagacctataagcaatggctcgaagaactggatcattcagctgagctcacgaagaaaaagtgacaattttaagtgcaattagttactgtgattcactaggtactcaaggtaaggattctgcaacaagagtatgatagcctatacttagacagtaaaagagggattcagcaagtcctgtaattagtaagaacttcaacagttttcatcgctgtattaatactgtgtaaaatactgaaaaatggattaccctgaagaaaacactaattgagaaaacaaaatcaactataaataacacacaccccaatatacaaagaccagactttgttacatggataactcatgctagaggatgtcagagaagatgagatagaaaaaagaatgtcctggtgcaaaagattaacaccaggaaggttgggcatgtgagcgtagaagaaatggggaagggaaatttgagggtgggaaaatgcagagatgggactgatataatgacagaaaagcaatagcaatgactttttttgttgttgttgttgctaactaacagattaagcataccaatgaaaaccaaggcaagatcttagtaaaggggcctaggatagtgccatgatgtgactttatctgtcacgacaaccaagagggaatgattgcagaggccaatgagctgggagaatggaatggatgatcgtgacagagctgatcattgtgaatgatagatgtttctgggagctgagagtcctgactggcactgtggagccaagaggaaagaggaccagagcatacccagcctggtctcccacgccctgtcctgttgcgaggtgactgccgagctcttccccctccctggcactcagcagctgctctctaagcgctacagtcagtggttacaatcagtgggggaagtgatattcaaatattcaaaacgagatgcacgacatacatcccgatttgctctaaagagcggatttactctaaaatggtattcttcacaagaatgcaaattcattactttcttgtgacatgaaattctcctgggattctaggtgatgtcaatagacaccactagcagatagtggttagtccatatccacctcactcattttgttaatgcaaacaatattattattattattattattattttattattattttgagacaaaatcccactctgtcacccaggctgaagtgcagtggcgtgatcttggctgactgcaacctctgcctccaagattcaagtgattctcctgcctcagcctcctgagtagctgggattacaggtgcacagcaccacacctggctgatttttctatttttggcagggacagggttttggcatgttggccagggtggtctcaaactcctgaccgcaagtgatctgcctgactcaggttcccaaagtgctggaattacaggcgtgagccactatgaccagcaaagaacattattgaatttaaatactgctttaccaaaaaccaaaccaaaccaaaacaaaactaatggaaatgagcctaacacttgaagttatgaatatttggaatcaaatctaggctatgaattcattcatttttcaggggtctacagccaccacttaatggtataagggctgtatggtaacagtatttacgttagtcacatcagaagatgcaaacatatcataaagaagtaaaatgtttcagcttgaattttagggaaacatggcaagactcaaatatttctctattaaagatatcaacgagtctacctgctgtttgttttactactgctataatactctcacttccgaaattcagaaatatatcacttaaggtaatttgctggcagagtgagtggtggggactttttgtcagtagaaaggtcaaataattttgcacaatgtgctgcaaatttttagctttataattttactataagtgacccaagggaaagctcattatattgttacacacaaaaattatgttgtgagctaatggaaagtgaacagtaaggtagaagccctgtgtgctatacccactgctttttctgaaatacataatcttggcatgttttgtttttaattttttcaataaatgtggaaaaatttatgtaaaaaataagagtcctcatctcacaatcaacgatggtataggagggtagccttctatacatgaatataaggcccttctaaggaatataacatgcaacaaagatttacagtaaagccaaggaagtaagaaaaaaagttgactaacctaacccacctgagctcggctcacaggggtcaatgtcctcatcatcgctgggacactctgctgaggccacaaggatgtcatctgtggtctgcaaaagaatcacattcagtagattaatttaaagggtcctaacagattctctcatctttgtctcattgacaagtgaaatacaatttgtttatcaagaaaccaaattcactatttccctttctaaagacacagagcttacattttagatccttcatagaagtaactgcctatttgtgaaaacttgattacactttagtttacatgaggacgcagaaatggtgacagccaacttgtagatacccatccactcaaatgcagatagaagctgcacacagtatcatacagaggtttaaaacaacctggcagaaacagatgatttgaaatttattacagcctggagtgctacaatgtatgcatcagtgggctttatgtagtacttgtgcttggcttcctaaaagcagaaaagccataaccttttacactcacgactatgtagagtttgatgaatctttgagatatagcttgttattggaggaaacacagattaagtagagaattagatagctctttcattggtgcaaaaaggcaaggaaatacaatccatttaagacactttcattttcattatgatttcacacttgaagctcatttttgtaatgttcagatagcaggtattgcttcctcatcatccctttcatcattatggtttcataataaatgaaaagtgtattcaaagtgggggaggggaagaggtggcagttttctctgtgacattctagttgcttcattgcgcttacagcaaaaaagatacctatctctgtaataaaaagcagagtccataaatcctagcagttagtcacataatcaacacactgataagcacgaaaagttgttctttattgccactgacaagctgcagtaaattcagcatagatattgcatggaatctgtaaaggcttccatcagagttggctctgctaaggtaaaacagagaatccaatgtatacaaataaataaaaatatctcattacatctactaaggactaaagagattagaattgttcaaacaattctcagaattgcaacattgatacagttctcatttaaaagtggaattaaaataacataggtcttacttcaaagaaaaagcaaaaatacgatatgagcacctaatattaaaggagcacctaatattgtcacagattaaagtataactaaatttttaagaaagttgtggcattttgaaaaatggagacgaggggtgatgaacttttatagaaagtattaggcttaaaaatctttcaagtgcagagtctttaagaacaaagaatttgttcagatgcgaatgctttacaatataactttaaataaacacaaacctttaaatagcattggagatggtttcatgttactctgctcttacttcttctgagacaattgggagagtttctggattcatgcattttgctgctgctattttagaaagggaaggtgaaaatattggtttgcctggaagtgtaagtctttttttttaactgttgaatttattgacaaagttattcataatattctcactttttattcttcaatgtttgtggcatttgtagtgctaactcccctttcattcctggtatttgataatttgtgggggttttctctttttttttttttattatacttttagttccaggatacatgtgcagcatatgcaggttacatatgtatacacgtgccatggtggtttgctgcacccatcaacctgtcatctacattaggtatttctcctaatgctatacctcccctagacccccaccctccaacaggcccaagtgtgtgatgttcccctgcctgtgtccatgtgttctcattgttcaactcccacttatgagtgagaatatgcagtgtttgattttcagttcctctgatagtttgctgagaatggtggtttccagcttcatccatgtccctacaagggacatgaactcatccttttttatggctgcatagtattccatggtgtatatgtgccacattttctatatccagtctatcattgatgagcatttgggttggttccaagtctttgctattgtgaatagtgtggcaagaaatatacatgtacatgtgtctttatagtaaaatgatttataatcctttgggtatatacccagtaatgggattgctgggtcaaatggtatttctggttctagatccttgaggaatcaccacactgtcttccacaatggttgaactaatttacactcccaccaacagtgtaaaagcattcctattctccacatcctccagcatctgttgcttcctgactttttaatgattgccattctaactggcatgagatggtatctcattgtggttttgatttgcattgctctgatgaccagtgatgatgagctttttttcatatgtgtgttggccgtataaatgtcttcttttgaaaagtgtatgttcatatacttcacccactttttgatggggttgttttgtttttttcttgtaaatttgtttaagttccttgtagactctggatattagacctttgtcagacagatagattgcaaaaatttcctcccattctgtaggttgcctgtccattctgatgatagtttcttttgctgggcagaagctctttaattagatcccatttgtcaattttggcttttgttgccactgctttttgtgttttagtcatcaagtctttgcccatgcctgtgtcctaaatggtattgcctaggttttcttctagggttttttatggttttaggtcttacgtttaagtctttaatccatcttgagttaatttttgtataaggtgtaaggaaggggtccggtttcagtttcctgcatatgtctagccagttttcccaacaccatttattaaatagggaatcctttcctcattccttgtttttgtcaggtttgtcaaagatcagctggtcttcaaagaactagaaaaaactactttatatttcatatggaaccaaaaaagagcccatatagccaagccaatcctaagcaaaaagaacaaggctggaggcatcatgctacctgacttaaaactatgctacaaggctacagtaaccaaaacagcctggtaccagtaccaaaacagatatatagaccaatggaatagaacagaggcctcaatgtaactcttaatgtcagtgaagatcgttagcaattggcacgataatcatgtaggtatctttttaaaaagaaagctttaaaagcaaagacccattctccttttggcacaactacatcttgctgggtaatatacaaacagacttgataatgacgtgttattgaattatgtagtcttgccggtcagttgctccaattccctccagaggagataatcagctttttgtttttttccccccggaccaacatctagcggaaagctacttttattctcaatttcaaattaatttcaaggttacagataatttctcattttctttgaggaatgttaaatatattgatgaaatcaatatagtgttgttcctattggtgttttattcttgttagagggaggaggatataaataaattctttaaaccaatggctctcacatcagcagtgatattgccaccttttccttcctccacctggaggcacgtttggtaatatgtggaaatatttgaggtcacaattggaattctgaggtctgctactatcattgtctctttttgactgctaaacattcttttctttcctcttcctctcttctccttctccttttttctttcttttttttttctttttttttttttttttgtagagataaggttccagctcagtctcactgtgttacccaggctgatctagaactcttggcctcaagcaatactcctacctgagcctcccgaagtgctgggattacaggaatgagctaccacacaatgcctaaatattataaaatacacatgacagcttgaagacaacaaagaatgatctaacctgaaatgttaataatgccaaagttgagaacccctgctcaaaacatttaaaaacagttctgtcttattgttctcctaaaaatatggacagcataatagtatctattgttacaaggatgaaattagtacatgaaaagtacctagaaggggacaacactgtaaatgtttattaaaactttcaatattattatcaacttttttcaatatttcatgaatgtaataccaatttaatttttgcactataattacaaataatataattatagatattaaaccgaaacttgtacatatgaattattcttgaggtctcatgttaaaatttgtatcaaaatacagtagctacattggtattttgttgaactaagtaccatcttttactgtccaactttgaccttttaaaaggcaaacatcaaatataaacttaaaaaactgcttcttaaaaaaattcatgggctacaactgtgtgactcagtgggtagtgtttcatgcagactaaattatttacgcaatacaagttaagctttgttttaaaagctgacctattttcttttggaacaattctacactaaccagaacgtgtgagaatgttctcagtgttaccttctgcaaaacacaattcctaaaataacaaaagatgtcatacaatggtacttcctatagccctcttacagtagaaaaaaataactacaaatgcgacccttttgtaaaactatattttactttttaatgtaatttccctggtataatgaaatacgttcttgattttcatatatgtttttcctccagaaattaaaaaccagcaacaatcttgagaataaaagacctcaaatcaatagatggcttggcaaaaatcatcatcgcagtatgaaaaatcaggaagtggctcaagtgtaggggaagaaaatcaaatttcactttagaagctgaattaactgcacaattttctagccaaagctgtgtaatttaaatttaattcactgtgtttggagctgctgctatgacttgctgttgagagagtggtagaaagaaactcaaatatgtcacattaatcaattctattctttagtatacttttccctgatgtttataacctttttgagaaaagagacaacctgctgaaaaagacagaagcgtgatcaagcagaagcattagctttacataacagtccatttagatgagtgtctctaactgtgcatttaaccacccacaggtgaaattgctatgctgatcttccttaattcagactggtctgtacatgcacatcgtaagcatctcttcttgttgaaaatgtgcactaaaatctaagtctctatacttttaggaagaaaatgatttgaacagaattcaagaaataaaggctgtaaaacttaatccatccttttctatatttgaacaccaatattttgtagggtttgagaaatatgtcaggacgggggcaaaagaatgttcttaatgaatggtaagaaggtagaccaagtgatttaatacccagggatattaaaaagagggagcatttggttggggggaatttagagaaacacagatgtatgtttgttattttttctcacttataggaagccttttatttttcaacatcattaatggtggaattttctgtatatgcatttgctgtcactttaaaaaatatagcttaactgcatatctgtgtggtaaaaatatacaaggaaagcacgaataaacccagtatgtaatattatatccctgctaagaataacattccaagactttattccttatgataaacagctttcctgaagactaatatattccaatgaagacgcttacagaaaactatactattaagacaaatctgttttgtaaggaaaagagcaatttccaattgtaaaataggatattcattgtcagtatatgatacccacaaataaacccgatttattctaaaattttaattgaaagtttatttctaaacagcaacagtgtatcctgctatacctctaaatacgaagccaaaagaattgtctcagacaatgacatgagcattgtataacattatttagcctaatatttaactgttgtgactgatatttagactgaattgatagcaacagttagtgggtcgaggacagtgctggctgaaatatgatatctttggttaactgatgggcacttgttcttgctgatacttttctgtatgcaaagctgctttggaagagagagcgctctcaagtgtggttttcatgaatgaatctaatagtttctccagaaaatatttatcactaggtgaggttccttgaaaaaaaaaaattttaacaggattcaggattagtatcacaaattcccaagtaaggtccaacccagtgtcctgataacctatggagcaagaagtttctaggaggtaagggaagtcataattctcaccagaaggaaaaactgcagaaaataatccacttgtaatgtgtatataggtatatgattcccaaattgcggtctatttgattaaagcaaatcagtaaagaaatagatcaaattggcaatttcagttaatgaacaatcctattaaggtgcaagaggaatttagaggctgtctagatcttattcttgtttccactgtctcaatgaagttgcctcaattgacataaagatgtcaatttcatggctcactatttaataaacataaaaataataagctgagatccagtatgtggaggatgaattttacctccagcacatgaataagaaagacagtgaggcccaattactcaacaatgaatacaaagcacctcatctatgcgtagcattttctgataggcataaaatattctcagtacacatgaaggtataaattgtggttccgatatgcaaataatttactgttctctctctgttctgaggcaaatgaacaaataactctttaatacaaataacaatgaagtaaattcaaatagcttatttttctcggaatgtaacaatgttcccatatccattacttcatttacaattcaccaatagcatccttatctggaatgcagatggaggtactgttattcagagtgttatagttaagtgtctgctaaaaaaaatactcatctgtacactcatctacccaatttgaatgtgtgaacactggctttcatgaatatgtagggcaaagctcaaataccccttaaaacagccactttcacatttctttaatgttctttcccaattgatgccctaggctattacaaaaagtgaccataaatcagctgtctgcttgggaaaaaggcagacttgaaagccattcaattttcttcgaatttttttcagctgtttaaaaagtatgcaatggttccagaaccactaaagtgggtttgagtagaagaactctgccgtggtaaagaaatcacatcttactcagtctaacgttcatttttatgtacatttgatactggttctcctaacaggcaaaactcaaaggaaaatataggaatatggaaataatgtcacagaaatgcactttaattaagttatggggaaaagaataaaactgaatttttgagtaatcaaaaaataacatattttagcaaacttattcaaaatagaaaacctacaaataaggaacctgctgtcagggaacttgaaattaaatttatgtttaaaaaatatgttttttattatttctttatgctactgatgacctctatgctcatattgcatttccatttttagccaaggcaatgtagaaggactggcaaaataaattaatatgaaatttaaactttcaggaagccatggaacaacctatttttctgaattctcactaattagaatttgagaatgtcagacctccaaagactgctggtaatggagtagaggtactgaatgagtgatcaactgtgtttcccgtctctttgtttcgcttttggacaaagcactttctgaaataattttggccatttccaaattaaataaatattgaaagatgtttacaaatgtaaatttaggcttctagctgtatcagtatgaatatctagtcctattatggattagtcacacaggttgaaatgaaaagtagggttctaagctgtatcaacatgagtatctagtcctattaatggattggtggactaattaatagattaattagtcacacacattgaaatcaaaatccctttcggtaaaaggccaaaataaaaccagactttatgattgcaaaatgcctatgatggataatttcaactagcatgactccaaatccaagctttcattgttgccatgttagggaatgaaaacatgttttagttaagcagtcatatatcttcttgtactgagtcagatcttagagatcattaatctaagctcttcattttacatattgggaaactgaagctagaaaattttaattggccacagttataatgctagttaatggcaaatctatgagattatccgactcccagtagattatgtttttctattatcccagatgacttctacctatccattcatctatccatccatcccaaaccatcttgttctctaatgaattttatgtgatttacgaagatacatgataagataaacttaaaataagtgaaaaggttgcaaaggtagagtactggattttagataagtaaccactaaaattgtcctgaagaaatacacacagacaggaggtgcatattcacagcttctgcaccatttgatatggcagcacatcatgtaacactaaaaggggagcacaattaatgctagagttcaacttttaaaaatccaattacagaaattcaaatattgacataattacagttattttgaaatggagttaacccagagagttctttatttacttgtgaaaatcttttctgaaattattgttttaaagaccttacataccatgccctcagtctctgtacctaaatgcataactaattttttggtgacaaaaagaaaatgcaaattattgaatctctttctgtctttttatctctttgacttagaacactgcaggctatgctggctacaaaattaaatcaatgaactccctgctctcttctcattaagccactgattaaaatccttccaacttccaaggtctctctcttactaactactgtcttcacaatgtaagtgccaatgagatattcatctttgtttctctcacacaactatcattagagttctgtcagattatttcttattacatcttgggaataaatacatggaagtgatcatttattagccatattggtagtttctccagaaacaatttaaacatgtattgatcaactcagtcttattgacacaatgaccttcgaagtgaaggttcaagatcaaagatgtagaaggagccacatttacctttggacaagcagccagttataaaaaacatttctctgctactgggtagtactatgaccaatgtcacctgataaactttaacttggggatagatgagaacttccattccacacgatgcttggagtatagaacagcaagaaatatggatgtggctggaaataatcacttagttaacagaaggtgtattttctgattttgagttgattcatgagttgaatatatgcaagactcaggactgcatgcccccaaataagccagtatctgagtagcatctctatgcttgtatctatccagtggtgattgagaataaacattatctggctcagatgtcacaatgttatcttgttcatgtgctaagaggatccagtgtcttctagttctagttaaactggaactccaagcttctacacttgactacttcattccttctggtgcacattggttctttaatacatatttacgatgttgtactgctgaaacacctcagtttaatttatactatgctgaccaataatgcaaaataaatactactccagaattcaagtctcacttttagttttcatgagcagtacacatcatcttggactggtttctgtgttctaaacatgacatatgaatatatacatattatacatttaaatacatatatttatatatgtaattaattgtgtctcacaggatgttaagggagtcaaatttcatatgtgtgaagacattttggaaagtgtaaaagtgcccacgatgcagtgtttgtataaattattattatagaaaacacatggacaccgggagggcaacatcacacaccacagcctgtcagggtgtgggggacaaggggagggagagccttaggacaaatacctacttcacgcggggtttaaaacctagatgacaggttgatgggtgcagcaaaccaccaaggcacatgtatacctatgtaacaagcctgcatattctgcatatgtatcccagaacttaagaaaaaataaaaaaattattattataactaataatttttgttcctcacatgatgctacaaaggagagctccggatagtgcttgaagaggacaacccaatgtccatttacctgaatacattttattttaatgtcctgaaatcctcttgtccctcagttgaataggatctgtatctctcacttacactagcccctcacacagatgctgttcttgggctgcttcctattatgccagcattgaattcattttggcattccttatttagggcatatgtgtggatctcactggtaacttacaaggtaggtagcaccaatctatgtctggcattatgattacctttcctccgaccagatctcctggagagcttagtgcacagactcagggatacttgagctctctctaaattctaagttctactcattagattgtgagaacctgatttattttatcactgcatccagaatttaccactctgttaaaactacagcatataaatgaacagatgaacagggaaaaacagaccacttagcaaacaatgctaattaaaggagagaaagagagagaaaaagggagagggagagagaaagactgaatctctaagtgtaattcatgcatgacaatgctccttacaataggagtggttgtatttgtagttataatatgactttacctatggtttgtcttctatacggattaataatatgcttatcaactcctgttaagacaatgagctatcttttcttagtgcattagaatagtgggagtacttgccttttgaaatcatcttgaaatctaaaagtatgaagactgcttagtgatatgttttattttatttcatatgctgcttttgggtacagtttatgttttatgcccccagggcatctatacaggaattcagtagagctgacttaaaatgacataatcactcaaaaacctggcttatattcttaaagcatttgcgtgaataaaaggattttttgaaaataattatgacttgaaaaataattgttatgaaaatacagcttagttaaaagtgagggattcatcttgactttaaaaatagaagaaatattatacatgacacttgaatttactagaatcatcacattttaaataatcttactcttgatggtcatccactctaagctcactacatttttggttatgaaaaaggcatgattgtcacaattgctcatttataccagctaattaaatctcaatataaaattgaacaagtatagattattttctaggaatacacctaagagtgggagatgagaattgtggcaaaataacactttttcaaagattttatctgccttataacatctctagaagtaacaatgaaactttctaactggcttccacattataccccatggctggaaatgtatggtagagaaatagcaaaaagtgacattatctttaactgaaagagagaatgactgaaggttagaaggaaggcaaagctaaaaatgtcttgcaataagttggtcttcctgcttttatgaagcattcctgtcctttgagaaagcagtaagataaagcctactctgtggaagggactgagaaaaacatagttaactatcattttgggttttttttttacctacataatattcctcaactatctctatctcttacaaactctcttgcaatagtctattgcattataaatgcttttacttagttgcaaaaaagaaaaaaaaactattcctttgtaatgttttccttcaaaatctaactacaggatgaaagctttatctttttcctgaaagaggccagccataagattcacaccaagaaatagtgtaagacagaatgcactaatcaaatctatatctactgattctgccattcattcattcatccatttgtactcatttgttgaatattttcatttaataaagagttatacaggcaaggaataaaaatacaattttctgactcagaacatttagaatactgtggtggcgcatgcaatccagtttcttttgggtttggagaaggcatctatcattttatgcattaatcttttacccatgtattaagtgttcacactgtatattcaaggttgcatccccagggcctgccacagtacctagcatgtaagagacaaatatctggccaatcagtcagaaatgattccagccagtataatcagaaaaatagaagtaatttgataggaaaaataagtccaacactaccccatcatgctagacaaaacaaaagtaccttagagttttacaaaaacgtttccaaatgcaagggattgacagaaccaaagatgttctatgttctctgatacttcagctatcagctgattagaaaaggtatcaatttgaaaagcaacgagaagcattgtcatgttaacttttttggaaaatgtgactgctaccaccattcactgtaaggcaatttgtgctccttcatttttacaactaataaatggtgccagtgtttatttttctccttttccctttgatttcatttttttcatctcttcctatttcattcatggtgtcccaactcccagaggagctacctcaggaaaaaagatctcacatagcaagaaaagtccaaggagcaaatgctgtttgactctaaccaacataccgtagcaccttaggtccatgtataaatttagggaagagaattacatgctctcttccagttattattatatgattccataagtcaaagaaatctggaaatgtttctatgagtagaaatttgtgataaaggagatagtcttttttactctgctaaaatattttttggtacaaggaaggtgccctgtatataactgttgatttaatttgagatatcatgagccctgacacttgacttttagttctccaatttaagttactaagctgcctacattcgatcaggataatttgccatataatcatgaatgggtaggggaaattggcagcttttaacggttctcaaaggtaattcctaagagaggtgagttggaactgatgaaattgagatagatgctaagtgaccaggcatccctgctttgaattgtgaaattgaacttcaatgtgtaacaaatgcaggccttctatgagcagcaagttgctttttccactactgagcatggaaggagcatgaatgttggagctgaacagactggtcttaaatcccagctctgccacttactagctgtgtaaccctgggcaagttccccaacttctctggatttctttcgatgtaaaagtgaagttatttacacctattttgcatgagtattacatgtattaaattatctagacctagataggcatactatctagcacagtagctggtatatggaagatattatcatgaatatttattacatagatacaaccagctttcaaaatgaatggctcttgtagacattttcacattattctcaccgcaatatggaaattaaactttattcctagcactggactccctaatctttagagacaaacacacccttcacagagaaagtacaagtttctcacctaaattcacacatccatgtttaaatattctataaacagagaagattatatgtttgataggacagcgcttgtaaaagcacctcaaaaaatcacattatcagtatattgaaaatacaaggagcatctcttctctctagctacacgatgtaatcaagcatttgtcaaatcatatttggaggctctttgaattatgtgctccagttcccttttaggtaaagagaaggaaaccctaaattggcatggtcaggtgtgggtcagatgtacagtaccaaattactgcactgcactgttcaggagggacttaggagtatatcccagtttcctggctctccatccagttggcgtcttgctccttctactcctcctagtttcatgtttgggtatggggcagataaaaataacagcgggaataatttactacttttcccaagtttcttatacataacttgactttttaaattcttccctatgtcttactgaaattttaagtaaggcctttgaaaaatactagggaatgatgccgtcactcacagctgccagactggagagcactcagtggctggtgcaaagcccagtaaaatccaaccaaagaacacaagtgcagaaacaggacaagaattttgctaattgtcttctttgagaactaggagcttcattagagaatttgcctttgtgcatgtatttaatgagatgggatatgctgctgaactcttcctgcaggtatttcagtgttttatttagttatgatattgcctaatgacctctttttttggtccactattcagacatttttgggtcatttaaaaagttgttataaataaacatcacttacataacatttagatttctaagtgattaaacatatcctctcttggatagctttcctcttgccagccttgcatttacagtctgtctcactcaattctgacatatttcattgcagttgttatcacgcctctgccatctgggtttgtccttttccttcccgcacacctctgcaatccccgcctgccctcttcccttcgttatcattgcttagatgcctactaattaaggacaagaaagaaacctattcaacataaatataccttttatcatcatgcgaacttacacagatgtagctttttaaacagttcagaagacaaacttttcttgatgatttggtgtcatttttatgagcacgagggctggaaacacagtagtgatctcaaagagtattgctgactattctccataggtacccaagttgctcgtttactttttagtctatgaaagctcaatctagcttttgtcttttgtcagcctttatagacctctttcttccttccaatttgccccttcggatctgctttgagctggaaatccagataatcaaagttctccgtcctgagaaatgagaaattggctataaggtaaaggatatcagagaggttctcaaatgagaaagcccaggtgcatgagagcactcagtcaaggctcatggcttaaaatacacaagacctgttagtttcttccaaatgcaaagttcttcgtgaaggtagtatatttatttctaagcgaatctcagtaatattttcactatgataattttcaaatgggcttttcttattttattgagtccaagcatccttattgaaacaagattccacatttctaaatttctattttccaagatctattcaaacagaagccaagcctccttttgtgttccactgagttggctgggagggagggaaatgaagatgaagtaatataataagaaaggtggctgtcttactgtcattgactgctttgctacctgaaaaactcgaaggtacactggtttatatttttacgtagaacctgatgcagccatgcaggcatccagctgtatctatccagagtgggtgattcacctggtgtaccctgaagagacagagaaatgctcttcacggtagcatctttttggtttcctaggaccagttgtttgcttgacaaattgagaagccctggtacaggttatgggatcttacaatgctgctttccagtgatctgctgcatgggcattggagtcagacttacccaagtttaaatctggactgtactatttagagctggtagaacttgtgtgatttatttaacctctcatttgtaaatgggagggatgcactgccaatctatgcagtagttgtagggattaagaaaatcatgacagatgatatacttaacactgttcctggtgcgtgataaattcaaaataaatattggctattatcaccttcattattattttataagacatacatatgttacctccagcatgctgaaaataacgtttcttaataaagtaggcaaaaccccagtatcctaacattcacaagaggtagacaatccacttttgtccttgcctagcatattgtgaagtggaaggggaaaaagccaaacagtgcatgaagaatgcaaatgtattttttttcctgaatgttctcttttgctttttgacttttaaactctactttatttcaaaacacagtcccaaccattccaaagcatttttgaattggaaagccttctttttttgtttcataataagctaactgcaggtgcaaactcaagggagacagaccttggaaattttaagtatgttgccatggcaatggtttgcaagaatgtgtatgagtttcatcttagctttcaagcattcaactgagttcatacgtggaggttcaaatcactaggcacacaatgtttgccactcattgtgtcctgaaaggtttggaaataactatctgtgttgcttatagcaaccagaaaccacaaaattctatttatttatttatttatgcaaatgtagagatctagtcattcatatctgctcttaggtggcctatctcaccagtgtggctgctctaagagaagctgtacacataatttcaacactaatcattttcaccattgttgcaaacacagttgtactcccaatatggagtagctataaaaatgttccactgaatatcacattaatttcctcattcaaatttgacagatccttccagaagcatgataattatttaaagatgttgcattaaagcaaaatttcagtctaatgaattgtggagtatttccttaaaagtgtctcatcctatagtggaagaaagaaagtgaaagcacacaatccagtcattaaattaacaccaccctccccagaaaaagcaccagcaccggcactgccaacaaaaagacatgcaaaaaacatcattttatcacatattactaccccagtggttcttaaatggttcagctaatgcttctaaattccaaaacctgcacactgaactcatgcttcattgacagaggaggcaatggttcttgacaaaagcattcttttccccataaatggaatccatagcatactataattgggtaagttttaaagctatctattgggtacgggaaataattattaacaaattctcttcaaattacaaggctttttttcatgtaaaatgagtactaaacaaataatatcatttttaattaaataaatgatttatttaattaaaatccagcaagaaaaagctggatttctaggggtgtatgttcttcatgttttctagcgaaaacttgctgcaaatgattcatcatgatacagcagaatgccctacataaaaacatggccacaggagaccccagtatctcctgcattttgttactgactgaacccttcacaaacgcattattagctaccaaaccctggcagctatttaaaattcgcattgttgctttaactttgacccatcttccaaaatgcctgcgcacgcatgcacacacacacacacacacacacacacatcaatctctcaatctcccgtcctccttgttgtaacattttgttgacgtacttcaaaactgcagtagagcttccctgccctgaccctccattctaagaagcttacagcaatgctggaattaaacaaatgagaacacaataattagctatgcaaactgtcaactagatctaaaaagaaaaacaacccagaaaacacaacaatcagcagtttcaagccctaacaagaatctgcattgaattctcatttattttaaacaaaaatagattaggccttttgaaaaatattcagtgaaatttctatggaaataggacaaattagcctataggtctttacatctctaatttctgtgttgctgatacagtagaaaagtccaacactctttccaaataaatgctcttctactctttaatagccagatttacttccaaaggtgagtagcaccaaaaatatttccaaagtggatatgaaacaggttagtggatcaaattatatggtgtgacaccgcagttcccaactctgtccccacaacctcaccctaatcattttatcaatggtaattaaaatataaagggaaactgtaagggaaaaataattcttgaaatatatggtgtggctgggtatggtggcacacacctctagtcccagccacctggaggaggccgaggcaggagggtcacttgagtccagcctgggcaacatagtgagaccctaacactaaaaaaaagaaaaaagaaaaatatctggtgtgtttgtggtatatgaaggggagggaataggtattcaattctttgggtggagagtattgattatataatttgtagctaaatctctcagtttcttcatagataccaatcaactgcctcctcacccttcgggaaccatcctgagttctgatgaagcaacatggattatctctatgatacagacactttgaatgaatactaatctaatgcttcaattgactgttaaatgttctcttaacccatttgcatcccgtaatagaaatttggatttttttaaattgagaattgtaatgactctgtaaaagttttgttgcttcaagtcttttatctttaaacttgctgaataactgcctactttataaattgagaatgtaatatgtaatgcctgaaactagtgtaggacaagaaatagtaatctaagttttgactaagagttctatgtaacccattgacctggggcaaatcactcctcatcctaatataagtaggttagagtagatgacctttcatatttcccatgcaatgatggagagtaacacaagggagtcctgtggtaacggtagagggtaatatcttgattgtggtggtggttacaagaagctacacatgtgataaaactgcatagaggccggacacggtggctcatgaggtcaggagatcaagaccatcctggctaacacggtgaaacctcgtctttactaaaaatacaaaaattagccgggggtggtggcatgcacctgtagtcccagctactcaggagcgtcaggcaggaggagcccttgagcccaggatatggagacagcagtgagctatgatcatgcaactgcactcagcctgggcaacaaattgagagcctgcctctaaataaataaataaataaataaataaataaaatgaaaacaaaatacaaataaaatgaaactgacaaaataaaacaggaaatatcacggattcactaaaaattaaatatccatatttatatcccgaggatgctgccatttctgcccagttagctacccctacaatgtgtaatcttatttttcaatcctcaaatcctgcagaatccttatttatctgataattcaattgtgctcaatatgcttccttttaacgtcacagaattcggtgaattttcctgacttccatgtggtcgaaaaataatggctggtgacttagaaattttactgctatgtattggcttcaaaatttgtctttcaagtgacaggaatggggcagaaaaagacagtagatgccactagcagagttctggtgtaggcaaagtagaagaaaagaggcaaaacaaacaggaaataactaagcaagagaatgagcagaaggaaggagaaaagctaagaaaagagttcctccacctatgtttgggcggtggcagagtgtctctgtccattttacaagtgacatctatgatacagctatttcatatttaggaaagtagaatgaatcacgcaatgagatgtgaaataagtcttgattacagtattctagaaaggggcttaaaagaagcaaaagactttactcctggtaaacaccaaaccttcagacacagaacagaaatgtgccgttagaagatccctctcacccccatcctttaacatctttcaccaaacaaaacagggtaaaacaaactcaggcagtttctcaattactttcattaaaatgtctatgaacggtgaattaaatgacgaatctctttcagaacccattaatactttttccagagctaatactatcagtaaattttaaatagtgggaggaattattataaaagaataaaatatgtaacagatgctgaatcggtcatatgtcccagagctgctgtaacatacccaggcccgtacttcatgtgtccataacgaaaagagctggctgagaagttatgaggccacacctcacaacacctcaccctgctctctccctagtcccacagaggcacaatgcttctaaagctttgaagcctgaagttcagggaatgctttaaagatgaagtgtttaagctattttctggaagccaaatctatcattttaagattacattaaaagctacacttctactgttcatatcaatttacgctccaaactgctggtttctcagagcatccattgaatcctggtgggaggtaaatagtttctgtttagattttgacagaaaattaaaatttaaaacataatcactacatcttccatatactaagaagtcttcggtggctcatgctgtaatcccagcactttgggaggctgaggtggatggattacctgaggtcaggagttcgagaccagactggcaacatggtgaaaccccgcctctactaaaaatacaaaaaattaatcgggtgtggtggcgcacacctgtaatgccagctactcgggaggctgaggcgggaaaattgcttgaactagggaggtggaggttgcggtgagccgagatcacgccattgcacttcagcaaaaaagccaggcctggtggctcacatctgtaatcccagcactttgggaggctaaggcaggtggattgcctgaggtcaggagttcgagaccagcctggccaacatggtgaaaccatgtctctactaaaaatacgaaaaattagctggacatggtggcgggcacctgtaatcccagctactagggaggctgaggtgggagaatcacttgaacccaggaggtggaggttgcagtgaaccaagattgtgccattgcactccagcctgggcaacaaaagcaaaagtccatctcaaaaaataaaaaataataaagtcttgaaatgataaatgtaaaagttctttattttattttttgagacgagggtctcactctgtcacccagggtggagtgcagtggtgcaatatcagatcactgcaacctctgtctcctgggctcaagtgattctcccccttcaggcccctgacaggtgcaggtgcacaccaccacacctagctattttttgtatttttggtagagacagggtttcaccacgtttcccaggctggtctcaaactcctgagctccaatgatccacctgccttggcctcccaaagtgctgggattacaggcatgagccactatgtccggtttcaaagttctaattacgtttccttgtgtctaagaaaaaattttttctgcctaaggtttctaattattatagacaccagcaggctataaatatgtatatatattttgagacagagtgtgcctccgtctcccaggctggagtgtaatggctccatctcggctcactgcaacctccgcctcccaagttcaaacaattatcttgcctcagcctcccaagtagctgggtttacaggtgcccaccaccacgcccagctaattttttgtatttttagtagagacggggtttcaccatgttggccaggctggtctcgaactcctgacctcaggcgatccaccctccttggcctcccaaagtgctgggattacaggtgtgagccactgcgcccagcctaggtttttatatataaattgtgaacagtcataaaaataatttgtcctacacaagtttttgtgcctactatagactttcacactgatagaaaaaaaaatgcttacaaagcctttttctcagaggatctcatttggcagttttgaaatttacttttccacaaatctttatcagtggtaagaatgtttctgaggctgtgctgtcaatcacttatgtcaccactttccttcccacttcattaggaaccacactgtactttatttcttaaaggagaatctgaaactgatttggggaagaaggacttttagtccagagtatgcagcattgtataaaatatgtattgatataaagcctaaaaatacacacagtaggtacagcattcacatacgcaattatttagcaggttcagctggtgtgattttacaccacagtgttcttcttacgaataccagagagaaaatcaaagtttcttgacatatggtaataaatattttcacttacagtaaataatttttgctcttttggcatccattgtataaaagctagtttgaaatcattccaaattagcaaagctagaagtttggtaacacaaggggaacgagcagtataggcccccataccttcgttttcactgaagtgtgcttgcttttgagatacaacactgagaaaacttcctcattttcaagatgaagagatgttatttcttcctattgtgtttctaggactcgaaatgagcatctgtattcttcattatggaaatggaaaatgagtttgccctataattaatgctagacatgacaatttttctggcactaccttcaaaataaaaattttcaatatgaaaatctcataagaaaatctcagatgcagattcatctcaaaatccaggtgacataattcaacaaaatgaaaagcagcctgtttataagaccaattttctttaaagcatttcttttttttttttaaggaaacacatttattcacactctaaaatcatgaaatgttagacctgcgaactcctcaccttacaaacaagaaaatcaggtatcagatgattaagccattaagtcttcaccagtagatacagaactttctccagtacaatgtcttcacataaatcaattaaaagaaaatgctctaaaattagataagctccaaagagtaatctgttcacactgggacatgttgaatttgaggtgaactgatagcagttgtaagggtaaatctgaagttgagaagagaattctgggctggggatcatatagatttcccaacgaaaccaaaagagaaaaggagattctgagaccaccttcagaaaaatccaacatttaaaagggtagaaagaaaaagcaggtacaaacaaagaactgctttcctgttaattgtttttactcctaaaatatttgattgaatgtttccaagtggaaatctgaggagcccagtgaagaggattctcttaggcaattggtggattctcttaggcaattgatcgaacccagtgataaatttcccaaagtagtcttatgacacacagtgcatctatgacacaaaaactgtaaagtaaatcacttttcaaaagtaattcaccttaaaaattgattaaaattaactgaatgttaatttcttagtattgacagatatacaacggttatatgacatattcacattagggaaaaatgaacaaaaagaactctctaaaatatgtttatgacatttctagaatctcaaattattctgaattaaaatatttatttttaaaataaagcatgctgatctgattaactcccatatattacatataaaatgacaaagctgtgatatttataaatacattctcttttaaaaaatgatggagatacattcaacaaagaaaaatacaaccacaaccaaaacaagcaacctacaaattcctccccacttttgttacgtttatagacataaaacatgcattatccttgtttgaatggcatgtctttgaaaatgtcctcccattttagagtttcaaataaaacaagcatatacttttctacttaatctcatcaatttaaaccttcatatcttttcttaaagtactgcaaagagtagatgcatcatttagggattgctaggtagagtgaaataggctggagtcagtatttattttgttattgcaggagtagccttctgtttaaaatgacaccttctcttgcaattgaaatcttactggctatgtggaaaactagaaagtcaggaatctagaaaacacttgttgcagtggatgtcttaagaagtgtcctcagcttccttttctctagcctgaggttttgtaaagcaatcaagagctattcagtttaatgttttatacctaggtatcatttcagtcagttttaatgaatggttcacaaaatatcccataattcttcaccatattttaagctgcttactgagaaaataatactattgatgaccattccagtatcaagagtaaatggtttacataattattattacttattcaaaattgtttcacctaaggccagattctcatttactgcccagacccactcacactcacctacccactccatcccaccaaaaaaaaaaaaagaaaattaagagctggcgaaggaagtagaataaggcaaacaaagaattattgctacagcaatttataagaacgctcaattataccctaagggtctgagacagttatgcagttatgccaaagtgtccaatttactttttctgaagaaaaacacttagcaacaatggctaattttaatgaataaagagaatgaatacaaactaaatatgcagatgacttttaaacaaaaagttgcatccattttgcattacttttatatttcataaagcatgaaaccggcttttaagaaatcagtatgttgtcctgagaacatgtagaacaataggaaacaacccccttgactgattttgagacaagctacttgggtcctctctggatattctagtaccctcggtgtccgtaatgccattttagaagcaggtattgatattaagggatgtgtagcctacctgatttgacctgattttgtgttaccttttatttcgtgactggataactagtgctgctcaaacacaggaaacatacagcgaaataacatgaatgtatctccttgaaccacattaaactctcctttctccaagctaccttgaaatatatagaatacaatgagcaaatatattgacaagacaatgagcaaatatatattaagtaatgctatagggtaaaatagttaggccttcagtgctcctctagttttatgcctatttgtcttgaatcctcaattgaacttttaaggcagcaagtgtctcatttttctttgcataacccatgacatctagcagtgttctggcatagatacaatcatgcagtacatattttaacagatcttaactaacaatgtacaaaagcactgagaggggtgcttagtaattacttatatattttaattttcaacattctggaaagagatagtaaaattcctaaaggctaagaaacctcttggcaagtccaacagtagcttatccccggccaaatttttggcttgctatatgtacttttaagcctattagttaatagctacatgtttaacaatgttttacatagacacacattttatacaaatgttgtagtcccactacaaatctaaagagtagatgatccactcaaatctagctgtgctaatggagggatgcatggtatataattaaaacaatgattttgaagccaatggagggtaactggtccaaaaagcacatctaatcatgcaaaataattcattatgtagacagttcatacatggaaaattgagaattgactcccaaggctgtacatatgcaacttctaaataaagtgctttaaaaaaatcaaaattctatgtaaaaggtttgatctgacaataaaatggttttgaagtcataatggcagccttagttttatatatgtaattacaccttattataaatacattttattacatatatataatctatacatttgcatataaagtatttttttcattataggtaaattcatttcactggacgactgattaggaaagaattttgtctttgatatactctcccatccgagtactaaccaggatcaactctgcttagcttctgagatcagatgagaatgggtgcattcagggtggtatggccgtagactgatatactcctgtagagttttcaacttgaacgatgttaagtcagccaggtaatggcatttccccatactgttaagccttcactgtatccatgactttactaataaatttaggctgtgaacttatgtaatcatgttttccatcaaaaatctgaaataggcttagagccaagatggtggaaccctacaagactcattacattttaataaaaaagcagggggaacaaaggtgagagcacaaagactgcagaactaatttctttcgggaactgacttattttggctccccaaaataatattcaagtcattcccaccatgataaatagtttttgtctttcaaagtaatgaataaagtaatggagactttataacaaaaggctatacattatagtcatgggaaaatagtaaaacaagtatttgaatgttttttattcccaagaagatgaattgtggcttaacccacagatcaaaaaatatatagcacaacactgaaaaaaattatcattgatttttgggaaatctgagctagttacttatgattaatcaaatgaattaaaataaaggtgaaaatttgaggagcaaatggaaacgggtagtgataatacacatagtttatgatgcaaaaatataaactatctctcatatatttctgctttttaatagttgttactcagtttgaactcatattgtctttaatgtgccaaaagaccctagatatatccatgaatgtataattgtctgtgactctctccaatttttctgtatactggaaattgcctacctactccacaatattgtccttagctccattctctatgctagagtgatgagggaaggaggccttcaggagattcaaatatcagctgtcaagtaaatgtaaataagatagcagaaggtaaaatcagtctttctggtcaatactggtaactctagtgtaaattttaaaaacttaaatgctaaagaatgtataaatctaaacttagtgtcattatactatcttgaatttgcacaaagattattgtttatgtctttaataatctcaagttctgaagcaaatggatgccatttttttctatctattggtgtttgagtccataaaccacaggtaaagcaacagaggaataaaacactgggagcagggaaaatgggaggtaaaagagaagactaaataataaaaggcaccacttgatctaagtatgattaaatattcattaacgctgttcagctgtggattttggtagtgctcataatactagaattaacagcactaattttgatagggtgaaatctcatttaaatgtcattttctaaatgggcagagtataagttcttaaatatttaaacttaatatagacaaaggcctaaagtacttggctacatgcttttttcccatttgaaaactaaaaagtgtcagctaagagggcttttcctatcaattagcattctggttactgaatccatcatatagttaattgattgcccttgtaccttatcaatgcacccagatgctgtggtatgaacacatttcataaattaaagaagcatatggaagtgacacagacagtagcatttcatcccagaacatctttaatatgcgatgctacatcactaattattttgtaaatatgtaagtatttccctagttaatgtgttggtgagaagtttgcttggcagttgagcccaaatgttattgtaaccagacatttaataacagttcaggactcttgtagtttcattccattctgcccataaggagaatgtgtctcttagcctactgggcaaccttgattgtgcaaagtcaatgaaaatatttatcctttattactgggtaattttccttaatgaacagcagtctactctccataatataaatatctgtccaaagatcggtctggagactctttctaaaaatgttacagggaatttgccaagtgaggagcatattgctgcttagtgaatttttttccattaatttctaaggatagaatatgaaggaaattgcagcagaaataagttggctttattcttcaactttgggaaaactagtataatgatctgagtatattatcctgaatttaccttaaggtaccaaaagtaaaaatttttttcttcttgtctaagtcataatttcttgtcaagccaagtttcaaaagttaagtcaaaagaactttttttgagaatggaaactttctttggagaatggaaattctctacattaattaatgtattaatacaaaatccactagataactgacaagtgagctgcgggcaacccaaaagattgcatttaaacattttaaatttgtgtttctgttacattttagaagcatgatttttgtcagattaatttgcacttaggactgaaaactgtatctgggttcaactagaattttgtaagagtcattaaaatcagaggattcagaaataagttgattttcatcctccttcagtcctatgacttttctgggcaaaaactgtgtccagttctctgggagctgggggtgacagagggcttgatggaggctgctgagagattaatttcatttcagaatttgaactgggtattggtcaggctccacgctgcatgataaaatcaacaaatacttaaataaaatattcaaaagttattctgtaaatggccatctattaaaaagtcagaaggaaaataatagtagattagtttgcatggctctaaacattttcagaattgaaaacttatttagggaaaaatttggtaagccctatagatgcttgaatcatccaaagtctagtaaataagtttagtattaattgccacttttatatttcgatgctactaactaaaataatacaatagcctactgttaatttctcttctgcttttcctgagcttggcaaagagaaaaatgtgacaaacaccacaaatagacaacacaccatttgtaatctggtaaagcaacttctattcatggaatttcttccctttatgaagcgagggctatctaatttaatgaaaatagttgtcaccacagatatgacattctgtctcctaattaaatgaagatgcaatcagaacttcccttgaaaagagaggccaggcttccttcactattaagcacactcttccctaagggcaccctcctaccctttttctgatatgcaatcccttctgtcctccatctgctccacccccacctattgtctccactcactccaagcatgccaatcccatctggctatactcttgcttctgctagctctaattctccacaggcctagggaatgtttgaatgccaaggcatttttgcttttctcgagaataaggactagctaggagggtatcaaacaattccccaaggaattcacacacacatgaacatgcacatggtctctcacatacacaaacagcagtttagaatcctcctctaggatataatttctttaaaaatgtttttaattatttcatctgggaggcattttagaaaattaaaatcttactattgttgaaataatcaaaattaatatttcagaaataaacactttcattatcccagacacgcatttttttcagtaagcagaattaatgtaagtaaatgttactcatatcttatcatgaaatatttacattaatcaggtttaatcactgatcactaatacgttttctgttttagcaaacatgcatttaattcagacattccatctttacaaatgctcatgaaaatcccactctgccacaaaagcatgcatggtcagaatctaagcatatttaagcaaaaatttcagcaagtcattaacaataataaagcagtctggcaagtactgaaagcagcttttattcatgcttttacttgaactaagttaatacatatatacatacatatgcacacacacacacacacacacacagacacaagttttggttgtttttgccacaagcatgctgataaacccctgaagctcacacaaagcagcagacaaaactagaagcaaccatgctcagggtttaaggacattttaaaatttaaaacaacctttccacatttcacatacagcgtgcataaatttgacatgcaatcttcaagaagaaatattttaacataaatcttaaaattagtttatccaaatgagtttattcttattttcattattattgtttttaggcttctggtatcttaaaccctgcatgctgcagatctaagctgtgctcagcagcggctgtgacagaagaagctacctgcaagttttcacagtgccatctcatatccatgtctgtctggctaccctgcgtgcttagagcttttttcttaattcttaatggaaatcctaggaaatttagtccatcctctgaaatcaatactggtgacaggagagctccctgactcagtgggagatcaagatgataaattgcctgcgcatcagcccggcctatcagtgccctgcacacagatgggcgagaaaagacacagaaaacgctctgtcagtcacgtgtcactgaggagccaatggctgacgcactacggcaggaagggatgctgcagttccgtctgcagttgacgaggctgttggtacacagcccagcccggcaccactcaaaaagtctcagcagtcgttgcttttcaatttgctcccctaacgagaccgcataggtaaacagacctccctctaacccccgaccgaaaaaaaggcttattttcatgcacgaacattttctgtatattacattcaaatccagtgtgattgctaaacacagaggggaaacttttttttccccagcccttaaactgttatgtgtttttcttgagataattatctttttacctaatattaaattagaagacttaaaactgtgcaattagcatggaaccctcctagtagaatctcctcgaagccttgtaattgtaattacaattttatttgtaagttaatgaatgacattttttgaatgccaagtttataatgagtatttttatgggatgagtttgtaaagacaattatgcaacattaagaaatacattcttaggcttttttttttttggccaattacaactgttgctctttaaagacaatttaagtcccaataaatatgccattttatcaatcattaaaaataaaaacaagcaccaaaagatgcacatcctgtttcccaaagcctgaagaacaaatgtattattcaatgatgaaaatatgtacttatttgctgccttttctctgaaatttacaataattatttggtaagcaaagactacacatctggaataccatatggaactatatccccaaatacatctgtttccagtgatcatactgtaataacagatatgtttacacacttcttcaatgtgagatgattatatatagttatatatacatatacatacaattatatattatatatatgattatatacagtctgacagggtaggctataagtgatgagaccggtgtgtgtttcaaatgacagtatcacggagattttttttttaaagctcaaaagtagcataaaacaatcttcaggaataaaatttctagaagaaaaattaccctagccaccctggcacttttattgcttttcattgcccagttttcatactattcatacatttgaaagaattaattctaacatcttttagagtctggcaacactatttagaaaaaaagtgtattggaataaacattgataggtgtgcctcataagtaaagcttatgagttgtagaatgctgaaattccaaagctcaatttgtcttggcaactatttttttaaactaaacacattcctgaaagattgaaccctgtcaagtttttttgcaaattctttctttcattcaatattgactatcaggaaataataaagcatttttcaagttttttaaaatagatgttgtcatgtgtttttttctatttattcagactattcaataataacgtaattctcaacaaactttattcttaaaaaatattatgactcagagcacctgtcattaaaaacaaaataataataaaacatcaacactaaacctattcattagagcactgtaatagccccaaactagaaaccaccttaatcactgatagtaaactgagtagataaactatgatacagccttacaggtgaaatactcttcatctgtaaaatacaatgtggtaaatcatatgtccttatatgaagagatttctcagatacatttgaatgaaaaagccataaaatttaaattgtgtataggctatacttacttacataatacatgcatgtatacacacacaaatgattgcatatgcggaagaatttttttttttttttttttttttgagatggagtcttgctctgtcacccaggctggagtgcagtggtgggatctagactcactgcaacctctgcctctcaggttcaagtgattcttctgcctcagcctcctgagtagatgggattacaggagagtgccaccacgcccagctaatttttttttttttttgtatttttagtagagatggggttacaccatgttggcctggtgggtctcaaactcctgatctcgagtgatccgcccaccttggcctcccaaagtaccaggattatagaggcatgagccaccctgcccgacctacaggaaatttctgtaaggacataaactatcagttaatagtggccaaatagtggctacatctgaggagactgagttcaaaggtaggactgagacatagttttattaggtatcattttatacattttgtttaagtctatggtttacttttctaatttaaaatgaattaagataatgttatcgatgttcatgtaggtttagaagagcatgactggtatgttttgagggaaaatcttgagggaaaggaaggaagacagagggaaggacatgtggcctgctttttttcatgtaaagaaaatagtgtaggtgtgggcaagaagggaactgtaaaataaaggttctggcaatctctgctgaagaccttcacatctcatatcaacttgaagttcttttatctatgaatgcaaataataatacagacatggattaagagctttacaatttagagtgacgattaacccaaattttgtctgattcttccaggaacgaatgtaaaaggctgagaagtaaatgatttgtatatttacccagacatgggcaaattaacctcttcaagccttagttttctcagctggatgcaattagcaaaaagtggccaagctaaacttgaatttcaatttagggtattgttcactgctgcttcaaaggcaaaataacatccatgtttttaccaataatggtgtagggctaaagacaaaacaaattttcacgtgtttcctccccagaagcagcttatgttgtccaaaactgaaaacttggcttatagattctattgttggctcttgttgttattcagattcttgtaactttaagagatacaaacctaaaaaaaaaatgaattggccaaattaagtcaaagattacaatttgaataatttaagggttttggggttttacataaaagtgctgtaaatcagtggtttcggatggtgattttgctccatcccaccccccagggaacatttgacaatgtttggtgacatttctggttgtcaaaactggagggtgctagcagcatccagtggatagtggccaagaatgctgctaatcattctataatgtacaggacagtccctatcacaaataattatttggacccaaatgtcaacagtgctgagatagagaaaccatgttctaaatgctaaacttttctaccttctttccgaaagattaaataaatatattctgtattatgaagcatatattgtaacgtgacaagatttagatggagaagagaaggggaccaaggaccaagccctgggtttctccaattttaataagttacagaaaacaggaaaaaacagcaagtgaggatgaagagatgggaggacaactcaaaggatggtgacctggaagtcagtggtaaaagtgtgttagtaaagagattagggtcaatttgttcaaatgctgtgataggtcaagttatctgttcttcataggttttttaaaagaattaaagtgagaaattaacctaattgaaattaacagtatacttgaagtctttattgctctgcatgatatttgcatttttaaaggtatggacagaaaatgtagcggggcggtggctcacctgtaatcccagcactttgggatgctgagtcgagtggatcacgaggtcaggagattgacaccatcctggccaacatggtgaaaccctgtctctactaaaaacacaaaaattagctaggcgtggtggcaggtgcctgtaatcccagctacttgggaggcagagccaggagaatcgcttgaaccagggagtcagaggttgcagtgagctgagattgcaccaccgcactccagcctggtgacagagcgagactccatcccccacaaaaaagaaaatgtagtaattacagggatcacaggaggactagctgaggaaatatataaaggagaggaaacttctgtaactctcaaattataattctgaggctactttctctacaaaggtgggcttgtgagcaagaaagtgaacaaatcctatcttggaccaccctacaccacagcttgcatgggagacagagtgccaccctctccccttagaaactatgtctgcagttcttgtcctcgggctctcacgaagtgtctctatccatagataaggtttctgaaaacagagttctaaggactaacttcaggtgcttttcctcctgggactcctctaatgctaatccccacactgtcaggcctgtggtgttcagggttagtgcagcaaggctcaaagacagagccagctggaggactaggacactggagcagctttaagcaaagctaatgcctttgttgcaaaggaaatgttagaaatctcacagaaaaacagctgggggagggagggcagaggagagagagagagatagccataaaaagaaaagagaggccacaaaaaaaaaaaaaaaaagatgaccacaaacccatggatattattacaaactctatggtgtgggagaaaactacatgtcacaattctcttaaaactagatagatttttacaaattgaatagtccaactccttcgttttagagatggattttaatgtagagaggttaaataatttgttttaaattttaagtgaaagtgacattctttaccattcaaagcaatcagtgaacctgatattgacaaatttcaaggtgctttcaaaaatcatcatagataacaaccagggtaagacttaggggaaggaggtcgggtgcgggggctcatgcctgtaatcccagttctttgggaggccgaagcaggtggatcacaagatcaggagttcgagaccagcctggccaacatggtgaaaccctgtctctactaaaaattccaaaattagccaggcgtggtggcatgcacctgtaatctcagctacttgagaggctgaggcaggataatgccttgaacccaggaggtggaggttgcagtaagccaagatcatgccactgcactccagcctgggtgacagaacaagactcaaaaaaacaaagaaacaaaaacttagagggaggggaaaagttgatgttcagtaagagataaatctccaaagccttctctttcccatgctgatgctgtattaaggcacggagagcctttgctatcagggagaggaagtattatcttccaaaatattccaatgagtatttataggttatgaaatacaaaagaagaagccttgagtattctcctttcagaagaatttaagtggctgctgaagttttttttaaatgaaaattctcatctctatttgcactacagtcatgatgaataggatgcatggatgactttcaaaagacatatgtcagaaagtaaactccagttgacaggaactatagcatagggaaatattttggactgttttcagtttttaagagatgggaaaaatagaagtggtggaaaatccaagcagattgtcttagttttttattatttttcctttttctccttataattgaagcactactttgagactatggagtaccattaaattcctattaactattaatttaatatttgcaagtatggattagagataggatggaaattaatgtccaagtgagtaaaattccacatagtcttatattgtttttttggttttttttttctgctactgtattcttgtgggttttgtttttcttactctggttgtttatctaggtatatatgctttgtaaaaagcaaacagaaacaaaacatctgtggccccaggcaatcttttcattaacattatatcctaaaaattattatgctaatgttaaaaataaagaaattgggactcagagggattaaataacatatatatccatgaagctagcaactgaaagtctacgactacattttgaatgttctctccaaatcagaactagcgttccagaatagttgttgttaaagtttattatgcataagaaccaacaaggcacacgttaaacatccagatttctgggcccttccatggagactgattcctactctaactcagatggattccaagagtctgcattgttaacaaacattccatcttccatactttaagaaccttgggaccatattggagtttcagcttcggaattcttctttgggaaaagccatatcaacaagatttcaatgaatagaaatgggaagctttaaaaaaatagaaaggaaagttggtaggagtagttttttaccaagagagaaactggagcagagaatagcttcacagcagagaggaaaaatgcagatgacttagagccatccattaagggatagtttcccatattgagttagataaagtatgaagtattttagttgaaaatatttttgagcaaggaagattaatgtgcatagaagaaatgtacaaatcatagcatttagaataggatgacccttttgaacctacaaatagggcacttggctgaattggttcctacctccactgctgcaattagaaaccatgaatgtgcagatatacaggcaatgtcattttgtatatgctagaaaataatttattttcagaggggttttcatatgatgggtttctagacctctagagagaggtaaagtttcctttataagatgagaacctactgaagtcagatgaaaacctccccaattgcttgacaataaatcttcccagagaaaagtcctcagccatttcatgtgaaatgatgactcatgaaaatgaaatagtacactgtacagaaatcttgcaattctagtttttctcctagctgacttctaggttggaaagcttaaggtcaaagattagtggtgccaaaacatgctcattttaggctaatctctacatttcctactgccagtctctgaccagtttttaaattttctgagctttttggcatgctatgtatttctcttactttgacagaaggatgacatactattcactttgatccaacctcaagacccaaaggataaggttaataaggaactgaatctttcaggacaatgcagtttaccaaacagtagtcagtgactaaatatttttggtaactgattgatgaaagcactcatcaaaaaaccatagtccatggacaagtccatcagaagaaattaaggaaaattggaaaaaaggaagaatgaaggggagggagggaagagggaaaagaactaaaggaaaaatgaacataaaaccttacatgtagttgaggcacaacaatggactatacgagaaacttttggcttgtcagtgaatacagcttgtcaggcattatcaagtgtaaatcctcttcccccccacttttcccgctcttgataatgacccaagcaataatattttatgcaacaagaatgacttaaataagacacctatgaagaaggccacagatgacttcataaccctatgcatatgtacatacagaacccacatggagtgaatgttgcctattaacaaaactgtgaaatctgagttagaaacaaagctcagcttggactgaatatataaaaaaatcagtgaacagaagatattttcaaatggacacttacataaatacagcattccaagggaaaattccagcctcagatgcacttatttcatgaagactcaatattttatagcaatggttttccaaagttaagttgcttaagatctagggtgcttattaaaaatgcaaagtgtctggacccaccctgatctaaggaattataatttccagggatgagagtgaaaatctatatgtataacatgtactccaggtgatcctgacgtaggttgttttagactttatttgagacacacactctccaatgtacataaagtcaagaaccagattcttctccaaccatttcctgcagatagtcacaccagccttggacatgccgggtcatccaattcaattattaaacacaatgtctttcatttggagagatagaagattgataaatctagaaaaagattaggaatgatgagatgaatagattatcaatagatttcatgaaacaggttcgattcaatttgggccttgaatgatggtagagttaattattttggcaaaggcattgaggtataaaatgtttttctttaaaactgttagaatttattattaaaatgataaacttctttatcttttcagctggagggcttagcaatgcttccagcacatatgaaatcaccaataactcttagttgaattagtaaattacatgaccacaaaaaagtaaatctacttaaaaaaaacacacaaaatcccaccaccttgacaaaacttcatgatttttgttgatgatgctgttgttttgatttttatttcaaattcttcatttcttatttgtatagtttgaatagttatagtaataaagatataattttctttggttttataagttatataatggcacatacattttccatcttgatttagaatattcataattattctagtagcaaaagaataaataaaatggatgtattgtaatgtacatacctattctgtgttttttagataatggacgcatttctattctgcatttctgctttgtaaataacaattttcttcctttgtatttttttcataacataagtgaccataaatgagattactagactaaagacatagtgtttttatagatcttgaaacaatctgttaaactacttttcaaaagacttgttctaattttcacattgtctcaagcatgctatgttctataacatctttactggcatgaacatgctgtcttttctatctggggacgcccttttcccatttaaataaaaaatcttggtaaactcctacacattgttttgtactaagctcaaatgctattctttcttgcagcctttccaaatcctctaggaagagttagtcattatttccattgtgtttccatagtactttgtaataatactatttgggacacttattcaaatagctctgtgtttgttatagtttgtatatttcttttctttttcctagattattagcaactcaagggatgagccgctgtccacttcatctttggaacatcagcttctagcacaggggctggttatattagacattcaataaatgtttgttaagcaaatgaggaataaatgagtaaatgtcaatgtgatactcaagtcaaaatctgtggctgtatgttgggtaaaaatgctttctttccttaagtcttttataggtcatttagtactaggaacatttatatttttacgggtcttttaaattatatttttatacttttaatatttatatattttgtaggtctacatttttaatacctttgctgatgactttcaggcttagatagcacaattctatgatatgctgtgagtcagatctttgagtcctttagataatgacttttaggtattctggaatcagaaaatgtctttttctagttcatacagaaacaacttttgttaattaagtgttaggactagtaaataagattagaaaccacctgtggagaacacagcatgtacatggccccactgtagatggaataaatgttttaaaataactgctgataaattatttaacaaaatataatcaataattattctaacatatatcactgtgcattttgttgcattacatatattctctcattttctctctaccaaaactggtaagaaatacaaagactggacactgtggctccttcctgtactttgggaggctgaggcaggaggattacttgaggccaagagtttgagatcagcctgggcaatagagtgagatctcatttctactaaaattaaaaaaaaaattagctgggtgtggtaatacagcacctgtagtctcagctactcaggaagctgaagtgggaagatcacttgagcctaagaggctgaggctgcagtgagctgtgatcatggcactgcactccagtgcggtcaatagagtgagacctggtttcaaaaaattaagaaaaaaaaatcagaaaaagcaaatacagacaaagcaagtataccataaatgtaatttgaaagataagtaatctaacacacagaaatgtggctagcaagtggaaaaatcagaaccagaattcacatattttaagccacattttagccttcattctagtaaaatcactacacccaactgaattttgctaatttcaaactgagaaaatgagatctgacgtcgtataaactaaacaggtgttttaaaaacaaacagaaacttctctagcaataaaaactttttttccaaaataatgcttatgaataattcaatataaaaaacaatatcagaggactcatattgaagtgagtggccagtgaaggggggctcctttctctcctcttttatggctcttggtagttcctagagcttgcactcaggaaagcactgtattgggccatttctttacttagtcattcagtcattaatacatcttacagcctaactaggtacaaagaattgtgggaaagataaatacaagacaaagtcctttgagaacacacaaacacacacacacacacacacacacacacacgatagtatattataaatgccacagaagttatattgcatagtagtaagcattctgaaagttcagagaagaatgatgtctagtcccataccctggattgagttccacatgtccacctaaggacacacagattttgtttcttatttggtgacttggtacaaaccatttaatctgcctatttgggcatccattcctgagaaataaaagtgatcaatgttgccaatccaatgcatgtaatatgtgactatagggagagaataacttagtggagagaatggggcagtgaaatcagacagatctggttttacagctttggcacttagattgagctagttagttcaacttctctaagtcacagctgtttcacccataaaatgagagtaacagcaatatataccttttgaaaatttccataaggtatcaataagataaaatataacacctagcagagaaactagcatagattcaatggtcaataaatagcagaaatccttattaactattaagatgaagaagttacatctaggatttgcatagactattttgattctacgattcaataaattttatttttgacataactcattcaccgtggaagaaattagtgttctatatttaatgaagaccaaagactttggcttggtaaatactattcttagaattttcctccttttcaagctgtatagattcatgtgaagcctggaaaagacgctactatgttttattttgcaatgcactagattttgcttgtactctttagaaaatgttaggctttatttcagtcgtcatttgtgcataaactctagtcagatcaagcaaaaacaatgaagtcattagtgtgcactgagtttagtcacttctttaaatgctacattaattgctttgagattctctacttccactgtgacaagcaagacaaatggagtttacctgcaggacacatcaccagtcaccttcccagcaagctggctacaacctcatctgctccttttcacttaagaaggcatactgtcatgcaaatgagtgagaatgataacacagacaaaatcttgaatctacattgcttgatatttacaacaaaaaaaaaatattcactcactttggaagttaaaccattattagtaatactgacaacacatttcacattcgatggggccataccaatatgtaacaatttatggtacagaatcacttcatggtatgacccaaggaaatgtacttcatttgtggaataattaaaagtccatcctttctgtgaagaaaatgctttatactctgaagaccactatcatgaattaaaaaatccagtatcacaaattgtagacaacctaaaagaatgttaacttaataatatgtgacttcgatctaaatgaagtgataaattggccagaaactcagatgccacagggcacatatgttacataaataatcacataaataatctagcatttctctaaagcagcgattctcaattttggtcttagatcttattgtcactgttaaaaataattgaaaactccaaagacatacatattgtttatgtagattacatatgtggatatttactctattagaaattaaaggtgataaaagttaaatatttaactgatttaaaaataacaataaacccattaacataaatttaaaaaggaactacattttcaaaaacatacattttaaagaaaataatactgttttacatttttgcagatcttttcaatatcttttaaattagaagactggggctcatatttgcttctgcaatctattgcaatatttcatgtcatgtagtctttaaaaaattccactgtatccttatgaaacaatgagaatgaaaagggtaaagttttttctttttttgttgacatataataactacatatttatgagatacagagtgatattttgatacatgcatacaacatgtaataatcaaataagtgtaattagcatatccataatctcacacatttatcatgtctttgttttgggaacactcaaagtcctctcttctagctttttgaaaatatacattaggttgggcatggtcactcacacctataatttcagcactttgggaggccaaggcaggtggattgcttgagcccaggagtttgagaccagcctgggcaacatggcaaaaccccatctctacaaaaaatacaaaaaattagccaggtggggtggtgcacacctgcagttccagttacttgggaggctgaagtgggaggaccacctaagctgggcaggttgaggctgcagtgagccactgcgttccagcttggctgacagagtgagaaaaaaaaaagaaaatatacattaaattattattaaccatatttaccctgcagtactatagaacactaggacttattcctccttatctaactgtaattttgtatctgttagccaacttctccctattcttacttccccctttacctttcccagcctacaattctgctctctatttcaatgagctaaatttctcttagctcccacatatgagtgagaacatgcagtaaaattttagtattattttgaaaataattttgacctcactgaaaaggtcttacaacactcctttcccctgtcctaagccttggcctcccaagacttctagatcatattttgagaaacactgctctgtttttataatatttagagcatatattatttattattttttgtgtctaatttacatatatgtcctattgttgtttccctatttgaaattttcctgatggagatcatcattacaaaccttaggtatcactttacagcatgtggtaagcctgcctggaaccacagtgtacctcaacatgtaatattgattcaatgacccattgatagattgaagcctatagtgtcttatggtccctttaatgacctttaaaatatgtgatatagtagtatttttatagtttgtcaaattttgagcccattatgtcaacattctacctaaatagaaggatgagctaatcatacataaatttattctagatgaaacaacgtttttttttttttgactcagctgtgacttttggaaaagaaactagaattctagagaagttattattatacatttttttcctataaaatttatcctaacatatcaggcaatattttaaggtctaatcaatttatatatttagttgtaatttcacaattacaaaacaattgaaagcaaaaatatgaaaatcatcagtttgaattgatttgaagctatagtttcctatgtctatgagtggaacaaaaaaagtaacaaatattacttttatgtgttctactgccaaatcagatcctttgaaaggcacccacttagtaacttggaaatgaaacatttatacattcatccctgctaaattgctgcaaaatgtgatggttgggaaatatatattaaagagtgaaacagtcctcctaaattaaaggttttcttacataataaataatttctttgactctttgaaaatggttccattatctcctgatctaggaaacccacagagaaagacttagtgtctgccattaccttggtaatcagataattattctgactattctatcagaaaaaaaaaaaactgtacatactgaaaagaagactctttcctgctaaaatctgggtaaacaaaatagctgctagactgggaaacaaaaagaggggtcacagatctgagttgactcttcctttttcatgagtcataggacagcagatatactagttgtcttttgctttcagaagagttttacattacctaaactcatggctgaatcacaaagtacatggccagaagacttagtgacttagtaacagagttctcttagacattttaccctccttaaactaattttggtcttgacacagttaactattaaaaaaaaaaaaaaaaaaaagccctgaagcctgcctattcacctctgatcactgagaatgaattgaattatcaccgtacaaataaatttgggaagcaagataatgggagggaaaagagatgattaatatttgaactgtaaaggatatatgtctgaaatttaattattaacaaatgtgcattgatgcaattatgtaccattacatagcagagttaagaaatctaaattaagtaaattgcaaatgctataactaaacttataacaagttattttaaaaattaaaactctcatcagttgaaaactatatccaacagaaatcaggcaggaatttctaccacctgttcatatgcatgtacagtgggaatctgaagcattgcccagcacaatgtggcagccagactctagattattccatttgagttctgagtaactgtaattgtatgctattttaagcttatgaatgctaagattgtttaattcttaataagctgataggtagcccttaattgcatgatgaaaatccaagtccaatggcttgtgtgccacttgcctataaaaagcaaataaaggacttacatttctggttcaggttgtaatccaccaagtgaaaccttggggtctttaagctaaggatctttacttgaaaatcactgttttatagcttattaaatttccatgtcaaaaatatcaaagaagtcattcaacaaacatgtattgggtctactaagtggcaggtctctttaggactctgcagatgcagtagtagcaaatgtgataacaaggctctaagtgaattcatcttctatttgaagaaagtcagaaaaccaacagccaaccaacaaaccggtcaatgcactccagggaaagaccatgaggagcatacctttacttgaacaagtgagtttattaattgttgtagcaaggaagaacacacaccacacggagccatgaagtatcttagtaagatactaagtaagggcattagtaaaggcatattaaaaagaattcaggcttattcggtgattctggggagggtttaagaaaacaggactttgttctgtactggatgctgccagaaagtagaagcaattctaggattggatagctcaataaatcttatctatagcaagagcagactagagtgagaataaagttatgattggtaggaaagtagtattcaacttaaccaataagatggtttgacattttgtgggttatatagtgacaccaatttttatctgttttttaatgaaaaaatgacatagcattattttcactcactttattatggtcttagtgtgactgtgtttcatgttggtactctatgaagttatttctctctaatgggtgaacaatatcatctacctgtgggctccaggccagcttctaacaatgctgaggcctcacttacggattagatcagttcccagacaacaggggctacttttccctttcaatcatgcaaccagccaagcaataaatttaaaaaaaaaaaaactatcaaagagtgatagaacatagtaaaagggatggccctttatattgggtgttcagggaaaggctgttagatttgaacaatcagaaggagccaacatatgactacagggggaaaaacatttctgtcccagtgaataactactgccaaggccctaagataagaaagagtctgagcatcaaaagaaagacagtgtgatctaagaatgatctaagagcacagcgaggaaagacaaaaggaaggagggagagccaggtggccagatggaagttgtgtagggtaggtagggtattgtgactttattctatatatgataggaaatcattgaaggttgtaagagcagaataatgacataattttatttatatatttaaaagatcatcctgtatgttccatggagaagcagagatgtgagtcaggaggttttgcagtttaggcaagagataatagtggcttgccacaggtattggtggtggagaaggcagagctgactgttctgaagtcagtgttcataagacttactgataacatatcagtaagtaatttgggaagtgaaaagcaggaagaaatgagtgaaggatgatcttaatagttacttggttcttaatgtcagtgataatcttattcatcatgttattcctaatacctgattcacagagggcactagatatagaatgaaagaataccttttgtagctaatgttggcactattagcaagcttcaaaagtatctgcatttattaatctccagttggggtttggttcctaatttcttctgttgatttgcagttaactcagtggtggtagcaaggtacaaaataccccaggactacacagaacaacacaatcaaggtagaattgacacaaataactcctaagaaaatgtttcctacatatagagtaaataatttactaaacatgcttaaaataaataaatttggaaaaaaataaaataaatagaaaacttcctcaaattgataaagaacattcttaaaaacttattactaacatcatatgtaatagtgagaaacttgacacttctccactaagactagaaacaagacaaggatatctccctttcaccaactgtttcaacatcatatgggaattactagctactgcaataagacaagaaaaaaatagtaggaatacagattcagaaggaagaaataaaactatctttgcttgcaggtgacacaattgtgtatgcagaacatctgaaagaatcataaaaacctcctggaactagtaaatgattattgcaaggtcacaagatacaagtttaatatataaaagttaatctctttcatatataccaacaatgaacaagtaatattcaaaataaaaaaaacataataacatttacattagcacccccccaaaatgaaacacatagatgtaaatcaaacaaaatatctaaaaaataagtagttttcttctatataaggagaactacaaaaccttgaggaatgaaatctagtaagtaaataatggatagaactaaataaatggatattccatgttcattattattgtcaaaatgtcagttcttcccaacttgatttatagcttcaatgcaatcccaatcaaaatcctggcaagttattttgtggatgttgacaaactgattctaaagtttatatggagaggcaaaagaactggaatggctaacaaaatattgaaggagaagaacaaagttgaaggactgacatcatctaacgtcaagccttactataaagttataacattcaagacagtgtggtattaatgaaggaataggcaaatagattaatggaagagaagaacccagaaacagacctagataaatataatcaactgatctttgatatagagcaaaggttacataataaagcaaagatagtcttttcaacaaacggtgctagaacaactagacatccatatgaaaaataatttagagacagacaattgacaaacattaactcaaaatggatcaaacccttaagtgtaaaatgaaaaaccataaaactcttagaagacgacacaggagaaaaacctagatgaccttgggtatggcactgactttttagatacaaaaccaaaggatgatccatgagagaaataattaatgagctctacatcattaaaataaagaaaaaacttttggaccgggtgcagtggctcatgcctgtaatcccagcactttgggaggccaaggtgggtgaatcatgaggtcaggaaattgagaccatcctggacaacatggtgaaactccgtctctactaaaatacaaacaaaaaaaaaacaccccaaaaacaaacaaacaaacaaaaaaccaattagccaggcatggtggtgtatgcctatagtcccagctagtcgggaggctgaggcagggaaattgcttgaacttgggaggcggaggttgcagtgagcccttcctgcctagcaacagagtgagactctgtctcaaaaaacaaaaacaaacaaaacaacaacaatacttctgttatctgaaaaactctgttaagaaaatgagaagacaagccacagactagcaaaaaatacttgcaaaagacctatctgataaaagactgtgatccaaaatatacaaagaactcgtaaaactcaacaatgataaaacaaaaaaagggccaaaatcttaacagacacctgaccaaaaagagatatagatggcaattgagcacatgaaagatgctccacattatacaccatcagggaaatgaaaattaaaacaacagtaagatatcattacacgcctattagaatgaccaaaatctggaacactgacaacaccaaatgctggcaaggatgtcaagcaacaggaatgctcattcattgctagtagaaacgcacaatttcacagccattttggaagagagtttggcagtttctaacaaagctaaacatacttttaccatacaatccagcaatcactctgcttggtatttactcccaaaagttgaaaacttacgttcacacaaaaacctgcaaagagatgcttatagcggctttatttataattgccaaaacttggaaccaaccaaggtattcttcggtaagtaaacgggtaaataaatggtggtacacccagataatggaatattaatcattattttaaaaaatgagccactgaaccataaaaagacatgaaggaatcttaaatgcatattactaagtgaaagaagccaatataaaaaggcaataatatggtataattccaaccatatgacattctagaagaagcaaaactacagagacagtacaaagttcactggttgctaggggttttatggataggatgaataggcagaacatagaggatttttaggtctgtgaaaatactctgtatgacactataataatagatccatgccatgatatatttgtccaaatccacagaatgtacgacattcatgtaacctctggcctttggttgattatgatgtgtcaatgcaggctcaccaattgtaacaaatgcactactctagtggagggtgttgataatgagggaagctatccatgtatgggggcagggagcataaagaaaacctctaccttcctcttaattttgctgtgagcctaaaactgccctaaaaattgtcttttgagaaattaaaagacatttagaaatcatggaaaaaatagaaaaacgtaaggcaattgctcatcatagcagataaaaaatccaaaggttctgaattctgtcccaaaataccctcaatagggtgtccacctttacctcattaacttatttgaatggtacatttgtatctcttgaagaactcttagaagaactggctgtggtgatgttttctgccttctgtcaacctttcaaaatcacatgcccatcagatggcattctcaaatttcctgccctgtaccccaagagaactgtcctcaggaacaatacagaaactgcctaactaagtatagtcaataaaccactgcttcagaatcacaccggggatcctctgtttcccttcacaagcagagtctctcaggaagcagtaatgaagcatagtacgggggtgctcctccttaatgcctatgaagactcataattggaacccaaacttgctcttcaatgtgttgatgactctgcagacaaacctgggcttctctggtgtgctttcttattgtggaaaccaacaggtcaaaatattaatatgtgcaggcagaaataggtgtagaatataagcaagaggcctctttctttctctattggtatgtttgaagcaatatgactaatagacgaatccagtctgttttagaggtttagtttgggaaagtccttgtaaggcattaaaggagtagttttaattcacagataatacgacactcagatacaatgccagaatatccaaaataatttattgcattctacacccatggattcctgaaggttagagtatatttaaactacaccggtaagagttgttgggaaaaatacaagtatctcagagatcacatggtcacaacctacctataaggacctcaagccatgtaaaaacatcacagctgagggaactacttcaaggaaacaaagacagaacatggtcatcctaaaccccagaggcaaacttacagccattaaatagactcctttggccagtcatgctcattcattctcatttaaaataattatttgatgatacagtcaaacaagaaagtattctgctttttgtaaggcaaaaggtgagagtgaatttctagaagttaataaacaggttggtagttttcttccactttgctcataacatcatggaaaaatcactgaagtgtgagaaacaggattctgtcacaccagtgcctcacatccaatgctgcgagagaatgaaatattgacaatttaggtgtagttctcataatttcacccaactcaaaggaatgactgaaacactccttgataacaagaaaacacctgaggaagggagagaaaataatcattctctccaaccttctttgcacctttcgatttcatatagctaaggatacacatttctcacagtgattgaagagggtggcaacatctgtcaaatctgtagagtcaagacatgaaattcaattttaaattctcagtagaggagaaaaatgagagaaaggtaacttgtaatttcttccaattagatatacaggaataactaattgaaatgaatgttttataaaaaaccttcttttactttttaaaaactgaatttctacattttaataacattgtcatgtgtaattataggggtgttgaaattttgtttcctcttttctgagccctaagtttgccttctgagagaaaatcttgaaaatgtagtcatattttaaaaagtggtaaagcctactactgttcatatcattttcaaccatcagtagaccttaaagataggaaaagaggccgggcgcggtggctcacgcctctaatcccagcactttgggaggccgaggcgggcggatcacgaggtcaggagatcgacaccatcctggctaacatggtgaaaccccgcctctactaaaaatacaaaaaatgagccgggcgtggtggcgggtgtctgtagtcccagctactcgggaggctgaggcaggagaatggcgtaaacctgggaggcggagcttgcagtgagcggagatcccatcactgcaatccagcctgagcgacagagcgagactccgtctcaaaaaaaaaaaaaaaaaaaaaagataggaaaagaaagaaaatagcctgtacttcaagtatgaaagcaccatgctggatagtaaaaaaaaaaaaaaaaaaaaaagaaaaaaggatttagagagcctaagtgtatgccccttgggtctcatgactctgtcaaaatgacagggtgatttccagaaattcattaatcctttcaatgaatatttactgagcatccacagtgagcagtgatctgcacaggaagctaggagtgggatggggtgagtatgatgtacaatgataaatgagacacagaaaatgcctttgaggaccttatggtgtagaaggggagaacacatactttctcctaccttgtattaaaattatttgtgtgtgagagtcatgagaagtataaataaggtattatgaaagttcacagaggtaaaaaattaattcttacagggaggaattgcagaagtagaaataactgtctttgcctggaaggatgaaaaatctcaggacatgtagagaaggtagaagaacattttctttgaaagggatgggataagcaaggacattaaaaagatagcatggtgtacccacaaatcattcagtttacctgaatcaagaggaggacaggaatggaaaggaagattggggatttacatagtatggtaggctaaatccatctactttctaatctctggaatttttaaataagttaactgacatggcaaagtctttgtaggtataattaagactcttgagttggagatattatcctggattgtctggtgggcccagtgtaatgacaagggtcctttcaagtgaaagaataaggcaaaagaatcagagtcagagagagagctatactaatggaagcagggatcagagtgatgcaaggaaggggccataaactgaggaatgcaggtggcttctagaaaatgaaaaagacaaggtaacatattctcccctaaagcctccagaaggaatgcagctgccctgcccatccatgctagacttccaacccctagaactgtaagcaaatttatttgtgctgttttaagccactatatttttggtaaattgttacagcaacaggacacagatatagagtggaatgttttgaatatactacatcttagtccaaataattatttatccattctctcttggtgtacctcaacttttacttattatttcattacaacatttatgttgtattttttatttttataaaatatatttgcctgtctgcttcgtttgagttataaagaaggtgaaagtactactaacagaatacagaaaacccacaaagagaaaaatatttaaaagcaagatgctgaaatctttttcgaacacagtacgtttgaaataccaatgggtcaacacggtgggtggacagttggagatggaaattcatgcctcctgcttgaagataagagcgcatatctcttggaagcaattacaaaaatttattatagctcacaaaagagaatcattgaagtgtgactattgaccattgggaaaatttaaatagtatgtattcatgagaagggaattatttaatcagggtattttgacataggttgctggaagaagtgattttatattaagtattattagctaaaatattatcattttaactacctgtgattacctataggcaaggcataaggcaatctactggagatgaattcacgaatggagaaaaagaccttttaaagaaaagtatgtcatctacaagtttcttggtttttgaaatatctctagcaggacattaatccctcaacttctcaagtattttctgagtatctactagtgcaaggtaaggtcctttattcatttttatcctaacatagcctttggctttgagaagcttattgtctccttgccatgtaaagttgtgtacttcctcaaaatactagaaatttagaattttcctaaattatgattttccccaagggtatataagttttaagtctcaaaagcatacatggcctatcttacagcctgttcctagagttcatctctctaagatgagtctgaggtcactctctgcctgggaatctgaggaagctgggccgccggggtgcaagggagacttcacatagggaaaggaggcaaggaaggcttaaagtgagggcaataaaaataacctttacctgtttcaagtcttgggttggcccagactaccaccacttcagggatttttataaaatgctgctgcattgcttttgctaaaagagagccaggtcagcagagtgggatgacctttcccaacagaaatgccatgatgtttagccatcaagcagaaatttcagggacaataagatactgtagtctgcatgcttttatcccaaagtgaaaaccatagaggtcaaaaatatgagttaagggaggaaagaattaaaacttttacctgctctaaactctgaaaagatgatggtgtgttcatccctgaaccttgtctcaacacaatttcagagaactataaatgatgcctcctaacagactactatatgacccgtgactcctgaagtagtacaatgagaaggataaccttcaccacttgcaaatcttaatgcccatgtatatacacatgtacatatttttaattgtaaaatgtgtgtaatgaattcccttcaagatagggaggatataatttcccataatatgtacttggttgctttttatatttttttagaaacgtcaaacttttttcaaaactttttttggaaatacccagtatttttttgctacccaaaacacatgtgaattggagcatacttctttatgtaacaattaaaatgtaaaatgaaccaatttttgctgaaaaaccaatctgaaatgcagtattcacttccctgccttcttaatcaaaggatgatggacataatttaacctttttaaaaaaaataatgtcatggctttcattattatgaatgataattattctacgtcgctgcgatacacagagacccttagggattgctgtggtgtatggagcttcttgcctacacgaagtagtgtaggtgctttttgttttttcattttgagccagctgttcataaatttttctctgtcttttctcactggcatgctgtatgtgggttgccttttttactactgtcgttgtagtcagtcttcctgcttccatcaactcctagccaaacaaagcaagacattcccagtgtgccaaagctcaggcaaattaccttgtactagcattttaggccgatgcttctcgtactttagtgtactacaattaatctggggatcttcttaaaattcagattctgctttggtagctctggaatgggaactaaaaatttgtgtttctatcagcaaccaggtgatgcctttgctgctggtctttgcaacacaccttgaatagaaagatattagctatcatgactttttagaattgtgtctagattaaaagaaaatttgttttgagggagtgattggctactctcctataaataagatctaaaaatttagaatatgaattttaaatatgctatctccaaaatgactttccttatctttatatccctgacaccaccacataaacatatttcccttctctatactaatatagcatttaatttcttcctctcttatggaatttatatatttataacttattatttagatataagtcaagtactgaacatgaagaggaaccaagtcttacatatctgtattttttgaaactataccttgctcaaaaatggttgttgaataactgtagcaattgaaagctataaggttctttccgtataatttcatattctttgttgcatcaatttttcaaataagtaatcaggaaatgagacaatagtataataaatcagtataaatttcaaattaactgttaagaaagtaaaacatgttttcagagttcctgcctctttgtcgtatacttatttcttcaatttgcctcctcccaccacacctcatagaacacacaaatagatataaaagcacatacaatctaaacatatatcatcttcatattctttaatttctaaaaccttatttcaagaaagggcctggaattaacttacactaaaatgtaatgactaactgcagcataaagtatatttcctaccttcaccccaagaagggcttaaacgttttaatagaaatcaaagcctacatagtggaatgaagctgtggaagaagatttttcggtttttaatcataaaacaaaaggtatattaaatagaacctctcctaatactctcacattgggtgatgtttgcactgaacttcccctaactgagaattgctaatccacagctttcctgcacctgggctgtaaagttgctacatagtgataaactgcttgtatcctgatatgatgaactaatatgcacagaaaatcctcactaaaagtgcaagctatagaaacagtcaaggctaaagcagggcaaacacaaaagtcaatttggcagctcatttgaatctacattgtgcttctttccaatggcagacagaatttatcatctactggaaaagaataaaacaaagccccaatttccattaaacatttgtgtaataaaaagaaatggaaattatataactagagataattcaaatatgtaaataaaattgtcaatggaagcagacatcatcatagcttttgagttaatattatgtgatatccattttactaatttcatccagcacacaaatttgctacttatctcacacctctaattaaattagtggccacctacatgaaattcagaatgcactcaataacaggtgcttagaaggaaaaagtgaggcataaaataagatagtcaacataatttacacagatttatataaagttgctctgcatcaacatattcctaaacaatagagattaataagaatatgactctagataatagtcccagagtctagagtcatttctcttgttaacaggatatcaatgtggtgaaaagtgtacaaagggtatctggatctgcctttcctgactctgtagattgttcgctgtgaaaatggctaggatcagctgagaaatctgagcataaaactggtgagcaaggcaggctggaggtacagatgagttctggctgagatgcggtgcagacagctataaaatgaagttcttacagtatttgctttcttggtcatccaggggttgttcaattgtgaaagtcagacaacacggccttaatttcagataagataaaagtcataaaattgttattttcttcccacaacaaaacaaacccaacaagtcagcatattttgctcaaaaggaaagagagaataggtactagcttggcagtgccttacaaatctcagaccattgtagtcagtggctttagcatcaaagggacctgggtttgaagtcacagcccaagaaagcatggctgagctatttaacatctctaatttcagatttcagtgtccttatcacaaactgtggatggtaatctttatctcacagagaggttataggataaataaaataacatttatggattgcttagcaaaatgactgctcaataaatagtatttataactgcttacattgaagacaatcatactgaagtacaaattttatgatcccttccagtttatctgaaaattaaggagatgaagtgaatgcatactaaaattctttaatcaccaggggcttaaatattaaagtatgtaaagcatttagggggtatataaaagagtaagctattatcacagtgagccacagaatgtgttaagaagatagactctggggccaaattatcgcattcacatacctattctgctgctgcccagctgcgtgctttggatgagtaacttaaatgctctctgcctcagttttctcatatgtaaaatgagaataataacatttaatttttaaataaggtaaaaacgaaatgggttaataaacataaataagagattggcacataccaacttctacgtatttacatatatatgttttagagcacacacatactgttgtaaacagaccttagactgataagtaatttctgcctcctatatctacatcttattggaattttctccctttaagcgtggacatgacctgtgacaggcttctggccagtataaaatggcaaatgttaggctatgttataaagactccatcttaggagaaaggagtgccagactctcctgctggccttcaagaagcaagcttcttgatgcaagctgctaatggagagggtcctatggcaggcagcctctaagagttgagggcctcagttctccaaccagaaagaattaagttttatcaacaaccatgcaagcttgcaagagggccctgagctctagaaaggaatgcagccctgccaattctgtgattgtagtctagtgagagccaagcagaggacttagttaacctgtgccccgacttcagtcagaccacatgaactgtgagataacaaatgtgttgtctagagcttgtaagtttgttgtcattcattacacagcatagaaaactaatacacatacttccatatagaattcagagaaaagaaagggaggaaacgaaaaagcttattttctcagtgctctgtcttagtttcaggctgagcagccttgacctggccagtcattgctgagtctatcattgtaaagtacatttaggacagaaagatcttactctagtcaagatttctcctataggccctattttagcctctggccttcatgaatggcaagaatattaggatgtcagtgatagttgtttttccagcttcagattccagttaaggaattttagcaaaacaatatgaactagaaacctttttgagagtgggaatgagagatcaaaatatttgtcttttaacgtcaaagtttactaggttttgctgacaaaactaatcttatgtattactggctttctgatgagcttctgtcatccttccctcatttttctgccctgctctgtccgccattcccgagaaatagactaggagtcaagggatctgtgtacaagtttaagcttggcttgtagttagttgtatgactaaagatgataaagatgagccagctcaactctctcttctgttgacctgaaagtgttgggatgggggaaaatagatgaacaataaatgaaaataaagttcttgagaaaagttacaagggcagaacaaatacatgacagtaatgttacaaaacagtcttgaaacctcagaggaatctaggcaactcttaaaaagcctcaagccctttccaaagtatgaacctgcttatgatttagagtctgggccaaaagatttataggatttgagaaatgagaaataagtttttctctcttagacaactcctatataaaagcagtggttttcgagatagttatgttctaaggcttggtggatgagaataccctgattaattatgcatcaatatggaatagggtccatatataccacttctgtcattagtcccttctgtacctacaacaggtacagagatgagagatcagaggcttggggaagagaaatagcttgttaagattatagagctagttactttcagctgtgggacataattacaaaggaaatttgtacatttggttattcttgttaagtatctctatttgtaatgccaaacacaaatttttgctacttcaaaagctgttttatttcttaaatttgtgatgtctctattatattttgccaatgtgaggaaatgagtgtctaatcttgtcaatgtaatatttattctcaattcctgctatattcattcctcctaatttgaaagttgataaaatctgttggcaacctccttgaagctgcaaagcagttactcaaaacaattttcagaatgttcagtataaatgggcacatgaaccattcttgaaaaccgatgtgcctttttgcttcacatgtttaactaaagtcggttataaattttaaaattatttatttaactttttcacatccttgttttaaaatttccataccataatacagtgttctttcaggatcacatgtgaaatagataatatttccaacatttcatgaggagctatggggaagaaatgatgagcaattccataaggcactgatagacataaaataagagtacatactttcatgtcattccagatagaaatatcaaagatggaacattttccttccccttgacttaacagatgcccactctcatttagaactatttcctgacaatgaaatctagttggagagatacaacataataattcaaacacattgaaataagttttgcactgaggtaaaaaagccacagggtatgaaaaggcatggtgtagttggtgaaagggaggtgaggtattacttgagtaaaaagtttacattggtggggtggcagagataaaagaagatggagatagagataggcaggagttagatcatagtgaaagtcttgtagttattttagggaacccaggaagcttaaatctatcaatcaggatagtgacagggtcagatacatattgtagagacactcttgtgagtaaggaaagactcatttataataaaatatttgtggtagtccatatgatttggtcattctgcaatacatttatcaatatctcaaaactcacaagaacatgtaagcaaaagttaaggtatatatagagagagtggaagaatctttagtattctctggtgtcaatttgtatgtgatttttaaaaattgtttttggaagcattttattttctgtttagtggttgctgtagttttcttgagtcttctccctactgctaatttaggctatttggcatattcagcctcatggttgcaaaactggggttttaatattaaaacttccattgttcatttagatttttccttctgaaaatttgtagaattattcaaggcaatcttttatatacactttctaccttcctttgcctcccaaatcaacaacctgaaggtaggccgaattaatacacactagttgtggtaataatgtagttaagttgacactgtgagctgtggtctaggcagagaatgttacgtgcagagcttctattgtcttctttctcccaaacacagtggtaggttattcacattcattccttgctacacgcatctagttaaaataacttagactttttcaggaaagacaaactgaggccaaaagctattgctcatctcattgctaaaactctggcaacattttctgaattccacagatccacagtttgagaagatgattgtttaacttgtggcatcatgagggcccaacagtttagaaaacagtgggacagcctgttgccctgcagccaggtgataatccacagtaaccaaaataataacaaatattcatgaaaccactgtctttctttttcagctcattattgaatatttgcactgtatttattatttctgctgcaaagaaagtaagaaattaccaaccaatagatcatgttcttatcaagtgccaggcaaaaataattcttataactacacactaggaagagagtaggaaactggtaggaagggaccaaaatgttatacaacaaaatactatgcacgacaaagatatggtatactatagaaagcagattatttttaaagaagcgatatagacttttctgcaaatgttaaaaattgattcttattacttgagaggaagacaacttgctccaattctaaaatggctttaaatcattttctctttttaccagtcaactgctttcctacaggccaataatagcattaccaaccgggacaaccatgagagtctccttactcacagttgtccaaagcctttaggcttcatactgtggaatgtatcatctactttttaccagcattatcttccagaacctagagcaaataacttctcattactactaaaaacaaaacaaaagcacaaccaaaaacaaaaacacactcttccagagcttcccattacctagagaattagtctaacctcttttatagagtttttaatattctctaaacatctgctcaaaattattcacttccctgcattctaattaccttctgcaccaaattctacagttctcaaacacactgtgcatcttcacaatctttgctcatgctgaagcctctgcctcagacgcatttctgctaattctccatctgacgataacttactgcccttttaatgttagcatttttgccacagttagatctattaattttattggaatcaactttgccctatagagaggtttctgaaagtataacttgccaccggtgtccgtgctattaaaaacactcatgcagagaatgcatgttgacacaccttggttgtctacctcatcagtgactaccattgttcttatataacataaatcaatcctcagtaagtatttgtagacatggaacttcctcagcttgttccctttctctttggtatctcttctctccatcctcaaagctcataatcaatggccaattaattcctcttgtttcggcaatgttcctcttgcctacacaatattcccacttccattaccctagttctaattttcattacctccttcttgaactaccgcacttgcttccttagctattgctcagcttctagtctctcccttcttaggccattttgtagtcagctggtgaagtcattttcccaaagcacagctctaataattccattccctggcttaaaaaacatcaattgctctctaatgcctgcagaccaagtccaaactccttagcaggttttctatcatctgcccaccatttgcctttgcaaacttttgttatacattcccattatactcattctgcatgccagtcattccctgaggcattctgtggagtctctcccattccctgacctgatgtatgaattctctcctttgatctcttaggttactcttttcctcaacattgcctgttgatatacccacctttaaagaaacaaatgaaatgcctcttccacaatgatgtatgtcaagaatgtaattttagatttttttgctcctagagtatattcattgtattgctaaaaatgtattactccactttactactattgcatacaaaactgtgcttgtgattcaaatccccctctctgcagggataaatcatgttttgtttacttctcttcctggggttgggccttaaacagtgcaaacacaaagcacaacttctggatcatcagaacgatttagcaatgaaacaggctatctcgaagatgaaaaatatttgaagagaggctagatgctcatctatgaagatgactgaaggaaatgcatgcactaggcagatggtgagattgcatgaccttttaagtcccttacaagtgtaagtttctgtgctatcaagggaacaggccaggtacagtggctcacacctgcaatcctgataccttgggaggccaaggtgggagaatcacttgaggccaggagtttcagaccagcctggataacaaagcgagaccttgtctctacagaaaataaaataataattagccagacatagtagtgcatgcctgtagtaccatctcctaaggaggttgaggcaggaggatcatttgagcccacacatttgaagtcgcagtgagctttgatcccaccactgcactccagcctgagtgacagagcaagaccctatctctgacaaaatgtggtggtcacattttgacgtttgaggggtcaccacccctcgacaggccctggtatgtgatgttcccctccctgtgtccatatcttctcattgttcaaatcccacttatgagtgagaacacacagtatttggttttcggttcctgtgttagtttgctgagaatgatggtttccagcttcatccatgtccctgcaaagaacatgaactcatccttttttatggctgcatagtattccctagtgtatatgtgccacattttctttatccagtctatcattgatggacatttggctgggttccaagtctttgctattgtgaatagtgctacaataaacatacatgtgcatgtgtcttttatagtagaatgatttataatcctttgggtaaatgcccagtaatgggattgctgggtcaaatggtatttctggttctagatccttgaggaatcgccacactgtcttccacagtggttgaactaatttacactcccaccaacagtgtaaaagtgttcctatttctccacatcctctccagcatctgttgtttcctgactttttaatggtaagtgttattctaactcccaatgctgtctacctaatgtgaaagttcaccattctaagtaaccagtcctggctttgttatgaaatttggatgctgaatccaagagattaacaacatgatgacaaaatttacttattctctttaaatgtgtataaccatcaacaagagagacaagattatttatacatcaagatccttgccttattaatttcgtctccccaagtatctagacattcccaaaataggaggttcaatgttttaaatagcattgatacatggttttccaagtgacttgggagtatgatgacatctcctaagcaagagtgattggacccatgatgaattcagtttctaatgaacagaacactagagaactgggtttggatctaacttttggttcttttctatatcctcttggaggtagttagcttcctttactgtttagatgtggaaagggccttgtttgctaagtttggggaaatacaaaaagcttggcagtcaggaactaagcaggaatccaatggactgaaaactcctttggagaaggatgccattttttttttttttttgagatggagtcttgctctgtcacccaggctggagagtggcatgatctcggctcactgtgagctccgaggatggcatcttatggttctttttgattccttcctccctagaaaagtccagaatatgactctgaacactatgtaagatatgcacatagtaatgaaaattaattgacaaaattttctgtggaatctcaattgccttgcaagaaataatacaagtgcagatcgagtttttaaaaccctgcataggaaggagaagaaaatgaacattctgcttcaggattggagttttctttctgatctgctaattctacaaagtatataagattactcaacacgttttaagtggaaagcaacaagcttactctacattatagtagccataatgtcactagggggtgtatgtttggttgtgagagggtgttatcaatgttaattacaaagtttttaagagttgataaatttcttcataaaacaatgacataaaatatctcttcaaggtaacaaatcctgagagtcaaaaagctcaggatggtttcaatcaataactttataactaccaactatttgtttttccaaaattattaattaacaactaagaaattgctgaaagcctccttggagcatttttacaatctttgtatagaagtaaatagtatttatgatagtatcgatatatttggactagactttaccatggctatgggacctgctatagttcttgatgatcccttgtcatgaatggaacttaggtagctattgtcacaatctctgcagtcactaagcatagaaagtcctcactaaatgcactaagcatagaacgttctcactaaatgcacaagattcaaataagatggtattttccaattccttcactcagtcacttatatgagggctaaagccatggtaacatagaggctcaagtaacttaaaaaataacatatttgaaatttacttgctggaaagggacaccccaccttgattttaatgaatttcagagcaaatacaagctgtcctcagtggctttcatatgaattccctgcacagtcttcttcctttagaaatgcaaaaactatttcaagatttttatgcctgcatggagaaaattgctattgtgtacaattagcatatttactaaggtttgtcattacttttggtaattaaaatcgtacaaaaagagagacatatccaattcaagaaaattacacagtacagtaatatacaatcataatagtcgcctgacaattattaaaatacaccaagttctcccttacagtaaaagtattcaccagagtagcttctgaataagatcattgcagtgctttctatttaaatgtttttctgcacagaaaattataattacatttgcataactactgtaatcaatctagaattatggctgaaatttttattcttgaaatcactgttctttctaagatagtaggagctctgaggcataatctaggtttgtgggccattattctaatttgtaataggattaaatatatttttgcactctctttacaacaatcaatcactctagagacatagcagacgatacaactacatcacacaatttgttttcttctgtcttgaaaaaacaaaccaggctttaatttaccaaatccattttgtccaaaaagcaaaacaaaacgaactcaagttaaaaaaaaaaagtcaaatttataaaaggagaacaccaaatattatttcatgaaacagactcaataagaagtcaagcattcatctctacatttagatgctctgtacttactgagattagctgggatggccgagataatttctgtcccatcatggaaatactggctaccataaaccaaagatttcttttgaatgttctcctttactcctgctgtattcaacaggcttccttggagcctgatgttattgtcttatctttttaaaatatccaagtcagatctgatgaaaacgataagcagacctaaatacattaatctgcaaccagattctggtagagctagccttttgcaacgataactctaagaaaatgccctgctagccccttcttctgaccaatgagctgataatgtaagaccctcacagacaccatctgcatgcattctctctcaggagtgcagagactcagacactgtagcaggccagagaatgaggtgttctaaaatcccctctctctggtcctgctgcaacttgtttttggttacacagcccagctcctcaagagaatgacatctccagggatcaggccataacaaaagaaattctcaatagcacaaacaatatatatttcctgagaagcacaacataaagtcactacagaaagctaccctgaagcatttctctaacatgtggtttcaaaatcatttccatgttatcaatgctaattataaagtttttaagacttgaaaaatgtctacatgaaacattaatgacataaaatatctctgcaaggtagcaaatcattgagagtcaaaaagctcaagatggtctcaatcaataactttgcaactaccaactatttgtttttccaaaattattaattaacaactaagaatttgctgaaagcctccttggagagtttttacaatctttgtatagaagtaaatagcatttatgacagtatccagataagttcggactaggctttaccttggctatgagacctgatatagttcttgatgatcccttgtcatgaatggaacttaggtagctattgtcacaatctctgcagtcactaagcatagaaagtcctcattaaatgcaatgtctttttaacaaagatattaaactgaactcaatattttcatacttttttactttggaagatttggagctgtgctcaaaattgtacaaggaactgttttaatgaccaattaattcagattggcagatacacagaaataaacatgttcagagaataacagcaaagactacatagatacccatagattatgattgacttttggtgagaaactcagataagctgaggacaaacattaaatcagcagtggaattataaccttacttatctttgtgctcaagtgtttgtttataagcatagataatacctacctaagaaaaatggagcccagcaggcagctagatttatatttatataattttataaaataggttcttgcctcaccatcagaggctggtcaagttgccagcctctagaaaacattgagatctctaggtatagatatatccttatttggaaggtgtatgaagccaaaataaagacaattccaagattcctcttctttaaataaggtgaagacccttaaagatggagaaaaatagtcaaagaagaaggcaaagaatcatagaaaattggagataggtggatgttaagcacattttattttttattttcattttatatacataaaaattgaggctcaaacaaatgaatattcttagtcatgattacatagccagcaaatgcattgatgaatatacagctaaatcactttccattatacaacactgaatttgaagaaataagatcacattatggatgtaaggcaaacataatagcccagggtcaatatggcagagaaataaaagttagcatttttctatcttaaaagtattctggattttccccccatcttcataaggttggtaacaacaataatggttcatggacaacctagaatatttcatatttaaactagagtcttttctcatggaaaacaaaccatccatgtcttgatcaaaacaggggcatgaattactagaagaataagagcaaagaagaaataagcataaaatgtttttcaaggaccatcttgagataatactattataactgcatttacaacttgtatgtctttttaaatctgatatttgtagtagtgtatagattagcatacttatggaacaaatgtgtttctctttgtttaagacaagtaagttataattcatacaaaatattagtcatggtgtcatctcttcaccaattctattatcatgtataggtcacaagctatttctggttttcatttttctttaaaaaagaaagaagagcttgaatagatatagcattttgaaaattttgtcctgaaagacttttccacctccattcatcttacagatctgataatttttcaccaaggaaacagtctttgtcctggagtctcatatggctcttgccataacagtatatccaaagattcattcatttatttactcactgaataaatgaaactctacaaggcaccaagttctgtaccatggctatgtatactgttaaaaacaagaaaaagaagtagttgaccttttagaatttacactacagtgaatgggaaaagtccattttttttataatgtagttttcatttgagtattgttttgtattattaatagttaacccatggaatggaatggattgcactcctgaagtattacttctgtgggaccttcaatgcttgtggctgtgtccttctttgctgtggcacatgctttgctagtggaaagaatttgcaaagcccttttgtgggggagaaaccctacctgcttgggatctgatctgaaaacaaaacctacatttgttcatcaccactacctcctctctaaatcccttaaatatccctctactaacagtcactcaagatcatgatttaatcatttcatgtccaataaagtattgatttcattttcattggttatcttttatatgatcatttagccattttaggcattatatcttcaagaagaaggagatttgtaaatactacaaaggggttttcgttttgtgttgttgagatattactattaaagtttctttttttttttttggatacagctgtgtaaaataaccaagatctatttctcattctagcatgtggtctcagcattctgtacaaatgattttactggcttcgtaaactcccaagttaaagaatctctttaggaagaatcttaattgacctcttgaattgttggcctggtacccagagtaaaagaattgtgttttaataaggattacttttgtcgtggtttattatgctttagcaccacacgctaattgatgtagttgcaggaaataaggtaagacatgccatggtttggttaaaagcttcattacatgtatttatgaagagtcttatggatgaaataatttacaacatctattacatatattgaaatgtatgctactgcttccatttcttataatctgcggaacccaggtctgaaaccacttggtggaaaacgtttttaaattttattttggtaccaagtggcaataacaaaagttcaatgactggctgagtagcaatttggactgatttctaaatgtgggcacagcattaatgaaagacatttcttatttttgagataaagcaaacctacatgaaagagaaattacatcatttgggtactagtttcagtgaatgcctgacaatgggggagtcggaagagtggtgtaatgacggaatgctaaagctaggtgagttaggaagggttatttggagataagccttgagtaggacctcaaagaagggaagcaatgtggataagctagtaggaggctgatccagaagttaaatattaaaagtatagcactagagatagcaacaaccatgtgtctagactaaagagcttgttttttttttgtttttgtttttgtttttagaaatgagtatggatggagagaggggattatagcagagcgaatagtgttgaagtcttggtggggacattccgatttaataagtaagtatagtttctttatcaagagtaaccattcgaaaatgctatttgaggattagttaccaatgcaactaaacttcataatgaatgatgatcatggttagcacccactaagtgcttactatgtgttatatactattttaaaaacttcatgtatgtccttgtgtttaatccaggattttgtaaccatgatgcaattgacatttaggattaggcaattcttacttgtgggggactgacctgtgcactgtatgatggttagcagcatccttgacttctattcaccagatgccagtaatcacaccaaaacatccccacacaaccacaagttgtgacaatcgaaagtgtctccagacattgccaaatactcgagggcaaaatctccctagttgagaaccactgatttgttcttaacaccacgtttcagttaaatttcattaattctttttttattgcctctttttgtagttgaggacatggatgctaaataacttgcccaatgtcacatggttaataaacaaattttaaagcctccctgtgaactccagcgacttaattctagggcctggatttgtaaccactattgtctattacatccccataatctttctaggcaggaatctagcataaacaaaaaaagaaatagcccagtgtagtaagtctcgtttgaactgatatatgaaaaaaatggcagacatttaaattttaggtaatgctatcacagccggtgtagtcaagacttctgtcttttgttttgcaatttatcaaaaggctgactttctcatctaatcctatttcagtggtatgttctacataatttttaagagattttgttgtatctaaccttaaatcaatatcacagcagttttatgattttttagtgcctctctcatcatttcttctaggctttggctggacaaggggaataaaagccctgtgtttttccacaactataagaaatgcaattatcagagcatatcttgtactttccaagtatccctagattgtacaatatgcctaactgtcctaacacaaggggacacttgctgcacactttatgattagagctgttccatgttcctttaacgatatgtggaaagcaaggaaaagaatgctaggagggaaaaaggtctctcctttctttgatgtggaagttttgcaaatcatatagtgagacctcctaagagttcatctcactctaggcacacaggagactgtggctggagtagggaggaagaaatgagaataacatagaaatgattataaatggtcacagcctgtctttggctagaaaaataaacagggatttctgccaaaaaaaaaaaaaaaaaaaaaaaaaaaagacctgggcttgggaggaggcagcctggccctctgtgtgtggcctctgtttacccttctgtataatattatgacaggtccttttcaatgataatgttccatgcatcagtaataatgaatgaaaaacaagaaagcacttgcagggtttgcctattaccttaaaccactgaacatcatagagaaggcagcagatgtgacagacaaaaagagattcatagattaatatagctgaaagcacactgacagccaaaagcatgttttttttccattccagaaagttctacctgtgaaatctgagactctgccttttcatctataaaatgggataaaactatcttgcaggattttgtgaggcttagataaaaatctccaaggagatggaatttccaacagtatccatcaaaatacaggcactcagtaaacttacacgggctaaatagataaatagttttcaagtgaaaatgtaattgtgaagtgcagtttagttctctttgcctctctagggctttgtagaacatgaaaaaaagaagtaaggatctttttattttattttttattttaacaagacccatggactaaaggtaaagagtaatgcaatttaaaggaccaatgcaactaggtaggtaaagtcctacctagactcagaaagtccagacaccagttacaggaaacaagataaaatgtatgagtctcaggataagaccgagggtttcaacattactcacagaaggcaagatgccattttctacaaacttaggggcctttctttgcgtttagtcaactaaacttgaagtgagagaaggaactcaaataggagaaatggctaccatttctttgccggtgatgggggagaagtgaaagcagtggggctatgtattattctgttctcaccctgctataaggaactgtccgagactgggcaacttataaaggaaagaggtttaatttactcacagttccgcagggctacggaggcctcaggaaacttacaatcatcgtggaaagggaagcaaacacatccttcttaacatggccgcagaagagagaaattagtgcccgcaggggaaatgccagatgcttataaaaccatctgctcttgtgagaactcacttactatcacgagaacagcatggggaaaaccacccccatgattcaattacctccacctggtcccactcttgacatgtgctgattattacaattcaaggtgataatcagagcgcagacacacagccaaaccacatcaggctatatggaaaaaaataaatcaaagaagtttgtcctcagacacagaagcaacatttcacgttccaagacattctacaatgaagtgagaagcctggcacttccttcctccacttccagacttaataactggtagaacaataatatccgtaagtaacaaagagcctggaatggatgagtctgacaaagcccatccatcctgccacctcacaaactatctatatttgttcttttttctccagctttggagacagaggatgtgttccagctcacagactttcaggaataatactggaaattgacatctaatcagcattttatgcactataattgtgtaaacttttaggcctgctgtacaataatccttccctgctgtgtggtgagcactttggggccctctggatgctagatgtgatatgaatgggaagcattattattatttatgccttataatatgtcaactctatgtcctctgccacaacagacacttatttcaaatgtgcagtaacagcccccaagtgatgtattgtcaaaatatttttgaaatgaaaaagcaaaattaaccataaactgcccccttgtctccatgaaaatggcactgtaacactaccaaggaaaagcaatgttaaataataaaagctacaacaaaataaaagtcaaaaaaaattggaagagctctgtgtttggaagaagtatgctttggtaaatcacaacaatgacaatttcgctttccaattaaagtgtaatagtgaaagagcaaaccatcaccccagggtatcctcaagaacagctcaatgaattctggcttacttaaaaagaagttttcagtggagctgtttttcttgcaaaagattttagaaaaaaacacagcctttttttttttttttttggatttacattacgcgaaccctgatattatcagatatcatctaatgactcatcaattcatacagacctttaaggttggaaagcacatatttaaatatatagtagacagcaagtaacaaatgataggaactacattttagtgggtaaaatccttctgcaccatcaaagactttctaagagctatgggtttattactcaggtgattcagtttccattttgggacaggtcatattaattttcaggatcttttcccagaatgttatttaattagtgtgactaaatatctgaatcaggatgctacggtatttttaaaaaggaagatgtcgatttaaatgtgatagatacttaacagtttgataaacttttaacagactgtaaccttgatgctttccctggtgtagggaggcatccaagggaccctggtgaactgaaaaagttaatgcacttctctaaacattttgagtctggcagaatctggaactataaaataacatttcttcattaacatacaagtcacaatgctattcccataaagcacctctagcatataaggctggacgtttttcagaccatcatttatagggcgggtttatttttctttgtcttgacattaatgagctatgtattcagggaaatagaagatttcaatgcctgtcaaattacctttcaaattaccaaagcttgcttttctcctactcaaagagcaagcagggacttcttttagaatgggggaccaatggaatattcagtaaaaagggtcatgaaaataaatgtgaaggcagtaatggatccattccaaccatgacttcatgacaaaatgctgtgacttcagcatttcattacttgccatgttctcatcctttgtattattatcacacctcccctctctcccacgttattacatctttttgggaaaagaagatatgtgaaaatttctgtagttgtatgataccttgttctaaaatttagactgctgatttgatatgaaacacataatgtttttatagatcaaggctgccagttatttgtaaccattctgttacaaaaatctttcctgagcaatcttggtatatcatcttctgccacatccttagcaattaactgaagctaactgtttcactaacatttccttttccatttatgtagaatgggctgaatgtgttaatgcaatataacaagagaaataggcacagaaaaatcctctttcatatcgatctcagaatcctgtctgtgtctcatttgggatgaagagaaaaaataatcaagaaaatatgtgttggcagggttaagaatacaaaggaaatattactggaaaatatttaataggtaaatatagatgagggaataggcacaaggttaggtaacaagcagattgaatttcaaatttcctaatgactctccctgttttgcaaatccttccaaaacattacctcatctgtgctttcatcatccctagggtatagggttcgattactcatcctatccctttgcacaatggagaaatttacatgtattcagccctagccgtccttctagtcattctctcagtttagtacttacttgttttcttatttgggttttggcctgttctccataagtttgaaagctgtttgaggacagggatatgtttattctgtacttttctggtatcctcgcttggaaatttagtacttaagagctaggtcgggctgggcgcggtggctcacgcctgtaatcctagcactttgggaggccgaggtgggtggatcacaaggtcaggagttcaagaccagcctgcccaagatggtgaaaccccgtctctactaaaaatacaaaaattagccaggcatagtggcgggtgcctgtaatcccagccactcgggaggctgaggcagagaattgcttgaacccgggaggctgaggttgcagtgaaccgagatgctgccattgcactccagcctgtaagaaggagcaagattccgtctcaaaaaaaaaaaaaaaaaaaaggaggctgggcgcggtggctcaagcctgtaatcccagcactttgggaggcctaggcgggcggatcacgacgtcaggagatcgagaccattctggctaacacggtgaaaccccgtctctactaaaaaaatacaaaaaattagctgggcatggtggcgggcgcctatagtcccagctactccggaggctgaggcaggagaatggcgagaacccgggaggcggagcttgcagtgagccgagatcgcgccactgcactccggcctgggtgacaaagcaagactccgtctcaaaaaaaaaaaaaaaaaaaaaaaaaagagagagagagagacctagggagctacgtcctcattaactattataaggtggtttcagaggagcatgtagtgcactattgaagctcaggtttatcttaataggtgtatttgtatacattcattaagtatacgcagactaggcactcctcattttacactcaaaactcaagtagctgtaggactaaattacttatgattttgatttataaacagcagaagaacaatgggtaatccatattaaaaatgattgtgtatcatctcctaaagaaagcattttgaatacgtgtttatcctgttcttaaatggttttactctttgttatattcattctaattaaactgttctagtgcaaaaatgctaaagcaatttctgtagtttcattttttattctaaaattcttaactgtatactgaaagtgagcttatgaaacattcttgatatgaaaactcacaagttttcaaacataattctttatctttaaacacaatacctacctgaaattttgccagacaggcttatcctcagagtatgctttagtaggttaatactctgaagaattaaatgtaattcacatattaactactggtagaaatccatgtgcaatcatattgtttacttgataattccatatacatctttaaaatcaaaatgctctgtttcacttctcaggagcagttctgacacattttatactttttgcagattcaggattagccaggtagagctagcctgtgttggcttcccagttaaaaatcaataaattttaaacataaataaaaagaaattctctctttaaaaagtattttgaatttctatatgtgtgtgtatgtatgtataattacagtagtaaaaattttattaaatctctaccaaaatctctcctgacacattcctttctctttctacttttgagtaactataataatccttctcaatttttctagaaaaagaaacatgcattcaaactgatctcagaaaagaatttttctcatgccaagtcaaacaagttagcaatggtaaaatatatttcattaaaattttaatctagtcattaggtagggaaggttaaataacttaagccttttcttaactattaatagataatgtcaactcttgcctagcagcttcaataagcttttgcaaagtgttgaattccagtaagcactttcagaaggggtaagatgtatacgtgatcatctacttaggtcataatactgcacaaatagtgctaatgtgaaatatctgctgggatttttagtacaggttgtttttatagtttaaggatcaagttgcttagagagtgttcacttctctaagacatacggaaaatatctatgaaactttactatctgaatgtgtactacctgggcacactatatatagctagtatagcaggatggaaacttcttttggttggaaaatgcgtagacacaaatgacaaaatcaagtgtaagcaaagacagtaagcatattggaaattatcttggacaaagagaattttgcatttcttttgaatatctcctatggaatatatcacatagttactaaatgcttcccgttgagaaatagtgaagaagtatttttctaagaaataaattattagagactcaaatattaacccttattagccatacttacaagagacaaggatgttagttaaagccaggagaattctttagtgctgtctttctagacgttagaatttctcaaatgtattcagtaattaaaaacattttgaaaaatttttaaaaatgtaatatacaatcattttaacacatattttgctaaatcatctattcagaagtcctctagtttctttatgaccctatacagaagataattcaaaaccatggctacaacatatatgttaatggtaatatttatttatttatttagagatggagtctcgttctgtaacccacactggactgcagtggcacgatctcggctcactgcaacctccacttccagggttcaagagattctcctgtctcagactcccgagtagctgggactacaggtgtgtgccaccatgcctggctaattttggtatttttagtagagacgagatttcaccgtgttagccaggatgatctcaatctcctgacctcatgatctgcccacctcagcctcccaaagtgctgggactacaggtgtgtgccaccatgcctggctaatttttgtatttttagtagagacgagatttcaccgtgttagccaggatgatctcaatctcctgacctcatgatctgcccgcctcagcctcccaaagtgctgggattacaggcatgagccactgcgcccggctacaggcaattttttaaaacctgataaatatttattccttattgttccagtcctggatattaacttctagaatttaaaaaaggtgataccttagtactttctgatttaaaaattttattagctcttgtacttaatgattagatacatagaatgacagatcttctaatacaattaactctgtaaatcaagaatcttttcttccccaaaataatataaaaagatataaataatttacaaaagcaggggattacatttagcaccaattcaaagttcttgtgaaaacaattaaagaatgtgtgcaaaatttcaaaactgggatacaaatctgaaattttatagaatcattgtcaaacaattgcagatgcaagaatagtatgtttgatttatttcttcatactttggaacagaatcaagtttgtataaaaaaatcaaattctcaatttttacaaaaagagatgttttgtatttagttatactccataatttcctttcactctttctatgaaatctgtgatgagtagtcactgaaatatcaagacacaacaatgttagactttcattcagtggcctgtaaatttactggttgccagaatatcttatatagtaggtaaaaatagagcttctaggaagactgaattctatccttagttaatgctgaggttcaggctacatatattcccaattgttgctgaaattaagtagtactacatcattctgtcacctgccaagggagtatgtgtccttccttcctcactgatacccagggaagaaacaagaatgcactgaagatagtgatttgcagcaggtgctgaggctcccttgatatatgtacatatacatgtctgactccataatatactggaacccataagaaaggcataaattactaccaagtgtttctctcattcttcctggaaagaaagtcctactactttaccttgcttagtaaatctaggtgctgctctttcctaaatgaaattttgattaagaattattatatctgaaactcctttaacctccatcacttctctttttcaatgccatttgcaaatatgtgctgtaagatataaagaaacactgataagattacagttcccctggtactgtccaactaaaaaggaacccaagaacatttaagagcctggtgtcattttttttttctgggaaaatacatcccattttttctcctgtaaatgctttcaacctggtgacctatgacagctttgcagtgaaaatcttgaactggtttttacttactttgaataaaaggttaatacaaggcttcatggaggtttaatcagcaccacattcaaaaatgagggaagcaaaggcaaagctaatgaattgaccttttaaagagcaattcaatgggataattgccatagcacaattcacttcggggccgaatatgtgtatatggctggtcttccttggatccaatccaaggacatttaagtatgtaagtaccaaaatcatggtgggttggatgaggtggacaacaacatcacatacaacctagtggacctcaaatacatttttcataaaagtaaagctgtgctttcacgcataattttaacctaatcaaccagttcatgtatgccaccaagaaaaattaaaacattattaacattatctgccatctgtgctaaacactttatatttgttattttgtacaattttcatagcaccccaggcattaggtgtttttattcctattttacagatgaagttggatgtctgtctagatacattgccagttcttcctgaaatcaagtagttattcatccttctgttcttccaaggaattgtgtgtcctacctttctcactgatacctagggaagaaacaaggatacactgagaacagtgatttgtagtaggtgctgaggctggcttaatataggtacatatgcatatcagaggggtttaaataatatgcctgatagaccacggtggatgacattaggaactgagactgaactttatctaacaagaccttagaccgtgactactcacctactcttaacaaaaaggacaggtttttgccctgagtgtttttctaaaacatcttacatgtagaagtacccccaaggttaaactcaagataataaaaaggtttccccttggtcttatgccctacttttcctacctttatatttatgagaaacattacaatatatgtgctatcttataggagaaagctaacagtttcctttaaaggggggaagattgggcttttttctttaaatcaattatggctgtggctaaagaattaaagtttgagtgcagagaatcaggttttagtcccatttctgcaactagctttgtcaccagagtaattctttttttttttggagacgaagtctggctcttttgcccaggctggagtgcaatggtccgatctcggctcgctgcaacctttgcctccaggattcaagcgatgctcctgcctcagcctcctgagtagctgatattacaggtgcacaccaccactcttgactacttcttgaattttttttagtagagatggggtttcatcacgttggccaggttggtctcgaactcctgacctcatgatctgcccacctcagcctcccagaatgctgggattacaggcgtgagctactgtgcccagacaccagagtaattctttaggttactcacctataaagtgaaggttctgggctagctgatgaatgagattcacagtagttttcagatggtgtgatttcagtactgttcactcagcctatatatctacaaacactgcactagatactgtgaagagatacgcaatagctgacaagacacaggttaaattctgaatgggtttataatttggcaaattgggggtcggcagtgagtgaggtagagagtggaggtgcagcaacaaaaaatgttcttttatgaaagataatctttactaacccactacacctgcgatgttccttttaactgcatattcctacaatacatatatacaactctatccaaccacggctttacaatcagtcccaggagatgatttgtaaacaagatttggggaacagtagcaaatatgagtaggtagagaaatgaaattttaaagtaagaagactggcttatacggcgacaaggagttagagatgaggagtcagacatgttgaaatgaatggaacttatatttagataggcacataaatgacatgtgcaatgtcatatgaaacaaagctgctataggtcatggaagccacaatcttcaggaaagtagctaaagaaattgaggtggcagtgggaagagtaaatcaggaccagagcgtatgtaagaaaaatatgacaatgtcaagtagcagaaaatttgaaaatgctttggggtatctacattttaaaacacatttctggaagtaatattagtttcttaagcatctatagtgccaggaatgttgcatgcatcatctgtcataatttttacaatcatcttgcaaactcagatatactttcctattttatgcatgcttaagcaggttaagtggcttgataaaggtctctagctagtaaatgagaaagccaggaagagatcacaagtgtgccctgcagctagtaccacgtcaagtcttactccccaattaattttgcaaatatgaaaagtaatgactttagcctatgtggcccaacttcaggccagtcccaactgggaagattttataataacttcttagaaactgctactggctctttctcactggcttagtagtggatattaatctctttattttccatatacaggcatatggcttgcagacatggcatactgtgtgcataaaaaacttccttagaaaatacatcatccaagaagcaggaattgctgattatttcattactgcagcaaactcatgtttctaccatcccaagtccggactctgtctacaagagtagaaaaaatccactagatttttaattcaacatctattcaagttttgaggcacatgctatctgaaacaccgtaatttttgagtttgaaacagagaatttttctttagcaactttggccctgaaatgtcctccaatctcaatgtcaggaggtttgctacaatggtctggagagtgtagtttttcataaaaatatgttctatttttcaacaccaaatgaatatctctttcctgcatattgctcaaaatagccatttccttcacatggttatgttttattactcatgtcatcagatctggcaatgtgagatttatttagggggaacatttcatcaattacaaaacataaagcatgtgctgtctctcaatgagttcagttacatcttaaataagttctgagctgttgggagaattacaaagaacacacttttcctgaaaaccattaaaattgcatactcatagaattttaaaaaaattctatgcctgaagttttaatatttttatcccagggaagtggattttttcacttcctttttagattatggccctgagaatatatcacccgaaaatgaagcatgaaaaacaagacaacttgagagcaactcacagaaattagctgatttcatgatatttatgtgctactcacttgcattgtttaagtcttttcttttctttttttttttttttttttttttttttttttttttttttgagacggagtctcgttctgtcacccaggctggagtgccagtggcgtgatcttgattcactgaaacctccggctcccaggttcaagcgattcttctgcttcagcctcccaagtagctgagactacaggtgtgtgccaccacacccagctaatttttttgcatttttagtagagacggggtttcaccatgttagtcaggatggtctcgatctcctgacctcatgatccacccaactcgggttcccaaagtgttgggattacaggcgtgagccactgcacctggccctgtttacttttttcattgactctccctgccttaagagtaaagctcaagtttctaccctgtcctgatttatttccttctttccttccttccttccttcctccctcgctccctcccttccttccttctccttccttttctcttttccctttccttcctttgttcgttcccttccttccttcgttgcttccttccttccttcctccctcccttccttccttcctccctccctccctctctcccttcctccgttctttcctttgctccttctctccttttttgagacagtgtctcactttgtctccaaggctggagtgcagtggcactctcatgactcactggagacttgacctccgtggctcaagcaatcctcccaactcagctcctgagtagctgggactacaggtgcatgccaccatgtcctcctaatttttatattttttgtagagacagggtttcccagcttggccttgaactcctgggctcaagttatcctcccgccttggcctctcaaagagtgggaatatagatgggagccatggcaactgcctgagccctaccctgtttttgcagggccctgcatattgtagtctctgtctcctaaacaggggaaacttctatcctaacacctttgctcaaactgtgcttgccacctagaatatcttcccacatgcacagttatgggaagcctccttataccttaagggccttgctccagttgtaaataagccccgattcctattatgttgtgttagttttctctgggctaacattctgtcttcaagatctttgtgtttagatcctttgtatgtttcaatgtgtcttgggcataagtactgagagcacaggttaaatgcaaaggtgagagaggctgtggagaaaaaattaaaaaaaaaaaaacttttggcatatttagaagtcactttgcttctcttactgtcaatgctcttatttctgccctagccataactgtaagaaaatacttaccagttgttcaaagataggttgttcaaagtaaaacattaaaatgttgctctttaaaattctttttgtggatatactgagggagcttttataatcctataaatatagagaattgggtgcacatttcttctttaaagacaggtttttacccactcttcctaggtatctaacaaggagacatcaaggcattttaaaacaaaagacccagattctaaaataataatgtctttttttacactcaagattccaaacacaatttgactgaccttcaacagtcttgtaaatagccatatctagtctcactccctatagagagaaaatcaacagcatagtgtgtcctactgaatattatataagttgttagtatcagcattaaaacaagggagtcttactccttaggtgctgctacacatcatctggataggcaatctctcagcacaccacctaggccttatcttctgcacattgctcaggctaaggccatgcctggcaggtagtcagtatgcaacaaatgagccatcaaatataacaatataatgaaaggccattaggtagtctctagaaatatctgtccttaatcttacatttgttttttctcactgtatgtctaaacattgctagtttatcccagaaacctagttgcttcttttctgacagtggttgtattaggtaagatgggattgataaaataatcttggaatcttaacatgtaattaggtgaacaataaaactatataaccaaggaaatgtgctgggttcaagcataatcaagatacaaaatttgtcttcatggagcttgcaatgctgttagtgagtttgatggtctgaatgtttgtgttttccccaaattcatatgttgaaacctaatcctcaatctgatgttattaggaggtgaagtctttgagcagtgattaggtgttgaggatggaggcttcatgaatggaattagtgcctttataagaggctgaacaaaccagagttcttccttttcaccatgtgagagacaacacagctaaaagacagctatctgtgaagcaggaagcaggccctcaccagataccgaatcagctgccaccttgatcatggacttctagcctccagcattgtgagaaataaatgtatgttgtttagaagtcacccagtttataccattttgttatagcagccctattggactaacacagtgaagcagtcactacggactgaattaggtccctgcccaaatccatatatatcaaagccctaactcccagtgagtttgtatttgaagatagcatctttaggaggtagttaagattagatgaggtcttaagcatgggatcctaatccaacaggactggtggccttataagaagaggaagaggatgcacacacacatgctctccatcctacacgcaggaactaaggaaaggccatgtggacacacagcaagatagtggtttcctgcaagtcaagcaaagaggtctcgaaatgaaacctactttactggcatcttgatcttggacttcttagcctctggaaccgtaagaataaatttctgttctttaaatgcccagtctgtggtggcccaagcagactaagtcagcagtagggcacattgggctctgaatttaatatgaataggtttcaccacttgtcaactatttgactagagggactttcttagccttatccttaataagcccaaaggtcttttgaatgaaccttataagaatatctatctacctcaaaatattattgtgacatttaaaggagaaaaataaaatataaaatgccagctccatgccaaaatataaaataaaataaaatacccagctccatgccaaaaatgctcaaagatgcaaatgcaagcaggcatttaaaatgtctgggtaactatgtgtcaagtgggtagcagagacaaaaggactgtagaattttggaggagaaagagggtctctttggttggaagaatcaaagaacattcaagatagacttaatatttatctcagcttgactaaaggttagacaggttgcttcctgactataggcccatgaccttcttttccttagagcctttactttagaaaacttgcaattataaattctttctctgccccttttgaaatgtatctaaacctccttaaaagcctctggccagttctatgatctagggagtatctctctcaaggacctgcatgccatacttttcagatctaattatcaagaaagatagtgcccccatctcccagtctctgtggacacataggagtctatcataagtgaacaattagaaactataaaacactttatgtcatgcatatgtgagaaagtttactttctcctcctgtaaggataacaggcaaacacaggtggcctatgattctcctacatctgctcttaaaaactgtccaacactttgtttcttcagagttgagttcagtttctctcccctattgcaatagccttgattaaagtcttccttgcctgtgaaactttgtctagcacatttttctttactttgacaggaaacattcatagagaatatacaacttgaaatatgttgtaaggtatggcttagatattggtttggcaatgtataacttaaaatgaaaagctgcatgcattttcatgttagcagtaactagttatggcatgtctcaatgctttactcaagagttttcttgagatctttttaatatatattatttcaacagttactcagcacaaagtaagtattttttcaggctcaaaatcctgcactaacattgtaagctccctatggcactagagtttgtatatatactttcaggcagctgaagacataggtaaatctttgcaaatggggagagagggggacaaaaaagggttcctggctcataattttaaagcactacccacagtgggactgttttctaaagaactcttaagtatgcagcatatatactaacatgtaaagcacaccttttgcactaatcaaatgtgaagttatataaatttaatatccaatgacttaagaaagtgggatgccaacactcatctttatgactaaagtatacaattttatgaatcaatgtaaagaagccagcatgcttggaaggaatcttttgctcaaactcagattatgttattacactgctaatcttggtgtgtttttttaaaaacgtaacatccttctaatcaagcatgattagttacaaatagaatccaaagaaatatctcaaatgactatatatctaaattatcttgcttattacttatgggatatttttcttatccatatccaggttaattacaatttcagaaattatctgtacaaatgaataaaattcaattctcttagccaatgagttactttttccagtgtaaagtacagtcatttaggcattcacaatatatggaatttagaaatcttttaacatgatgaagttgaaaaaagtaaacaaatattactttgccaattctccaccagtcagaagcttgtctatatactaactgtgtatttagaaaatatcaatgcataaggaagagaaatgcaatttgtctcatccaaacgcatcatataaaatgaccaagtgctgttaagtgctagagatgtgtctcaaaagactctcaatgtctgtatcattttggggttgtttggaagttaaacccttttagtaagaagtattggaagataaatctagttctcagcccttaattcgccattcactggtgaggtgttcttattagagagcatgtctcctggtctcactagttcctaatgaatgtgtctggcctttcctagcaatatataaattctgagaaattggaagacatgattgctccctacccaattctgaaaagagtgaatatatcattctttgtaacagatggaatgtattaaaaatatatcaatatgtgttttcataaaaaagaaaatatctaccattcaattagaaaagtattttggagaataataaaaatgatagatatgctattttactgttactagccagccattattgttagaaagaatatgattctaaatatactgaaagtctggtgacatgtacaagacaggaaaagcacctttattcactcgtaataaatattttcctgttcattccctacataaactagaacaattaatattttcctcagctttcctggagaatgagatatttgacctgaaactttctctattgtgatactgctagcattaattaagtggcagtattcaagattaattggagacaagaagactagttgggaaattgttttgtcataaagtagaaaatagtgccatgatggaaggaatggaaaggaaattcaatttcagaaatttcacaaaggaaatatggttagatcattgaggttgaatttgcagaatttagtaatatacaccaagattgcaatttgagagctaaaagctgtttcaagttcagtgttctatggactaaactgtgttcccggaaaattcataggttgaaaccctaacccccaatgtgacttatttgaagagaggaactttaggaggtaaagttcaatggaattataaaggtggggccctaatccaataacactggtgtccttatgagaataaaaagagacaccagagctctttttccctgtacacagaggaaaggccactcagagagggtggctgtctgcaagccggtaagagagctgtcatccaaaattgaatggatggacactttaatattggactttccaggctcccaaactgtagcataataaatttctgttgtttaagctactcagtctgcagtgttttcttttatacacacacataatacacacatacacacacacacacgcccccatatttatatactgtgtatacacattatatatatattttgttatatatacatgtatgtatacacacatatatatataatcttattaaaatcttatatatgttatatttgtctctattaactaaaatttaagtaccatgagggcaggaattttaatctattgtgttcaccactgtttctacactgtctaaaacagtgcctttcccagtcctaagcaaaaagaacaaagctggaggcatcatgctacctgatttcaaagaatactacagggctacaataaccaaagcaccatggtactggtacaaaaacagacacatggaccaacagaacagaacagagagcccagaaataaggctgcacacctacaaccatctgatctttaacaaagctaacaaaaataagcaaagaggaaaggactccctattcaataaatggtgctgagataactgactagccatatgaagaagattggaactggaccccttcctcacaccatatacaaaaattaactcaggacagattaacaacttaaatgtaaaaccccaaactacaaaaaccctggaagacaacctatgcaataccattctcgacataggaacaggcaaagatttcatgataaagacaccaaaagcaattgcaacaaatgccaaatttgacaaacaggatctagttaaaccaaagagcttctgcacagcaaaagaaattatcaacagagtatacagacaacctacagaatgagagaaaatttttgcaaactacgcagctgacaaaggtctaatgtccaccatctataaggaatttaaacacatttacacacacacacacaaacccaattaaaaagtgggcaaaaggacatgaacagacaattttcaaaagcagacatacatgcagccaacaagcatattttaaaacgctcagcatcattgatcgttaaagaaatgtaaatcaaaaccacaatgagataccatctcacaccagccagaatggctattattaaaaagtggaaaaaaaaaaaaaaaacaaacagcaggtgctggtgaggttgcaaacagaagagaatgcttatacactgttggggggagtgtaaattagttcaaccattgtggaaaaaagtgtggcaattcctcaaagacctaaaaacataactaccattttacccagcaatcccattactgagtatatacccaaaggaatataaatcattctattacaaagacacatgcacacatatgttcattgcagcaccatcctcaatagcaaagacatggaatcaacctaagtgcccattattggtagactggataaagaaattgtggtatatgtacaccatggaatactatgcagccataaaaaagaatgagatcatgtcctctgcaggaacatggatggagctggaggccattatccttagcaaaccaacacaggaacagaaaaacaaatatcacatgttctcacttataagtgggggctaaataatgagaacaaatggacacatacagggaaacagctgacaccgggacctagtggagggtggaggttgggaagaggtagagtatcaggaaaaataactaatgggtattaggcttaatacctgggtgacaaaatagtctgtataaccaacccccatgacacaagtttacctatataacaaacctgcacatgtacccctgaacttaaaataaaagttaagggaaagaatagtgcctttttcatagtaggtgttttacaaatatatacttagtaaaggaatgaaataatgccaatatttgaatgtggttttgtatatgactcaaacccatatagatctgtaccctatttctatcatatttccattcctttctaaaaatgtattttctatgttgacttacctgaatactgttattctaaggtccacttggataatttatatatagtttcataaatgagtagattttagcagaggtgattggcccatattagaatgtaattcaaaacttgaatttattattttaaattgaatataacagcttggttctatgtgtcataagtagagttaaagtcatatacctttcttatatttcattcttccgtgtcatcacacaacaatgaagggtacataatgctaaaatgagcacattcattgactgcacatctcaggaagaaataaaagaatataacctgattatttgaagttacagaggctagatatggggacatctaataaaaagtttgaataatttcaaaacatatctttttatctttgtgagattttctctggtatttacattttcgtatcagcatttctcatgatctaggagttcctactacttgaattaaactatcatgttttctaattcttacaagctagatttttccttcccttacagagtctcatttctctacccacttactgaaaaggtagtattttctgtgtgtgtcttaaaatgtttttagattgcaaaacaaacaaaaaaactctcaaaaacatgctgttaacttctgccagctgtttaattaagcagattttataggaatgtgaacaataaaaagcaaaattctggagctatattgcaatccagataatattcttatcctcagaggaaaaaacaatgaccttcacttaagttctgctatattattggctatgatttgaataagaaagcttagtatgacaactgcaaaacatatacttggagaaaaatagcctaaaatataaaactaaggacaatgtaggagcatgtgtgttaatgcataacagacccacagacacagtgggtatcacaagcccttttaatcaagacagaaatatgcacatatatatcatgaacattaatgaaacttgtggaactcctccatggttccaaattatgtcctgtctcaaaatacatttatgtaccttatggtaaagtgatctttgaataatgggatcactgaccattacagttcaccgatgaatacttctaaggaggaaaggagagaaagctaactataagacttaaacagcacctgctgtcagctaaacaaattagctgccctgaaatcacatgtacccacaaggaatgaatagcacaacctttacctaggagactgccttcggaggaaaatgcgcagaatagaaatagccagtatgatatggcttggttgtgtccctacccaaaatctcatcttaaattataatcccggtaatcctcataatccccatgtgtcaaggaagagaccaggcggaggtaactgaatcatgggggaggtctcccccatcttgttctcatgatattgcgtgagttctcacaagatatgatggttttatgtgtgtggtagtttctcctgcattcattctccttcctgctgccttgtgaagaaggtgccttgcttcccctttgcctttcaccatgattgtaagtttcctgaggcctctccagctatgttgagttgtgggtcaattaaacctatttcctttataaattaccctgtctcaagcagtgctttatagcactatgaaaatggactactacaaggcttctaattgttatcccaaatttgttcagcttttgacaaatctgtatacacatttgtctttgatttttagctgtttgtttgactttttaactttttagctattaaattttatcatttactaggctagagcagaaatgataatacaggtttttcctcatttcttaaggtgtgattaattacaaacatggccaaaattcttgcaattcctctccttgaatttgggctgaccatgtgacttgcttaatcggtgtggcaaaagcaatgtaacgtgagttctgtacctgagcctcaagaggctttgcaaaattccattttcactcatgggattctgtgattaaaccggccttttggaggatggggcataagctgttctaactaattcatcttagatagccagtctctagctagcatggcaagctgatcaccaacatatgaactagtccagttgagatcagctaaacctagcccagatcagaaaaaccacctactgaagcccagtccaaatggcagaaccacagaattatgagctaaataaaaggctgccattttaagcaactaagttttagaggagcttggaacacatcaaaaactaaatgacacaaaaggttagctgagaaacattttttaaagacaaaatgtattttaatccagcttaaacagaatatctttattttggttaactttaaattaatagatgaaataggtaatgataactatacagggctaaaacattttatatatggttaggtttgagtgtaaaatttttatctcctttgttcttttttttaagtcagtttctgggcttctttttagcaaagcaaacagttatttggctctaattacaatcaaaatttataaaaaaaatttttgaagtcaaagtaaaaaatccagaatattggaatatggctaataaccaaaatcttcctctccttctaacactactttaatatctcactaatatttctattccttactccctggaataaattgaaataggataacaagataaaattatacctggtttttcattctgggttttcttcattgataaatagagggttatgaagtcagaaatataagactattttctcctgagatttcattaaagatacgatattaggaagactgaaggctattgtgctggcttaccacatcatatacttccaaccatcagaagtgaatgacaatgcaataatgcaaaagaactcagctcttatcaaccacagaagcatttagaatttctgtgactgctctttgagtacaaacgattattactaaactttgtcaaactgggaagattaaaagatttttcagggttgtgtaagtgcaataccataaatactcaaccaagtagaaactgcttcagcaggttaaactaatgtggggaagacactagaaatatcagaattcagaaacactgactccaatgcattgtttttttcatatttcagaatctgctaaaagttgaaaaccagattaattgcggccatagaaaagccttctcatctgtcatttgaatgtgaaaagaaattacttgaaatgtagtgggcattctacatttcaagaaagaaagagggtcgatgaatgaaataagcagaaaaaggaacagcttagaatatgatatgtagagatacctgaggataaagaaacagtgagagcgaatctgtagatagtctggaaggagattagcagaaaatatacataaaaaatcacatcagttgacatccctctactctgtgacattgtggtggcgtctaagaaggtcatcagtgtttctcagtatctggcattcctgcccctatgtaatgtccttcgcttgcatgtgggctagacttacagcagccaggaggaagtgtcacttccaagattaggttataaaaagcctgtggctcctatcctgggctttctctctctctctctcatctgtcctggaagaaaagtaaattgccagctgttgtgaggatccctgcacccacatgtaagataataaggcatgctaacaaccatgtaagtgagcttgaaagtgaatggcatcctacacacacagctgaaccttccagtgagactgcaggaatgatcaccagtttaactccagcctcacaagagatactgagccacaggcacccagctaagtttttctgggattcctgacccataaaaactgaaataacatgtttcttattcatagctgcctaatttggggataatttgttatacaggaacagatagctaaataaccacctaaaatatagaaaagaatagttttctccgtccttccctccctctcttcctccctccctccctccctcctttccttccttccttccttcccaccctccctccctccctccctcctccctttctttctttttgccaaaaaagcaaaaccaacaaacaaactaaaatctagacagtctttcttttaaaagcaaagaaaggctgggagcggtggatcatgcctgtaatcccagcacttttggaggcagaggtgggtgaatcacaaggtcaggaattggagaccagcctggccagtgtggtgaaacctcgtctctactaaaaatacaaaaattagccagtgtggtggcgggtgcctgtagtcccagccactcaggagcctgaggcaggagaattgcttgaacccaggaggcagaggtggcggtgagctgagattgccccactgtactccagcctgagcaacaaagcaagactccatctcaaacaaacaaacagacaaacaaaaacaaagaaacttcccagcactttgggaggctgaggagggtagatcacctgaggtcaggagttcaagaccagcctggtcaacatggtgaaatcctgtctctactaaaaatacaaaaatcagctgggcatggtggtgcacgcctatggtcccagctactcaggaggctgaagcaggataatcgcttgaacctgggaggcagaggttgcagtgagccgagatcatgccactgcactgcagcttggacaacagagtgagacttggtctcataagtaactaaataaataagcaaagaaactgtgcaaagagaggtaaggctctttctgtggatgttctctatttgggcattagtttgtctgctatatgcctgctacttccaaagaaaagcctgtagctctccatactctgtttattctcaacctgacaagcagtccagactggtgctaaagaacagaagatacacatcgagatccctttggaggtaggttgttgagggaaagagataaggtttgatagaattaaaactgtgactgggaatttaaaatgatgatataataaaggcaagagattcaatacaagaaaaaataagtatgttgagtagctcatggaaaaacaaaactatagaaaacaaatatgattcaaatataacgcaaaataaaatgtcctgatttctgagcaactgataagtgcaagggaatccacttgaccttgatcctagaggtggaaaaattctcctttgagtagtccaggtaatatgatatttaactcataaaaaaagaaaggtaatcttaacatataactgagattagtattggataatatttacacagtaatggtaatctaaatggtcttcattgttttccactttagaatcctcataatccaaataaaatatgggagatttagttgtggttggttgtcagacagaatgttaaagttaacatccctggaaataaaatgagatcatgagatgaggaaaagaagagggaagctagaggaatggggaggagcataaaaaatatctttagcttactaatgtggatacttaagagataagagatattcttgtaaattaatggaacaagaaattagatgcaactatattacttaaagcaacaaaatttatatataatttacatatagttttatctaatatatatcaagtattatatatataatattttatacacatacagacataattcacaggagagaaaaaagcaaaagaaaggattaaagcctgagctaatcctcaattttcatatccaggattgtataagtattgtataaaaggaataaataaacaaatggaacataagcatattatttggagatatggagctaattaccaaaaagaattattaaaagacatttactctggggaataagactgggagtgatgaggggataaatgtggtatcgttgcttttttatataccatcttctaaactatattgatttgtttttatgtgcttgctttatattaatgaaaacaatgtatcaattattcccacttacatatgtacaacaaagcaaaaaagtgaattctgggagtaatctgttactagtttcaggaatagttttaaaaaggaaggtataactggtatttgcaatttgagttatcatccatttaaatatattgtattttctttttttttctatttccttttgctttttttaaattacactttaagttttagggtacatgtgcacaatgtgcaggtttgttacatatgtaaacatgtgccatgttggtgtgctgcacccattaactcgtcatttacattaggtatatctcctaatgctatccctcctccctcctgtattgataggacgtatctcaaaataataacagctatctatgacaaacccacagccaatattaatatattttattttcaaataagccacatagcaagaataaattcctttgacatttcctaggctttatcaagatctgtctgttgtgaggaattcattccactacccaaacttcatttaagtctttgcatccaattagtgttatcccaacatgtccctctaatctcttcttttgcttctctagttctttgtacttcattcccatttttatttgcctataaaaaaatcatagtttttacatgcttaaactctgcaatgagtgtcttttaaaaatgttatacattttccctatttcgatctggttttctagatgtctaaatatcaaccttatgcacagcttgtcttgtagccctgtcaagagtcactggtgcaaactggttctgtaatcattaggcttcctagagattttcgcctgtttcttccactccccctaactggctgaagacatcaaaaaatcagacaaactgaaaatgtgaattctcgactctttgaaatgggcaagctacttgcaaaattgtgaagtaagttttagctatttgtctgtggctcaccacagacagcaaggaaaaggtaaactcctatgaagacaataagagatgatttcctgtagagaatttaaaaacaataacaaaggtgactgaaagtcagactgctttttattattagagtgtgtcaacaagtctaaacaatgtcagtgataaaatattcctcttgagaggggaccattaacaatgcccctcctccaccttggtacggcactataacccaaaatgatgagactctagtaaacctctggaacagggttttacacatgttaatctgtaacctggtaggcaaaattatgccactttgggcccgtctcttttccttttagggacaactactggtgcctccttcctagtcttatgagaagaatgtcagtagcataaattgaaatgggaattttgcttcctgcatatcgcatccacccctttttcttaaataaatatgcacatgctttttaaaaaaccaaacaactgtaatttcaaaatgtctttatactgcataagaaggaagttaattcttttaacatcttgttatatataccatctttattctctgcaaatattgattaatctaggaaaattcaggactgatacggtttggctgtgtccccacccaaatctcatcttgaattgtagttcccataatccccatgtgccacgggagggacccagtgggaggtaactgaatcagggaggtggtttcccccatgctattctcatgatggtaagttctcatgagataaggggcttcccccttctctcattattctcctttctgccaccatgtgaagaagcatgtgtttgcttcctcttctgccatgattgtaagtttcctgaggcctccccagccctgcagaactgtgagccaattaaacctctttccttataaattatccagtcttgggcctgtccttatagcagcgtgggaatggactaatacaaggactgagcaatacacaacatttatcttagcatcattttatgcattctgtgttcattatttattcaaaaaccacttactaagtgtcctttttgtatcaaacactgcattaggtgctgagcatacacacattaagacaaaggtcttgactttaagatgcttgtcaaaaaaaaaacttaaggttataatctctaacaggtagatcattatctatctatctatttaaatgaatctctattcatctatcttttccaaagtgctatgaaaacaggaaacaggttctgcttggggttgttcaggaaatcataaagtgaaatgcaaagtctaaaatcttcctgtgccattaacactaacaaagctttagtatttttcaaatggagaagtgtatcattaactagatcacaggtacagtcgcaaaacaagaaaaggaggaaataggaacactgctggcagatgagtcagtatatcagaaagtgggaagttgcattttgagtttaggcaatgtgaacagtttactaatagcataccaaatacaaatttcagactagattctttatacatgtgtttttttacttttctgaatcaaattcccaaacaatgtagaatgcaaagttatataagataattgacaaagttacataagataattgagccattaaataaaaatggaaaactccagtcacaaaaatgtctgaaactacagtgaaaattctctctttggacagtggaaagccctcagttcagaacagaacaagttgggcacttaactttcctgcagtgtcttatcttctatcttgtattagattgccatgtagaccctgtcaagaaacattaccaactgctagttaatgctgtgcacggaaaagtcagacttggtaatgtcaccacagaatttgaaaggatattaatgggtccttttcatttctgaaaaaatagagattagaaccagagaacttcccttcaaggacaatttcttttggaagaaacttatattccctttggatccatgaacacaagtacctacatcattttctagctgtggactcactctttcaaaacatactcagggacagctgatgcaaaggtaagcttggaggtgtagaaaatataaaaatcagtttttctcaagtgtgttccagggccaaatttttactgctgaattttaaatgctggtctatgtttaaggaagatcttataacagctagcatagcatggcacaacacatagagactcctcacttggttcattctccaatattttggggaatctatagttgaatatatttgttacttggtcctggagtaatgtgggccaaatggagaatcatttctcttatttgagatttgggtcatcatgtgtgaatctgtagtgtctagaataaggcctagcatatggaaggaagaatgaaaaaaaagggagaaagaagagaagaaaaaaggcaatagcacagtggggatgaggatactaaggaagaacaaatgagcacctgctatgtgccagatgctatgccatgagctttatttgtgcaagtttatttgatactctcaaagaatgtggcaaaacaaacatgattttaaagttctcattgttattgcttcatactttactccatgtcgcagttaaacattgaggttcacaattataacagtcttggagttttctcaatagcatataatttattccatgtaaagatgaagataaaaaaatgtagcttcccccatatgcctctagggtactctgtatgtcctgctgaagtagaaaagtcctagaagggagctaagggggccgaggctaccaactactctattaaatctacagacttgatggtaatgtctattttagaagaagctttccgcaaatgcaacttagattttaaagacatcagcaagagaatgtggataattccagagtgagggtagtgtctagcacattgccaacacttaagacgtgaaacacttaagaagcatgtttccccaatatgcttgttattaaaaagagtctaaaatatcttttctcctttaaatttgtctctgagattcaactgtgttagtgatgctgttaataatatactctaaatctgtcatgtacaaaagctttgctattgttgatgtagggcactttataatttatgtatagattcactagtaatctaaggtgtgagaaatggttcttcaaaaaaatcctgaattgctaggtatttatcctcaagaatagcataataatacctagcaaagtgtgctacatatattagttgcacataagattttgcaaatttgtaattctaaatgaaaattttgtggatttacaggcaacatatagcatggtaaaaaaaatacacacgtacatacactgcctattttgttttgttttgttaattaccatttggaatgcttactggataaaccattggttaacacaagtgctatttgtctgcttgagatttcatataaagagaatagtgataacaagaatacagtgaaagctgtttggtaaatgctgaataaaggcagagaaattacctgagccttctcctgaggtcccagcctaatggtgttaatgtattttttattgctggagaacttttcagtgataccaacaacaacaacaacaacaacaacaacaaaactaacataggctctagatgataaaacatgtaagaaattaacatagagatttaaaactaatattgacttagttttttgaacaagcttaatgtttacatatatcatgaaggagaatagcaagtatggttaacacacacatacacttgtatacacaaaattatcttttttgttttgagacagagtgtcactctgttgcccaagctggagtgcagtggcatgatcttggctcactgcaacctccgcctccgcccaggttaagcaatccttctgcctcagcctcccaagtagctgggactacaggcgcgtgccaccatgcccggctaatttttgtacttttccttcctccttcccctcacagacaatgattattatatgtaagagatgaataaatcaacaggtgtaacacaaacataggtatgtattgaaaatcagaagttcacaaagtattacagaacaatttgtagagctgataaaaactaagacaattaaactaggttatattcttgctacttagacaagaactaattatttaataaaaagatattactttgtcctaccactgagactagacattttagaggaagtgccaacttcaccagtcctgagaaaattcccactgaaatcactgtcatgtatcgactaggtacacagacttcattcaatatctccaatgctgatacagaatatatcaaaagagatatcgagaatcatgagcccaatctagtctaactcacagctggaagtacttgaagtttttcattctcaagttgaaaaattagtatataatgaattcttaagctccttaatcaaaatatgttatccaggatagatacagaaatcatatttgcaagattcagtatcacaccatgaattaccttctgtgtgtgacaactggggaacagacacaagaaacttcctgagtgctcagtcaacaataatttgaagttggtgaggaagtaggggaggttgcataaaacagcgcaagttatgggaatccttggacagctcttcgttgtccaggactgtcccagcattgcagtgtgtgtagtcctcatggacctcacgataactctctctttgtgttattacctgccctccactgccgcttgcttcccatacatacatcccttaggggaatggtgctgcctcattcaacagagaattcagcttggtacatgccacacaattgatgtgctgctgaagaaacataaattcacagctactcttcaagggcagagaaaatagctttaaaggtaagaaagatgctttaatttacagtgtgtacctgaagaatgcttctcagacatgactttcagatgtatggtgctcacctgtgacaggtactttgaacatttctttatattttaagatgaacatatgaaatttctattttttatagttaaaaactggtgaagtggccatcatttcatatggttcctatactcttgactcctataatcctcacaataaacttatgaggtaggaaactgaggtctaagtaactcacagctagtacgtggtaaacacaatgctgggatataggtgggcattttggcttctggagtcaacgcccttgaccactatgcatagtgccccaacatcccacacaagctttcagaccttagactcccagaacgcagggcctcatcatctgatcatgttaggtgtccagcatggaaccatatttataggcaatgcctaaatagatactattagaaggagtaatacatgatacaaaactcaacttcactcatgactcaaacacttactgtgtgaccttcgacaaatggttcccatttctgagggctaaacttttcagtctatcacatagaatgtatatggatgcattaaggaagggaacaatatgactgtatttgcattttcaaaaggatagtctgacagttgggtggagatcacaatggaggtggttaagactatgagaaagcaggaggtgatgagattctgaataaaggcaatacgtaagagcagaatatagatcacctcaatgtatcctgaaaaaaagtgggcagcatagccttgggtaagttagcttttctatgcctcaatttcctcctttttgaggaggaataataatatcaagttgtactttttgagtttccatctcttcctcagacatatatatatatgtctgaggaacacacatatatatatgttctgcaggatatgattacacttctgatttaattagcaaaatatttattagaagccagaggaccacagaggccaggtccttctagaggttaggagcaggtaaagtatatcttggtgttgcttttgatcttttctctggcttccagtttcctaagaaagctaatgctgccagtggcactatccatacagggtgcagtccttctgggtctgaagaaatgcctgaagattaatataccaaagttttatgaaattgatacctacatctcgaatactttacgcacatccattcaaaagagatttccatttcatggttcccttccacacacaggcatccccctcttccttcctctgtttttttttcttttttcctgcagcctttgacatcccacactattcgttttcttgtctattgcccatcttctccaactagaacataagttcggtgcagaaaagtctaattttgatcaatgctgtatttctacagactagaaaggtagtagaaaggtacctgagatatagcaagtgctcatcaaacttggttaagtgaatgaatgaatgggtatatgaatatatttatctcggactagctttgtgagaagacatctcaaaaccaagcttgcatctaccaatagagcattttgtcatctagtaaaacctccagaccccaaagaaaatgcaccacgcagaacttaaaaaaaatcctttaaaatgcattactctagtactttttcttgccagtaatgagaggagaaaaacaaagtctgaataactgttgcttacacgcatttaaaattacaatacattacactcttctcaccaggcaccattaagttcaggagaacatgcctttgtatatattttaaaatacacatcaaagtgtttttctttgaaatatgcactaaaatttgctgtaaaaatgtacattaatttaagtgaattcagaagattgattggactagggaaaataaattaattattcatgtcaccagtattttttaaatgcacagtggttatcaggaacatatataattataagtaatgctattattttttaatagcaaagttacagctaaggttaattaatatttttaataaaaataaaattttgttctttgaagttgcaaaatgtattttgttagctctaaatatttttcaaggaaatgtgtgtgaattctgcttacatttttcaaacaaataatattcatttttcatgagtacctccaaagcctccaagcaagcaacagaagtgtccaatatattcaaacattcttttcttgcataaacattaattgggttctttttcagaaaacccaactgggaatcaaatgctactgactttaataggatgtctcatatgtgaaatgaatgtctcttacaatctaccaatgatatttcttgaactctcaatagttcctttccttgagtaggtttgctaactctaccctgaaaaaatgcctaactgaaaccatggaactgctccaatacatttcactcatatttactgattctgtctcactttataatttaatttcttcccaagagttgcaaactatagtcaaaaaccagaatctctcaaaattttattctctctcttttctcaacattgttgaaataagataaaaagaaaataaaaaaggttatggattctaaaaaccaggcaaggataccacagacaaattttgctctgaatataaagaacaggacataatatgtattattcttatgaagtatgcttttcttgcaaaggtaaattttggatatgctgtaaaagtagagtataatataatttatagaccaaatggcatacttttgagagtcaaaaatatactattaataattacactgaacatcaggtatgcacaggtactatccaggccaactgggctgcatggccacatgatggaagacagaggtgaaatctatgttttggtaaataatcatgagaagacctaattaagagcatcatcactagaatcaaagaaatcttagagctgagtacaacttaagagtttcctagttcaacctacttattttacagaggcagcaaggccaaagtacaatgatgtgacccaagttgtccaagtcacatgacgagataggtggttgtgttgaaagtggaaaccaggtctcctcattcatcatgctctttccattatactacaatctctctacagtatgtatgtattctctatagtatgtatgtagcttgtaaaatattctcgaaggaaagaacaaaaagatcgtaaaatgtgctataaagaacattccagaaacgatgtcacaagcttgatcgtaaaagaaacagcacagttcaattttcctttctttgtggacaggcaaaggaaggaagtgttgtcctcttcatgttggcttacatgtactcatctcataagacattgcaagtttaattagaagagggggaacatttagcagccaaaaaacttgcatgatactcctgccacatgccaagaagctctcagaatctcaaagaactttataccaccaatagtttttgtgaatatttgctttctgagattagccttctggaaagtttcataaaatcaggaggccttatggaaacatttaaaaattaaatattccaagtaaaatgaattttataaattttataaattttatgtaatccacataaaaagtactatcaatattgttatattcacattaaaaaggaacaattcgatcagaagttttggtaaatgtccctattatttcttgatataaatcacatcttcctaaagtaaacattgggctgaaaattgattatcattcaaagcaaaacttcttttttttttttttacttttaaaaggatatttactttaagtaggaatataaacaggactttatggaggatattttgatgaacactactatattctctgagtctgtgaaaactgaaatacatttcttccctattactatccctgcaggatggctgaacaaacctcatctcatctatttgaaatgagtccaatttaattctgcctgaccaaaaatctgtttccatagttttaaaacatgcaatcaccccaaggtacattgccattgtagcttaagtggctcagtgttatcactgagaaaaatgcactttgattgagaaaacagtccagtgtggcttttgaaaaatgaaatgaccctttctgatacacaatttagtaagacagttgataaaagcaggcggatatggccactatagacaacatttaaaggaagatgcttcatccaacctgtaaaaataggtcaaagtttacagtttcgaaattaacattagaaatttatctcatatttaaacttcctggtttaaatattactgtatttagaggacaattgaaaagtcaattacgaattatggaaaattttcaacaaattattctgtcactcaaatataaataaattgctttcttccctaatgttttttccccatacatacatgtgttgttatctgtattcatatatatatctcactacttaagagacttttaaaacctattagcccaactttaaaatactgttgctactactgaatacttgtaacatattaagtcaaattctttaattactgtcactggtttattacaaagctaacaattttaaatatctatttttaaatgaacctaataatcttttatttaagtcaatatctcctcaaatgaaccaagtattcactaattaattagatcatttacatctataaactgctgctgtcttcaaacatgtaatagcttataataaaagaggctcttttcattggcaattaaggagcagttaactctttaccttctgcattttaatattataaaatgcataaatctttatttctgcatttctacgtatttagctttcaaatgaaacagctgttttgtacttaaaaataatatttcttaatatatgttactaattgacaaaatacataaaaccaatgctgataatattttcttcttttgggacacacctggtttatataggagatttggcaactgtaatctcattaatgataaaacaagactactaagaaaaatacctgattatttcaaattatattcataaaagcattcctaactctgaatgtcctcttgtgaattattttagataaaggaaagtctatcaatttatttgtttcatttttcctgtatcagatttactgtaataacttgcttatcagtaagtgaaccataaatctacagcagtaacaaatcattaatgaaacattagcaaagaatgttaaatggagctattgggcaaacataaatctttctaaagtcacaagtctttatccaaggaactaagtgctatgatgttattggcaaccttataaatcctaacgagagaaaatcaacaaaaggatcacattgcaggcaaacagtcctactaaaatgtatattctttgagggcaggggtttcgtttgctgttaccaatatatcctcatgcctagaaaagtatctggcacatgtagacagtgatcaataaatatatatttgtgaacaccctataagacatcccattttattttgtagccacatgcaaataggaaacgaaaagaaaagagagaaaaatgaaaataagtgcacatgtaggtacaatatatccaacactacatttaatttgcattttttgtattttttgcccatccctcttctaggacattttctcttcatctattctgttcctctcacccttttccattcaaagtaaaaatcagagtcaattttcttcattttctgggaaacatgttaattcatatttggggtgctgatacaaacagaatttgccttctattattttccttccaaactggatgcaggtctgtttcaaatgcaagaagtaaaagcaaatttaaatataattatcattcttgcttcttcagaatgcatttttctggaaaagtagggatcgtgtatttggaaaagctttaaatggcacctactgaatatactcactatcagtaaaacagaacaaaacgaaacaattaattttggaccaaggataatacacaattctgaaaaaattaacaactggatacatacaaaggctgcaaataccaacaggaatctaatggcatttgaacagcatctaacagcatttcgaataaggtttttttttccctgtgttcttcactgatggaacaccaatattcaaaccagtgcctgaaatgtagtaggcaatcaataattatgtcctgattgaattaacatacttccaagttgtgcaaatgccacatttaaaaatcatattcttcaaaaattttaggcacaagattgaaataagctaattagagttaattgtaggtgagggcaattaatcacatacacaaaatacctcatattttgggtttgtgtgctcagataaaccaatagaatgtttttttatttttaaataaatagtgaaagagtatacccatcattcaccaagaaagccacatggctggctatcaattcaaaactttaaacttcaaaatactatagaagtattgtactattaaaatatctcttttaagattaaatttgccttgattttattttgaagtgctgagcttaaacagacaaggttttcaaatatttcattaacttgttcatttaaactaaaaagtgaaaatcctatgtaattagcagacgatctactcagcttgggccagaggagggttatggaatcaagactatcatttagcatctaacaaaccaaaacaaaatcttttgtaaaagtccacaaacctctaatgaacaacatacacacatttcatattcaaacggaatgcattatgttaagctagtttcaaaggaagctgtagtgcctaagatcagaaaaatgttccaatttagaaaagacgcatatgcagaaaagcccactatcataaataatataggatgaaaatgaaggaataaaatccacaggctcacctggctaatgggttcttttgtcgggggctttcctcttctggctgtgctagtagccagggtcgtggtagtctccataattgatgtggacatctctgattgcatggcagtggctgttgactcagttgtcatagaggaaggcacttcaccaaccagtctcacatttcccactatggcgatgttggcatcgttttcggctgccatattcagaactttcaagccattgtagtacagcccagagagctggccctggaagggctggccctgctctttcccgccaattattatggttgcttggctattgaagattgtgagctgacgccctgtaaaaataatattacatacatgcaaaaatgttgattgtgaactctatatctacaatggatgataaaacagatcttttatggggtgaataatgagagcaataaactataagagaggcatttgactcataattcattgcttataaatgaggtgtccatgaaatgcataattattggcaaatacttgtaaattctcaacttattataaatgtagtgcttttgctaaaagaccaatcaaagatatgtattacaaatcagtttttagtggatcccttttcccttttacatcaagatcttatattgttggtgtctaaagtctaaattgttaaattttaaaaatgtaagacaacatttcaagtatttgtcattctgaaattaccactgacagaaactaatacatagcagctgaaatctaatttaaattttatggtaaaaatttcataattcacataatgtccacatatatctatatgttattctttagtgctgtttattttttgaaggcaattattcattgttatttgaattattctatttttccggcaatcacactgaaaagaaattcatggtttacactgagcatgtcagagacaaaaaaattccaaaaatatttttctgattggctttcagcaagtctatcaaaacaaaacaaaatgaaaaaaaaaaatagcttcagatgtaaaaagcggcttcaggaatgatacacaaaccgatggagaaattatggcacatttccatcaaacagcaatccttaataacagtaccattatcatcaaattgagtatccagttttagcagattgctctctgctcataaaagcatgcacacaactttaagttcagttttaatatgggcttgttcccaaatcctcttagaaggttgcaaatgttaaagggacttcattatgactggcaattcatattgcccactatttaagattcctagagtttaaacaaagagtttttgtttttttcaggaccataataaagatatcagaactacatatattttagttaataatttagaggctggaacatgtaatatagtctatgaatgatttatcattttgggttaatgcttgctgtgagtaccctcatagattgagttagtggattatatttaacagtccctttaaccttaagttaactgggtaagattattaaacagctggtacgtctaaaaatgtatagaaattattatacaaggtatgcaaatattactatctacattttactgttttaaagttgtttttaatttagttttacggaaaatttattttttatgtttattagtgttacaatgaagtactacttggttatgttcaaattatttttttatttgaagttttaatcaatgttttttacctttgtcgagtagccattcatcaactactcgaccaagtcgatatggaattcgctgtctagcaatcgccaggcgctcgttatcattgtttcctttaaagtttaaagagacatttcattggttaaaatctgtaaggtcaaaggttaaaagttaatacttaaagattgagctatacagttgccacatgattttttgaaatttggaattttaaaaagttctacctagaacatttcatgtttcagacttgtcattcattcatttattttattttagcaaacaaaattattcctatgttaattgaaaattagaaatctgcatttgagctaggttattaaacttatgttatagacagacccgaacaaccaatttaaacagcatataatagctttacaaaaaatgaccaatgacctcagggttttgtctttttgatgtttcttattaactagttaaacatgttcaggtgaaacaggtttaagttttcaaaatacattcaacctcttattccagattaataatttatgatcaccaaacttaataccatatttggcacactgaagcatctacaataggcctagcatactttatttcctagtcagaaaacagaaattcttattcacctcatttaagaaaacaacaaagtccaaatagttcttgtgtatttcacacaaattgatttatcaatcacttggacatcacaagagaatgcatcttgcatcatccagatacgttattacaggaaaaggctttgacaaaagtcactttatttgagtgtccttgagtttcatttaaagcttaacatgttgaagcaaataacatttgaaaaaataattatatgtatgtttttatatagtcaaatatctgctttttattaagttattctttaaaagcatgacagcttaaggaacgaatataagccacaaacagtggcccctattcatagatctaacctaagtgagagccctgcttctttgcataaaaaattatctgctagaaacactgtttaaattgaccttgaatattgcttgcaaatagatgagtgttttcttgatctgtagagcacttacgaagaatctgagacaccatctcggtgttgagttgtgtataatgcaagaagagattttctattccattagagttaactaacatggaaatttaagccaagacattttggcattagctcagatgaggactcagaggtgaaagaaatgttgaatggtagcactatctgcataaaaagactggagtgttttgttagagaagataaatgaatagatttacattttattcctctgatttacaataatttataagtgctttcttttgctactcttataatacattatacttaccactaataagcccagcataatactgattacacacttttggagagatagaaaagaactatcttttagacctcatcaatttgtcatctgaatgtctatatgactgaaaatatttcacacattaatatttaatttaaaatgtaaatatcaaagtcaaggcaaatataaagtttaatgaaaacattaatatgtatttctctgtattctgtgatcactaaaacattgtaaaataatattttataatgtgggaatatagttttgttaaactaataatttttttaaaaggacacaaatggtacaaaattccaaccctgtcttcattttttaaaagtgtacaaaatttgtgttctctgttgtgtgtttgcatatatgcatatttggaatttttttttaatgtaatattagttactttaggacagtgtgattattgatcaattacatgtttttggcttataagtgattttatataataagcatgtttgacatgtgtaatttgaaaagcaatcacaaaatattttcaaaaatacataccctttgctctatagtcttatttgtcactcaatactcataccaactcacattggcataacacttctgacaactttatgattaggtggttcctcatgtttttcatgctagagtcttccaatcatcaggcatgacccacattctctcagacaccatccgaatctaggtcgcaaatccctcttgcccaattactactacagtctattgacagacctctctacatcttctctgtgattaatcacacccattttccatataagccaatatctaatcatgtcacttgtctagtataacccttcccatttctcttaggataaaatctcagacccttagtgaaatttgtaagtacttccacaatctggtcccttcctacctccctgtcccctctcacggccatcactgcctcactctgctctttttatccttatgagacttctttcaattcttccaaatcttttctttcttctctctgggactttgcacatgtagcttcctttatggaaaatactctcccttgttcccacctcatctctatctttcattagctaaccattactaattaatggaatcttcttggtaggaacattgcttccccagaaggtattccctgatgtcatcaggttacattaggacacttgactatattatttgtagctcctgaaacatgccctttagaaagaagcattgaacctgtaatggcaaatttgatagtttgccttcaaactctgaatatccctccatgaggccaagtactatgctactatgtgcagtatttattatttcttcagtgcttacttgcacaatatctatcacatacaatcctattaatatctgtagaatgaggtagtcaagaaaaccttgtttttagttctggtagcttctgttgcactattaacacattcttacaacctaacaacattaaaaagaaaaagaaagcaaatactagtgtccagagaataaaccacttgtagctaagcctccctttgcactttccaaaggaaacaccataaacctcacttataattttattttttgatgaattgtcactgatttgaacatctctacaatcagttcattatttgtttaataataaattccccatgtcacaaaattggtaaacatagttattattagtagggaaaggttggggaaaaaaaggtctaaacaagacaggtagagaaaaatcaaagctttatagattattttaatgacttttaaaaagatcacataaacacataaatacattcacacatacatacatagaatttgtcctcaaacatttgactagtactaataaaataattgtgtgattgatatagtatgacagtatgatgtaagtcaacagaagctttggagatccttgctgagactcagctaaagcaagaacataaacactgaattcccaatgattaacagaggtcacctaacaacaacaataaaacaatttagaaaatcgaataggcagtagacacaagttatgaaaatatgtgataatatataagaaaggtagccacacaagggggtcatatcttcctactaccccagaatatcagatgcctactaattcagtgagcactgttttaaactgaagaactttttaattacaggacagactttattcttgtatgggtaatgaatggaaaatcagatggtgcttattcaattcaatatatacctactttattctctaaattctttgttctcctactagaataaaaaactaatgactttgttctcctattagaataaaaaactaatgacttttctgctgcaaaattatatgcagatacattgtgatatggtttagctgtgtctccacccaaatctcatcttggattgtcgctcccataatccctacaagtggcaggagggacccagtgggatgtaattgaattatgggggtgggtttttcccatgctgttctcatgagagtaaataagtctcacaagacctgatggttttataaatggcagttcccctgcagatggtctcttgcctgtcaccaagtaagacatgactttgctcctccttcaccttctgccatgattgtgaggcctcccaaccatgtggaattgtgagtccattaaacctgtttttctttataaattacccagtcttgggtatttcttcacagcagtatgaaaatagactaatatagtaaattagtactggtaaagtggagtactgttattaagatacctgaaaatgtggaattgactttggaactgggtaacaggcagaggatgtaacagtttggagagctcagacaaagacaggaagatgtgggataatttggagcttcctagagacttgttgaatgatgttgaccaaaaagtctaggctgaggtggtctcagatggagatgaggaacttattgggaactggagcaaaggaaattattgctatgttttagcaaagagactggcagcattttatgcctgctctacagatctgtggaacattgaacttgagagagatgatttagagtatctggtgaaagaaacttctaagcagcaaagtgttcaagacgtgacttgtgtgctcttaaaagcattcagttttattcatttataaagatacagtttggaattggaacttatgtttaaaatggaagcagagcataaaagttcagaaaattttcagcctgacaatgcaatagaaaagaaaaacccttgtcctgaggagaaattcaagccagctgaagaaatttgcataggtaatgaggacccaaaggttaactgccaggacaacgaggaaaatgtctccagagcatgtcagacatcttcacaacagcacttcctatcacaagccaggaggcctaggaggaaaaaatgtttttgtgggctgagccctgggtcttgctgtttgtgcagtctcaggactcaggtgtcttgcatcctagctgtggctaaaaggggcaaatgtacagctcaggtcgttgcttcagagggtgcaagccccaaaccttggtggcttacatgtagtgttgagcccgtgggtgcaaagaagtcaagtattgaggtttggaaacctctacctagatttcagaggatgtatgaaaacacctgaatgtccaggcagaggtgtgctgcagggacagaaccctcatggagaacttctgctagggcagtgcagaaagaaaatgtgagtgggagcccccacacagagtctccactggggcactacctagtggagctgtgagaagagggccactgtcctccagacaccagaatggtagatccactgacagcttccaccatgcacctggaaaagccacagacacttaacatcagcccatgaaagcagccaggagggaagcggctgtaccctgcaaagccacagaggcagagctgcccaagaccatgggaaccttcctcttacatcagcatgacctggatgtaaaacatggagtcaaaggagatcattttggagctttaagatttgactgccccactgtatttcagatttgcatggggcctgtagacccttcgttttggccaatttctcccatttggaacagatatatttacccaatgcctgcacccccacggaatctaggaagtacccaccttgcttttgattttataggctcataggcagaaaggatttgccttgtctcagatgagactttggactgtggacttttgagttaatgctgaaatgagttaagactttggggaactgctgggaaggcataattgattttgaaatgtgagggcatgagatttgggaggggccagggatatggtttggctgtgtccccacccaaatctcatcttgaattctagctcccataatccccatgtgtcatgggagacacccagtgggaggtaattgaatcatggggacaggtttttctcatggtgttctcatatagtgaataagtgtcatgagacctcatggttttataaaggcagttcccctgcacatgctctcttgcctgccaccatgtaagacatgcctttgctcctccttcgtctttctgacatgaatgtgaggcctccccagccatatgtaactgtgaatgcattaaacctctttttctttataaatcacccagtctctagtatttcttcaaagcagtatgaaaatggaaacattgtgaagacacatctaaataaagtacagcgacaatgtctttttaatagatgattccccaaatccttccaccattaggtataaaatagttcagaatgtttaggttctccagcgactaggcctatatttttcctttacctcatgattttcataaaaatgttgcatactaaaaggggtaatggaagtatattattttaaataatttctcaagatgtattttatttctttacaaattcatggtgatatttacttgtaaaatatcattcagtagctttgcatgattttgctgattatatttaatactgtccattgttcaatatacatctagaccttacatgcaatataaaggatataaaccatttgattgggaaaggtcaaaggcaaaaataatttccaatgaccttttcttttctttggaaaggttcaggatctaatatcaaatatgctgggatatagaagctttacatacagcatttgtgaatggtcagtgtaagcaggcttaagctggtaggtgagatgaaaaacaagtggaatgtccctgaaaattcaaatcaaaacaaagttgaatctttcgaagaagacatttttaccttcaagtattctaaatcagaggtaaggataaagcaataaatgacccacttttcaaagatctatacattccgggctataaaaagggtccaaaaggaatttcatctctttctaaaagcataaaactctactatagcaacatgctgagcaaataggcttgatttataaaagcagagccttctcattgaatagttaaaagataacaatttagtctcacacttttcccatgataaaagcaagataggattttcctttgatttctttttcctccagttaattttgtgtggtttgatctgttggtaccttcactgaaaatgtcagtgacaacatacatgcctctgccgaagtaattttcaagcaatgaaactgcatgtaaaatttggttttattttcctttgaatttcaaaaagaattaagtatttttgacaggaggaaagactcccttccccccaatccctgtagtaatgccattgcaacaaggtacaatctctaattgtaaggtattaaatgtcattgtaaggtattaaatatcattaatacttcaaacaagtttcctggggtgaagaattcaaaggaaaatctgatggcttatatttggaatgtataccctctattttgattaaatcccagataattttatttgcctatttgtatagactgaatgtttgtatctcccaaaattgatctattgaaaactaattccaaatatgatagtgtcaggaggtaaagcctttgggagctgattaggtcatgaggaaagagctctcattaatgggattagtgcccttataaaagaggctccagaaaactcccttccctccttctgtgatacgaggatacaatgaaaagatggtcacctgtgaagaatgaagcaagccctcactagaaatggaatcttgtacttcctagtcttccgaattgaaagaaataaacttttattgtttttaagccactcagttaataatattttattatcattgcccaaatggacaaaaataccatgtaacaatatttggtcacattttagtctatttattctatatgaacaagcagacttccgggaaatgagagtaattacaaagaatcaaggtaagtagcacaaagcaataaaactcaaatccttgacttggagttaaatttcatggtgtgactcagagaacaaagataaatacaattttaatcatattgttataactatcgatcagtagagacaagctatatgaacatcactgatgtatagtttttctcctttcattttagttcttcactcttgtgtaatttctcctcagaaataaaagtgtcagcatttgatatgacatattaatatctatggggaaaaagtaaagaaaaacaatgctatgaaccaaacatttgtgcagaataatatgaaaataaaaataacaagaacaaaaagagacttgcttctttggaaggcttcttatttcttgagtttttaacattgggaaaagaaacacaaaaggattctgaaagtcatctataccacaagagaagattagtaacctgtgtacagactgatttttaaatgagaacaagacatttggatatatctaggcccagaaggcaaagtaatagttttgtaaacatactctgattttaagtgcagcataatcacataattttcaactgaatgcaatgtgtattgttgtcatatagaccctgcaaataccataatgcctcacttggctgataatgttccaaataaatagattttgaatatcgacaccttttgagaaacaaacttttgaaaaatatagctattctaataaaacatttgtcttatatattactttatttcctatatcattaaaatgtaaaagccgaatacacatatataattggctccagcttactccagtttcatcttgaactacttttctctgactctttaaattagtcactttgtaattttttcaattcctttagctaagccaatccactttgaacccgacattctcctttgcattgcgaatttcttgcatccctgtgtactcaacatctctgcccacctcaacagacacacacacacacacacacacacacacacacacacacacatctaaggctggctaaattttttcttttttaaatatcagcttatacatttctcaaggaagcattccctgtgtcccctactgctccaccaaattattctacttaatgaattcttccactatgcattcttaaaatacttagtagcaatatctataatcatgatcaaagaagttcatgtaattgattctagattctagattccttgtgagcaggaaccatgtctgtcttgttcaatgctgtacgccttatgtataacacaatggtgagcacatggtaattgcttgttaagtaatttctaaatgaaaactgaacccatacagttatgcaaaaaataccacttgaggtaattttttgcatgataacatagtggtatttcttgttcaagatccataaggcagtgagattgttagtgtccacttacatatatgtatatatagtcacaaacaccattggattgtgagaggaatagaactttgcaaaacgttatagtaaattttgcttggacgtcagatttccttttttcttcttgaccatttagtgtccactaattacatatgtgtgcatgtctatttagtttattcagtttaccagacactaaactaaatagagataaaatatgtgtctctatatataatatatataattactgattcattatatatataaaatgactcagtaactctgcttatctttcatcaattttgaatttgccattgtagtacacaataggacaaatcttttaaatcttatttttatgattaattacaagtcaatgatttatagtctgaggtgagctctactgtggtgcatacacattagcagaaaaattaataccacgtgggatcttctttttttttttctaattgtgtagagagctgatcatgacaatctttgatttggtcagggggaaatttctgcaagtgcttcaattctctaatgactgtgtacaagaaacagtcttggacttgatgaaccttcaaaatatgtatcatctccaagactatattttctagatgaattttagtggtgaattctttcaaataaattgaaatgttgatactctggtttctcttcacatcgtattaatcttttactaaattgaatcttttactaaactgaaatgttaaccctccaaggagcatttacttccaaagttcatcaataaatacatcaatgccttgtaaagaaagcaacattcatttaaccaaggcaaaaatgatacaaagttgaagcttataaagtcaggtagtagaagttatggatcttctagcctttgtaacatgagggcagagggcttctagaatttgcctgatttgtggctgataaagagcagcgaggggcttggattgtcttctggacttttaagacctcactgaatgatgaacacacactaccagaatcaaaggatggtttttgtcagacagcaggactagaccagacagtaaagctacaattaagtttcatgcatgctgggaaatccagtttttccgtatgaaagtggtctgtaggtaaagaaactgaagaaaacaaaggaccaccagaaaataagaaaataatgtattgagtagcttcatgttttatgcattgtgttacttgcttatttaggttatcttgtttaatgctgatattgatcccagaccataagtaccttttattttactgatggaaaaactgaggctcaaagagatgacataaaactaatgctgcatcatacatcatagaaagagggaccatttgaatcaagataaagctgactcgaaagttgttccatggaatagttataaagtaatatctcttaataccgtgagtcataagggccaacatcttctccttaatccttatagcactcttttgtataatgtaagatgtcattaaggcttgtctacaaagtttctgtcttctagattctggggtgagatcgcccttatggacacatgaaatcagtaatcttccctaaatcctcaacgatttatcaggaggataattttatcatctccattttatagattaagacagtgaagcagaggtaagtaaagtgatcaaagacctataacagtggagatcccagtgagaagcagtattttgttttttttccttttataatgatgccttgtatgcatagctactggaggcataaaatgttccagacattccttgtctttacctctaacctataagaaaagccacaagcataataatccactaacttcagtgctttttggacgttgaacctctccagaaacacgttggaaatggagagaggatcctagttgtgacacaaaagaccactgtacttcattgacttgtcagagaaaaagaatattgtaacatgttacagtaaattttgcttggacgtcacatttcctcttttccttcttgcctatttcttatctctgcgtttccttttacacagctccagaaacccagtgctttcatgccacctgtcaacaactcaaggcgtatatttacaactgcggttcctacacatatctcatgttccaaaaatacttcaccttccttcttctctagtgccaataattaaaccctggtttctttagtatagctcggctagatgttagaaaagcaatcggactcaataaagtcaatatataagcagtgcccatgtactctgaaattattgtactctgaaaggcacacatcaatacatcacatggattctattgttgaagagcttacacgttgtctagggagtcaaggggacaaatgaggaaagttaaaaaataaaagatttaagtaaaagttcaagataatagataatgagacataagtacgcaattaaccaccatgtgaagtgtagttgccatagaagttcagagagaacaatggattagagcaaagaaggtgtgatggaacacaaacgattgcacctagatcacaatcaaaatgtcattgaaataataatgagctaaaaatttttcataatgtgaatattaatcctcaaaaggttgacaattgatcattatcctgaacttcataatgctattcacccaacatctatttttaaataaatagactctccaataaaacatatttagtctcaaaatataattacaagtatgaccaataatggttaaatattcatgtcacgaaccatgaaaaaaaagaaaaaactctcataaaactactaagtaaaatgcactgaaaatcggcaagaatttgagggcaatgtgtaaaagtgaaatatttgtgttaggatggagaaattaatggtgaccttttttcaaacttcaattttatattattgatactgcatgtatgcacatttcaactttgttcccactgcttccttaaacacatacacacacgctcatttctctaaattaaatgcgatatattaatgtaatgctacaggaagagggggtggtgcaactcaagagttctgtcagtcattctcacagctagaaagagcacgcacagctcaagtagggtgatgcgctgttcgtgactaatgcttcagatgacatcccagctccttatgtgaaacagcaggcttttatatccagttaaacaatatattcatgtgagactgctgtgatgttgggcgtagaaggctgcaggctgtctactgcagagttcaatggtgctttggggaagaaattagaatcttagtgcatgtctaactagcttaagtaatttcttccttcacatccctctcttatgtggatttacattaagatatctaagtgttttacacaaagatttgtacaagcacttgttcccactagctacttacattcaaaaattttggtttggatattgtttcatcagattaatttgaaataaatacaggtaaccttgtgaattttggatctcattgcctgtgtggaatgaacagtgatttaaattttcttccctacacctttaaatgctgtttgtttcccattgcaaaggcactggagtatcatatcaaaaaccagcagcaagaaatgaaaagcagcagggacaagcaggtaacaaaatacagaacttactctgataaattaaaggtcatactctgttatcatgcatactaaagagttattttgtgccagttgtgtagcatttaagacagaagaatggtttaacagctacaaaaacaggcagagccattgatagacatcactaaatactgagaataagaaaaatgaaaagtaagagcagccccacattaccttacaaatggcattttgccattttcccagatatgagaatcttgagtactttctaaatcataatgtcataacatttaaacctatccgctctaataaaaacctaaatatatattttttctaaagtgtcttttcccagttcttgttttttgaaaattggaaaattatgtggttcagctgaaatttctacactccattatcagtcttgacttttaatctagtcttcttaatattcaaattggtccacggaaaaaaagataggtgaatgtttcatacacagtctgatgtggcctataaatggaactgcgaaagttccctattctcaagtggaaaagaaaagtctgattattatgacattctgatcttattttcaatggacttcaatctctctcttccagttgtaactggaatgcaagatttttttttcaattagaaagatgaggtttgtccattgtatgcaaataatttaagattaaatggtctggaattgcaaaggaccaagagttggataaaggtgctggataattgctagccccattcaattttataaaatgtaaaaccactgaagtaaaataaccatttttttctttttgtagataaattgaatactatggatatgaatttaaattcctaaaataactttcccctaatacaagttaattttctctaccaccaattatttcttaaaagtaattatcctgtggtcagaatcactgaggaaagagaacccttgatggttaagataatgagctctaattcctaggttcaaatcttggcttcaatattgactagctggatcagtagcataacatcttttaacctcagttttctcatctgtaaaacagatatttgtaagaatagtatccataatatatgccaatctcttagcacaatgcctggcacatggtaagcactcagtaaatattagcccttatattgtagtcatgtcattgtttattctctagtatgatgtgccttacacaatatatctaagaatgtgtacatcacaaaaaatattttttttacccatctgatcatagaaagttgaagtaaatgtgaagaagagtggaaaataaatctattatctttcccagaatgagtaatggccaaagagtgagccttattatgagtgatatcccgaacgtaggtgctttatcaaaatcactgcactttctcccaagcaatgtcatctttattctcagaggtttatgcatgctacttttaagtcaatgggaacaactgaaaagaggtcattagctggaagaaaccacacaaaaagaaaaagccaacagcccctgccctgagggaaaacagaattcagggtactaccatgtgttctgtgacagcagcatggtgacaaaagctgttcccagaataagaatactttggatagcaatgaagtcttaaaatgacattttaatccatatattaatgcttcaaagggatccacttcaactagaatgccttaactcttctttttgcccaataatgctcctggcaaagaagggccacagaaaccatgaacaggagtggatgctgcttgatccattttctgcaaaatgagatttggggactggatggcttctaagctgaccctcaatgctaatggcccatggtcccaggtatcagatggtgttgttgtaaagacaagcattaggccaccttgttaaaacatggtgattgtggattttcatgaggaaattaattttagagccattaaaaataaaataccataaatgttttttaactcagcaaatatcttttaaaaagcagtgaaatatttggcttgacatgttcttttcttcatctctctctgtttttaaaactaacttatggtgccttgacaattttatgaagaatttcagttggcatctgtggagatctttataattaagccattacatttttctgaaacgtttcatgttttaagcttgtcttctttccactttgtgctatacagacacacccacctcttatcactgagacatttctctgcattctttctacccatttaccacagcatgtcatggttttgacagccatcttaagaggaggaaggcagacataggttagatttcaggagattttgggggtttttttttttttttttttttgagacagagtctcgctctgtcacccaggctggagtgcagtggtgcgatcttggctcactgcaagctccacctcccgagttcatgccattctcctgcctcagcctcccgagtagctggaactacaggcacccgccaccacacccacctaattttttgtatttttagtagagacgggttttcaccgtgttagccagggtgatttcgatctcctgaccttgcgatctgcccgccttggcctcccaaagtgctgagattacaggtgtgagccactgcgcctggccgagatttcagttttatacagagtagttaagacaatgaaggacaaggcattatgatactaggaaatagagaagtttgtctcctcttcatttgaaatttttagcactaaagagattagatcagaaaaatttaagaagaaatctgaggacttcaagtcaatggctgctctttgcaagccctttttgtccaaagtgtatcaaaataaaccttttcttggattgctgaaacacctgtgatcatgggatcagtacttttggagctatttctggttcaagagacattctcatgagagttcctttccaatcaaatctgtcaggggctgacttaaaaacctgtaagtgggccagacacggtggctcacgcctgtaatcccagcactttgggaggccgaggcgggcggatcacaaggtcaggagatcgagaccatcccggctaaaacggtgaaaccccgtctctactaaaaatacaaaaaattatccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaacctgtaattggctcagtgtaactcagactaagtagagatcaccaattaaaacccaggcatcctaaataatgcagtaggtacagaggagaaatagttcattgcataaaatatatcagaataaaactataaatttctctacttccttcagtatttcttcttaaacttaagctacctgttatttctagtgatctctaaatgcagaacagaatgaagacaagataaaaactacaaagatatcctatcaaatttgagctgatgctccattactaaggacaattggaattgatgcacacacatgttcttctccatcttttttatagcccaatagatctacagttaggctgtgtcatatacaagaagaagcctgaactaactaggccgtataactctggcctgattaacactttatctaatactttttctgaagtcttttaatctaagtcttgttttgacttcattgaaaataagcagtttgttggtaatcgccacacaagaaccctacacatacttaaagactgttatgagctcaattgtttatcccccaaattcatatggtgaagccttaacccctaagacctcagaatgtgatggtttctggaaacagagactttaaggaggtgattaagttaaaatgaggctgttacggtggatcctaatgcaatctgactggtgtccttataagaggaagactggacacacaaagagacacaagggatgcacaggcatagaggaaggactatgtgaaaacccagcaagaaggtggacatctgcaagcaaaggaaacaggcctcagaaggaatcaaacctgctgactacttgattttggacttccagcctccagaactgtgagagaataaatttctctcatttaagctaccactctgtggtattttgctatggcagtcctagcaaactaatacagagataatttaaacgtagtttgaaataatatattgttagtttattcacagatctttcatattaagatgtgatagtattttgctgccagttgctaaaatagtctaaaagcgagtactcatggatttgcacacagaataaagctctgtgttaatgtcaaaatcatgtccattttaattattaattttagttaaaatgtattttgtcctgttctggttttgctgcaaattgtaatattctacattacagtcctggtaattagtacagttaccaaataaactctatccatgtacattttttgcatgactaaaactataaaataatattattttcatcatgaaatatacatgattatatgtagttccattaatgtatatagaacaacttttccaaaaggaactacttaacctctcataccattaaatgaattttcttgaagaaaacaaagtattttctactaccattttcttcactttgtggctccttataacttccctccttgtaacacctgctacgcggatgactgcagcactattaaaaatttactgtcagtgttagctttccaagttatggaaaaagtctcagtgcaaaacaaacaataaaagcaactctgcataagacaaatccttacttatgttaatgattacatgcggtgacattgtcttatttaaatatgcttatattttcttcaatttggaaactactgtgagatcccaaaagatacactgtgtccacttcaaaaactctaaaattctaagtaccaaaggacaagcacatatttattcacactaatttttatccttaggaactgcctaagaaatttaaaaaaaaaaaaagaaaaagtgattttgagagattataattagttttgtgaggcttgctaaatagtcatggcaaaaaaaaaaataaaacagcaactttcactgttaatttggaatgtttatcttctactcaaaactgaacgaatgtcttacattgttgtgctttttctttggtgcttatcactgaagaagaatgccaattccaagcccaacttggacatatacctcagtaaagctgccctgcagcagggctgaccacctccactgaaaatgcctaggcacagtgaaggcccagcaagtggatgacggcatcagctggtcctaaaacaaaaagacttgagtactatatggatgtaatgacctcaagatcccctatatttcctaagaaattagacatagcttcatcattttcacctatgaagacaaacttcaaaatatttttggcctgctttttacttaaaaaaatgcttatgaaaagggagtggacaaactttgtctatgcctttgtcttctgctctcttttgatgttcctggagcctatacccttaggaagaacttgatcttgaattacaatatcagtgtccttcaaattccacttcccgtgttatagtaagcaatgcctggactgtcatgtcacctagcttagctccagacatttgcagacatttattctggcccctttagactattccctgcactttagccagaaaaattatttgaaatcatgtgttatctgcaacagactatgtgttccaagggggtagtgaccattcctgcactccatgctgtatccctagcataagtccagacacatagccggtcttaaataaatatttctgaataaattactgaattcactgggattacctctcctcagtctcttctgtcttccactatcctttgttctaacatggcttatcaatcataattaacctctagaatacttatcaggcctcactcatgcttccagtttcttttccatgatccagacttactgaatttgccttctattcctttcaaatcctgctttttgctggcgaaaataggtagtcacagtagtgctcactttttttaatgcagtagaaaaagagaagcaatttgacattaatatttagatatggagttaacttccttcttgaaacttgacataatgactctctgctaatcatttgtagagatagtcaacaattctagtttaggtaggaaaattgagaataaaaaaaaagcataggcctgttaatctctttttaggaagagtttgagcattctgattagaaacagatgtcatataagctcttacacataaatgagtgcactattagtttgatattttatcgagaaagaagcaacatgaagaaaaataggcatattttatagcaacttggtacttaatagagtttatgccaaaggaggtcagtgcaatgcattttcttttttagtttttgtttgcacattttttaaggcctggaaagtatgagggtatgagtaggatcccagctgtgccaattaatgacacatataaccatagatgctttatttggctagtctttaaaataaacaaaaaaattataggttgccagattttttgaggaagaaattttctttgatgactgagctaagggaccccaacacagtatattatcaagagtacatcatttttaaaacattttatattatcactataatttaggtaaaattatagtatattagcactagatgatgtattcttcatcaaaaatgaaaagtttccttttagtagccatagaaggaagagttcccaatttaaatctcacgaaatcttgctttcttaaatatgtaaaatataacacaagatttatggaaaaaggtagtcaagtctatttgatttttatggaggctagaacattccagattcaaatatcatgaataaactcataaacaagttactatatcttctgtaaaatggggataatttatgaggttacttttaagaataatatgtaatgtctgtaaagttgctgggaacagtttctggcacatatatatgatggctactattgtttttatagattacatagaatcacagatccttagaaataaaaacaacttgagctagaatctggtgtaattcccatccaatgcaggatgatttgataatcttgacaaattggtctcttgagctctatagaattagaacagagtctaaaagttaccatagcccaggaagagttgaagtacattatcttataaaactactcttgttcatgctatttcctttctaaagtaaatgtaaaaagtatggaaagagcatcatcacaaattgtgaatacaatggagcttctcattttggtttgttttggtttggctatacatgaaataccttaattccattcagtcattatgcttagtttatcaagttagtggccttctggcatattcaatacatacaacggtaaagttcacagtgtgaaacttaaatgacaatacaatgaaaacacaaacagatctaatcctagatttcctattgcaagggcaagaaattgagaacactgtagtcaggaaaatgtatatcaggaaaatgagatttacaaacaatttatatgtatagaaacaaaacaattaaaatctgaaacagactccaaaatgtaaaatatctgacctcacagaaggactttgaaccctattatacacctttcttcatccatgcaaattctatttattctattagtctactttgacgagtcactgaagaattgagaggcaggaaaatatatgatgaaagcaattttaaaaagataaacatcttggctgcacaccagatggattaaaataatggagactggggaggaatatttattgtttatagctgataacaggaaaagaggcccaattgtgtaaaaagccttagatcattaaaataatgtcagcccaagaataaatgcctcaacaggaataaactgaacaccttatcataatcactaacttagactgagtctagtttctccaggtaaaattcaggcagtagtctcagctctaccagtaggcactgcatattacaggaggtgacaaatgttccagattgcctcaaatatcttggtttgttcctattatataggagtaactatcaatagtgcttctttttttatcagaattgtgtctgtttgaatgataatttttatgatcttctaattatcgaatgccactgtggaaatttaaaaaagaaaactttcctggattgttatagcttaagcaaaaggcttgggcaatcccaacgtgcttggtgacaaaggaaaaaaaaaacagctctactttcaggaaatctggctatgtacatgcacatgacttggagacccaagcacagactgtatttcagcctcgactcatcccctccgctgggactctggggcagcacccgagctgtctaactctacacagtgccctgtccaccagctagcatggtttctctaatgttcatttaccaaatttcaaatgaattccttagcacccagcccacattttactcttctgtgatatcagccttgattactgaacaccattctgttttctaaaattgtacagaacatatattttgtgccactcatttgaactatgtctttcttagtaatgtcttcatagtgttttgcttggagtgggtttggggacagaagcggtactgcacttaatgtctgccagggtcaggaggaacaatcttaagtttttggaaaggtttgtctccatttatgtgaactgaagtctgacagccaagagaaaataaatttgttcccagaaagaaatacaaactaatacggggaggttagtgactattgcagttgcaggattgcaaaactaaactattttgactaataatatagtggaattaacttttactcagcacttactacttaccaggtttttaccaatttctaactgttttgaaattaataactcatttaaacatcaaacaaccttatgaggtaagtactgtcattgtccccactttttagattaggaaaatgagattaaagaacttggcaaaaaatttcacatctcatcaatgtttgaactaggatttgaacccatgcagtctggcttttgaatgttccctctgaaccttcatgctaacctgcacacttaacttgcattaagtttgtagcatatgtctggtttgatcatttgatgtgtggtatatattcctacagcaattttagtcattaagaggagtattcaagttagacttggcactcacttctccatctagacaaagaataaccagcagacaggaagaacactattatgagaatgcttctaatcacaaaggacccctaaacagcccttacagatctgaatagaagaagtaataaccagtggtatcacaaccttagcacaacaaaggtctgagcatcatctgacctggtgaggaccaacaataacattttatgaattattttttaggggaattaagaattatttattaggcagcattgcataatcctacaaagcactggagtaggctttagaacctatggtgttggcaagtaaatgaatctccctgtgtttgctcatttatcacaaggagatactgtaagctgtcttataaagattctgtgagtgttaatgcaataatgtttgtaaataaggtatgtaaaataattagcatattgccccatatagagtgcccactacagactgcatgtctaacttattgtttcggatactagctcttacaaataggcaggaatttcaaaaggttctatgaatgtttggaattttggatgagttctgttacctcttcaccccaatgctggcgcaacatgaatttcctttattgaatcaatttgacagatttaacattctatttgaactccatttccataaagcacaggcctcatctaattatccccaggtctgccttctactgtgattgtgctcattctgcctttctttttttactaaagcaaatcttttcatttaaaaaagcttccttttgcttgtttcgcctctaaccacaaaatgcactctcgtccaagtcctctgccaacctgagcaataaaaataataaatgagacaactgaagactctacttggacctttaaaatgctccagcgaaggtgaccctgaaaaattattatggcatgttatcaattaggtgacactatcaagaaaaatgaaaccaaaatattcctttattctgcctgattttatatctcataaatcctgctaaaatacttcattggaaatgcatatggtaatatctagacaggcttatgttagatatattctttttggattctcagtggacattttacatattagggccaccaatatagataatatgcccaagatgacaaattacttcaataatacttaacatgaggaaagtctgtctcaactttgcggggaggggtaaacacagctgctttttaacacagttaaattcataaagctaaaaacaaaacagactttaaaatgtttaaaagtctgtctttgagaaatattctacccatgaggctaaatttgacacaaaatattcatcatcataatttaaattttaatatatggcctatttaaaggcttcatacttcaaaaggtttttacatttattttgtcattctgtcttaattaagaaccaactccagtattagattaagttacacctttggattgttagaaaaattaggttgctattcttctggaataaatctacttttccaataaacacatgaacatgtcaaaattttttttaacaacaaatgcatttgacttacaattacacaaaggcattatgtttaattatttttttctgaaatgttatatagaattgagtaaaaggtatttttaggtggaaaccatttctaaactcttatttcaaaaaaaaaaatcttatagaatgagagttccaaatacctttcattcagctttcctcctgttaataattaaataaccattaggcagttatcaaaaccaagaaagtaacactgataataaactgttgactaaagtatacactttattttgttttaccagttttcaactaatgtcctttttctattgcaggatctaacccagctcccacattgcattaaactgccatgtttcctttgtcccttcagatgtgtctttttttgtaattcgtgtagttaacacttttgaagaatactggccattttgtaaaatgtccctcaattttggtttgtcgtagttagatggaacttatggatttttgttgagaatatgaataccaaagaagtgaagagcctttcttagcatgaaggttcatgaagtcaatattttttattactggtgacatttaacttgatcacttaaggtgatctgctgagtttttctgaagaaagttactacttttacttggaggaaatatttttagactacataaattactaatttctactgaaaactttttcgcacttattttggtatctattagggaatcccgacttcaacaatttttacattgggattctaacgatgaattcctatttccatcatccttctacattattaattgtaatttttctgtatgggtgagctgtctctgcttccctatttatctatctgtatatctttctttctatctgttcagttacttgtttatatctctatgggttcatagatgtttattttactcttttggttataatcaaatgacatatctattagttttgttgctcaatttgatctagttctggcccttggaagttttttcggattagctcttacgctcctttgtcatgcttctctctcaggggtcaataaagtatgccctacaggtaaaatgtgtccactactatctatctaatattgtaaataaagatttattggatcacagccacacccattcattttcctattagctattgttgcttttgagctataatggcagaattgagtaattgtgaccatgtggttctcaaagccaaagatatttaatatttggccttctatgatgaaaatttcttgatctttgctctaggcgaattttctttttttaaattatgaactttgaatagtgcccaaaatgtatttaattgttatatctgaggtactttagaattcagactcttgaatgtatatttttcctatattctcctaacttcattagttgtaataattttgatgctagacatttattattttgtttgaagaaaacaaaatggattatcagtattctattgagtttaaaatactaaatcatacagaataagaaaataatggtgagacaaagttgaaaaattatctagtaagaggagcgaaagagaaaaattgtcctcttgcatgatatgttttaaagtttcctaaatacatgcaaaggcctttattaacttcttcccataataatgaacggtaatatggtagtctcctcttattctacagtttcagttacccacagtcgaatgcagtctgaaaatattaaatggaaaattttagaaataagcaattcatgccatttcagtaaatggcatgcaatttaaataataaagttttaaattgcatgccattctgagtagcaagataaaatctctggccatcccactctgtccctcatgacacatgaatcatcccgttttctagtgtatccacgttatatagtcggttagtcacttataagtagccacctgggttatcaaatcaacagatcacaagaagaagggtgagtatagtacaataagaaattttgggacaaggagagagagaggaagaggccacattcgcagaacttttattatggcatattgttacgattgttctattttattactagttattgtcactaatctcttatcatgtctaatttatacattaaattttatcatagggatatatgtatagggaaacacatagtatatataggttttggtactatctgtgatttctggcatccaatgagagtcttggaatgtattcctcaatggatacagggggattattgtactttccagagatgttatattgatagcaatttttatctttatgatattggacacagttatttcaccatcccacttcacaatcatgagatgattcactgagagacctttccaaatgaaactctgaaaccatgcattttggttttaaggatattcattatgtaatgccccaatgttataattatatcaagcatagtatcagtgcttaaaataaatttattagaaggataatggcattcttatgatcctattttggagaacaattgttttaaactggaagtacaaaagttggtcctattctgtgaaaaaaaaattatctgagctagtaaaggctacacccagagggctatgtcagtggttagaaggttattagcaggttagtaaagggcagccacatttcattggaagcatgtttaattaggggaggaggaggtttctcctcatatgttcattacacagactttattttttcctctaatatctcaatatcctcaaagatcacctagagcagaggttctgaattctaggtaaatgggcctaaggatgcaacccttaaacataacatacataattttgtatacaaatgtagatagatgtgtatttttctaaagatagaatgttctactttattggattcctatggaggcagagattcaaaggaagttaagaaaaactgatctagattaatgtctaaaactaaatacagttacctaagctttatactctacataggaccttgacaccagtgtatgatattttatcctttttgatactctgcctcctcttgacggcactttcatttgtttattagaagttaagtgacattaaaaccaacttattcctggccaggcgcagtggctcatgcctgtaatcccagcactttggggggctgaggcgggtggatcacgaggtcaagagatcgcgaccatcctggtcaacgtggtgaaaccccatccctactaaaatacaaaaattagctgggcatggtgttgtgaggctgaggcatgagaattgtttgaacccaggaagtggaggttgcagtgagccaaattcgggccactgcactccagcccggtgatagagcaagactctgcctcaaaaaacaaaacaaaacaacttattcttgagcttacaagatacgaaaagtgggtagacagtggacaaatataaatagcatgaaaatcatgagacttgttcatagttgacattcaaataatgacattaaagctgagaaggaacaaatcacatagtacagttttaaaaattgttcatcatacaccaaaatactagctattatgtattatcattataaaaatatataaataaatatgtctgtgctatttaataaaagctcctgaagatataagaactcagagtgtttgagaaagtattacgagaaaggcttgtcattgagttgggaatgtgacttcttcttccattaaagtcagctatttataaactataaactatatgataaaacaaagatacttttaggtaatagtcaaattataaaagcgactgttataaaatataaatattaaaatcaaccaaatacttgtaaataccatctgaagtttcctaaaaacctaatactctttaatatgtcattttttccggccttcagtgcttagctattcctataacttgtttccacctcatttcctaaaagctagatttctgcattgtagtgacaattaattttttatatctgacatgattaattcattttttgtaaccagtagttagattcattaacctgattacccgtatctttggtgaaaagtccttcaagacaatctcagccaatatctttagccacacttatttaaaatcatgataatgctattctctgtttaacgtgactacttttcaggagtgagaccagtataacccttcattatgataagaacttaaattgctaaacaaattgtatgttggaaacaataatggcagacaagaagttaaagggggaaattttatgaaattttatgaagggctgctatttgtatattacaacataagatatacttggcaaaagttcttaaacacagtaatgattaataaacatttctcaatttgatttgatgggttggtttctaagtaatttgttttcagaatctgagaacttttaaaagtaaaaagttcattaaaaactcgcaaaacagaataaatttttattgattaaatgtttcaaaatatatttaactcatttttaaataagcttaagtttagcttcaaatacgtaggaaactcatgagttgctatcctactttattgagctcttgttttctgatagtgataataaaggcacctatcctccccacacagttgcaaaaaggattaacttaagtgagagacaaaaaagtactaggagaaatcgggaaagaagaggtttgacttacatgtctctatgtcattcccaatagtatccaaatagcagatacccaacacgtatctgaagaaattaatttctcagattatttcaattttgtcagcaataaacatttaataatgcatttgttttgggggcaaaaaatcagcatattctgaaagcagaaaaaaagggcctgtttgggtttcactgagctttcagaattgcctggacaattatcaaattggccctgtgatactctgtatgttagcttctactacaagagaactttatgaaagtcactgataggtctcattgacaagtttcctgggatggaacaaagaacatttccataactacatagcaataatggaacaaaaatggcaacttacagacaaactacaagatttcaatttaaggaatgaagcagttaagcctagttgatataatatcctttacttctgttttaccacaactcttagaaaacatctgcattatctgtttgccaacctgtgtagtttaaatgatgccaaaacccatcaaaccatcagagaatcttgctctctcttttaacagaaaataaaaaaatgctaacatggttgtgtgtccagaattggtgggttcttggtctcactgacttcaagaatgaagcctcggaccctagcgctgagtgttatagttcttaaaggcagtgtggacccaaagagtgagcagcagcaagatttattgcaaacagcaaaagaacaaggcttccacaacacgcaagaggaccccagcaggtggccagggctggctcgggcagcctgcttttattctcttatctggccccacccacatcctgctgatcggtccattttacagagagccgattggtctgtttttcagagagctgactggtccgttttgagagggtgctgattggtacgtttacaatccctgagctagacacaaacgttctccacctccccactagataagctagatacagagtgctgattggtgtatttacaaaccctgagctagatacagagtgctgattggtgtattcacaatcccttaggtagacataaaggttctccaagtccgcaccagatcagctagacacagagcgcagattggtgcatttacaaaccttgagctagatagagtgccgattggtgtattcacaatcccttagctagacataaagattctccaagtccccaccagattagttagatacagagtgcagattggtgcatccacaaaccctgagctagacacaaggtgctgattgctgtgtttacaatcccttggctagacataaaggttctccaagtccccaccaaactcaggagcccagctggcttcacccagcgtatcccacacggggcggcagatggagctgcctgccagtccggcgccatgcccttgcgcggtggatgagactgggtgccgcggagcagggggccgcacaggagcccgtggcggggggacactggggaggggaggctcaggcatggcggactgcaggttccgagccctgccccgcagggaggcagctaaagcccagtgagaaatcgagcgcagtgccggtgggccggcactgatgggggaccctgcgcactctctgcatctgctggccctggtgctaagcccatcactgccggggcccacagggccggccggccgctgcaagtgcagggcccaccaagcccacgctcaccaggaactctaggtggcctgcaagcgccgcacgcagccccggttcccgcccgtgcctctccctccacaccccccgcaggctgagggaaccggctctggccttggccatcccaggaaggggctcccacagtgcagtggcaggctgaagggctcctcaagcgtggctgaatgggcgccgaggccgaggaggcaccgagagcgagggagggctgctagcacgctgtcaccttttagttgccttacagtaactgtaaaaattctgatatttaaaaaatccaagtcattgataaagtaagaacaagtgagaagtctgataatatatcatttctttccatctccttggacacaatttctcagaagctaagcttagaattttaggaagacacattcaatatactacttaataaaaaagttcattatgtttcatcatttggaataacctcaaattcccagcaaaattgaacactgtgaaaaaagataattaaacaggaaaagtcagagttttagacacttgtttaatttactcagctactgtatttgtggcttcagatttctcagagtaagatttattacagaaagttagtattagtaaacatttaatgatttccaatggaaaccaaacatttatatattgaaataaatattcatctatgcatgtaagtatattttggctaaaaaccaccagaaaaaaaatgctttgacctagaagtttaaggagggatgttgatttattcaacaactatttattaagcaccttctgtgtgtcacaccctgattattacgtcttttgttagactctactcaaaattggttatttaaacaataattcagatattccatatggtttatcagtttccacaagacttatattttcactattttacttttagaggaaggaaaaaaattagtcaaacatttcccatatctatacatttaatgagaacatgggcaagtcttcttttaacaaactttttctcccaaatgattcttaagtattctaatgttctaatggtccataataatttacttaatttgctaataaagtttctctagtaaagttagaaaataattagtgcttactaacgagtattattgattcaaaactttagtgaaaacaaaatatggttattataagataaattataatttatcatataaattataaattctatggttattataagaaaattttttttatgtgttactatgtttaaatacccataagatagtcttgtgtgtatatgtgtttgtgtgggtcagcagaaatagcagactgtgacatcgactgatacagttaggatcaatcatgtaagtaataacatttagttatgaagaataggctatgctatgtttaaagatgcatctaatgatctttgtatattttactttatgtttcccagactttataaaggaaggtgcatagcttgtagacagcagtccccaagtgtagtttttactctgccactaacgagcattgtgatcttgagcaaaccagttggtctcttcaaggttccattttgttgtttgataaatgaaggacgtggaatagaagaacgttgaagttccttccctccttcaaatgtaatgatcatgtaaggtagattgctttaattacatgatactttgaaaaattaaattaaacaaatattaaaaaatcattaaattaaccaacacttcagtaccaaccctgcaatctctaaataatagagtgacttaaataaataataaattactgatgacttgaattaaaaataaactaatcttagattaagctacactaaaggtttggaatttagggtaataatatgacttcctgagccctgaaatattttaccagatttcatggatgaaaacagagttaaggtttagatctaatactcataagctcttccagacaaattgcatgatcacgagaaaagatttacaccatctctatggagtcttagagcatttctctctttctctcagatcctcttatccctaaaggatctctttatcttaccactccagaccaccattttctattttccttaaacttaacagtaatcaaactcggcattttgaaagttaatacattttatctgacatgttcaggttttctggatcctccttatctcccaatcagactaatctgttggcaaacatgaataataatgtctttgacttctttgttccttcctacaactggtttccatttcattggtacctaatgctgtctggtgacacacagcagcattagaacattgaataattgctggttaaaagagagagagggggagaggcagagaagaatgagagagagagagagagagagagagagagcgagccgaaaatgcgggcatgtctctccttctattaagttgttcattagcttttacagtgtattttgcattcatcttgtttattttctcacattctactttagtactttatcttttgatacctggattggttagtagtttcctaaatagtttgtctgtctctatcatttcctgctaatccttcctaaatgaatgcatgcttgaaaagacctaaatctaatttgctactgatttcacaatcttactgcaccactcacttcaaaatggtctcttcttccttggaacgagttttccttttatatcttattcagaaattagccaaatatgatatgataactctagcactttctcacattttatatttctaatcttgaacttttttttgcctatctctgtaaccagactgtaaatttagtatgttacttttatgtagtatatatcctttaaatatttgttgatttaatatgttaacttgagtataaaacgaacatttgaccttgtgtagagtgtaaaagaaatcttttgacacactgtgataggaaaacaaattcaaaagtttattatcaaagataactgtgatttatctgaagcaatctttagtcagggtaagcaagatgatgttaggctttgtgaattaatgttatgagaaagaaagtctatttttgtggagagagaaaattttcccgcataactgtaattagggacaaatcagagattaatgatgcattatattctagagctttaactgataagcaccaagaaatggctttctcaactttaaatggtttgtaaaatattatctctgtactttgctctctatatagaaaataatggatactaggtcttctattcagaaaattcaatatttattctaaaatgtaaactgttgagttacaggaagatttcatatactcaaaaagagcataaaatctacctctactaattagtttctctatgaaagccttccaggcaattacagagcagtaccattggtcaatgctttggttgcttttcattaaaggtatagtgttgctaccagatgaattgcttcatataaaagcacttaccacaaagacctataatggaggttaagtgctatactaattactaatttcaatccttattacctatattttgcagtacaggcactttaaaggaaccatatatagtctgctggttcccgcttctctgagtataagacttggtggtaaaagctctaatttagctgttcttctaataaaaataaccccaaaaattaataaaaagagccataccacaaactgacataaaatacatatactagactttgctactgaactcgtatttacaatcaccgtgtcacaaaaactttaatcaaggtgacacactcttcaaaatttgtattcagccattatggcaccgttgcagatgaagttccaagagaaaaaggtatttgaaattttcatggcttatttcctacctcagcatcacactgaaatgaacacagagcagatgattaataaaacatctgatgacaatggtgactcccctgagttctttatatattgatcattaactttttatatgtatatattgaaattcttcatatgtgctttattttcttgagggccgactctgtgttttaccttgcgtatatccttcagaataattgcaactttgcccactcttggtttatttatattttctaaaatacatcttggtaaaagggcatttaaaatctctgattaaatgttgaaagttgtatctgaaataactatatgtaaagatttgcttcttattacgatactgctcatttctatttttaaacatcttttacattgtgtttcttattctgaacaattatttaattggcaaataaggtactatatgtgttaaacaaatattaatctagaaaaatatgtacaaatatttttttcaaataattaataagtactgcctcaatctcagctaccagattcaaattggacattagtctgctacaagaacacaggaaccatatcttttttgaactatattcagtacatggcatctggtatgtgcacagtcaaataaaatatagtaaaattggggcatatagacatttttgaaaacataaaatatttactaaaatgcaatgatgtttggctaatatatcctatatttattttctatcatctatgcttgggtaaagcatcctgtatttctcttttacagatacattatgcatattaataaagtccaagtatagatattttaacttagcttaacccagaatttcccaaactaatgggactttccctttctcaccataagtagtaataagctctaggtaaagataccagtttggaaattgctgattaagtgttaaaagttactaaataaagacattttcaagaattaactatgaacacaaaaccatgcctcaagaggcaaatgccacactgcaatagtaacaggatttatcattttgcacgttcaggtccactgttcacagctgacaacatcccatgagcaaagcctagaccttaccctactatatattttcatggcatccagtgtgatgactttctctcagcaaataggcagtgattaatccatattttaggaaaattaccaatacacctttctgttattttattaaggttttagctattacttttaaaagcacattttttaggctgggcatggtggctcatgcctgtaatcccagcactttgggaggccgaggcaggaagatcacttaaggtcaggtgttcaagaccagcctgagcaacatagcgagacccccatctctacaaaaaaattttaaaaattagccaggcatggtggtgtgcacctgtagtcctagctactagagaggccaaggaaggaggatcctgtgagcccaggagtttgaggttacagtgagctatgactgccactacatccagtctgggcaaaagagtgagaccttgcttcaaaaaaaaaaaaaaagttaaattgataaagaataaaaattgaaattgcacatttatactaggatttcagataatgcaataatctgggattagcaggggctatgtaacattgcatgcatattaagttacttggctttcaaatcttccattacttcaccttattgtatatggttcacataattgtagtgtaaaattgtggtaattcccaagacatcgattcagcaaatatttactgaatgcctactatttgccagtattataacaggcactggacatattaatttccttgcttcctaactttgtcatagagcagtttttttattacatttaattcagcaaatattggcagagtactaggcttgtggaataggtttgaactagggcttgaagatttagaattctataaaccagaaaaggtccagaagggtattatagacatttcattccacaattgtgagtcagtacttgggatatttgatatcaattgaatacattggttatgtcattaaattacttctttcaagaaccaaataagtgtgatagaagaatttaaatataaattttgattattatttttattgggtaaaatagaaatgtatttttatactttttctttatactgtgttataaattgtgtgctttgcaaaaaacatagttatatctaaaaggggaagagagaaatgagactgatgcttttagtaatagagacgataatgattgcagtaaaatatctttatacttttaatttatatattacttaaaaagcatatttgttttaaaattgaggatatatacaaccacaagtaacattgtttaaaatttctaatctaccacctttgtttcaataacataatattgataaaactcattcacaataaacaagataatttttattttatcaataacggcttgacatttattttatagacttaaaatgagtagtgctagtgtcaaagaatcctcatgaaactctatggttatatgaaagtgaaaacaaacttcttttatgtacatgttcttataactgctgatttatgctactattgttttctcactagttctctacttatctcacgggatccctacactttaatgtgtttcagctgtgcactaccatctgaggaagcgttaggtcttattttctctcagaaaaaaaaagtgttataatattctttcccttagttttaaattttaacttttttacttttgacaaagcctttcctttgtttaaatgcaaggatccagtaaaaagagctttgatatgttgtgctttttatgtgtgcatttttctgatttcattgatgtcctgaattttgaaaacgataatgtacaccttcacgttctcctataaaatggcatttgtacactgtagcaagaacagtttaggacagcattacattcacatgactctaaagtccaataaatagttgatggtttctcagaaaaccacaatttggtgaaacggatgcaaaacagtgctttttcttccagtttgtttttcataaaatcttcccccgatacatattcacttgcttacctgcagggtagcgctcgatcactggccagctgtccacctgcaacgtggcattgccaccactcctcgtgaaacgaactacatggtatttcccatcattaatgattgcattggattcttcaatggcgatgtcatctgtcccaacattaaacttaactccaatttttccctggtgctgtaagagaggaggggaaaaaagagttgaattaagttgactagtcaccatttaataaagattacatacaaggtattgttttaaaatgtgctttggacaacagctgctttcctccaattttacttctgaaaaactacatgtagtagaagcaagattcttgacatctgggtaaatttaagacatctctttcatggataattgatattccaaaaggcacactttcaagggaattgagccgccttcttcccagaggttgtcacagagaaggcgcacagctgcctgcacaaaggacatccttttgtgtactttaacacaacccctttaatccactctccccatttcacaagaaaaacggggctccaaattcttacttttaataactggtgaaatcagagcaatgatgtctgtttagagcccattgacaaatactcacaataggggaaatcattctaaagggtatggggcatttaatgagtgcagtcccttagtcagtattcacaaaaccatcaaatactaacagcttgaaagttattcaatgtttttattttattgatgatgaaacatcaacattttattgatgataacacaggaaggtacaagacttgttcaaggacacataatagagacgtacgaaaactaaaattcatttcccttattcttagattatatctaagctaagttgaagcaaagataccgttatccaaaatgaacgccctcttcacttcttcatatgcaaagcctcattatgaatcattctaactataaagttgttgctgttaactttagaatttcataatataaggtggcaaagagaaacatgtgctatgtcctctgcctctgagaagcattctttaacaggactgtcaactctaccatgaaatcagttgatttctaaagcatgtggatttgtccttaatcagttgcacagaatacctgtgctgtaggcccttgtcagaacacataacctcaaactgtctgtggttcacccttcttcaaacctcagttgagagaaatcacacggaggaagaagggtttaaagtacacacagtccatcctttcctgtagaagttttaaatcagaatgttagaaacctgaagatttgggccacattctcttgactctttgtggggttctcatcattatttgaactaggcagcaggagtatggaatcagcttacactaagaatccttacggaaaatctttttcaaaattgtattaatcaaaggaaaatatttgaggatgttattttgcagtattgctcattatctccttcatgtagagatcctaaaggtttctgttggttttcttccccctgggttcttattgtacataaagatctctttcttataagttagcatgcttacaattttttttggtttgattagctttaggcttgacggatggtttaacttttttaaaaaatcacattttaacactatatacatgtttgttaaataaagataacttattatgtctcttaaatgagattctttaaaatttttctgtagagttatatcacatgtgttaaaaatgtatgtactaaattaattactgaaaatgagcaaaaagtaattctgttaaaataagaaaataatgcatgcttacaaaaaggtctgagctaaaaaaaaatctttaaaaaaatctccataagtctttgaataacgtttgaattttcattggacttttgctgtttgtttattagctgagtcagtctacacaatactaaaatgccttacaatgacatgtatttaaaagtaagggtcatgagaaatatggtggaaaataataagtccaggggaaaatatatactaaagtctctgcagctattaaaattacccagccagaagtgatggcacacatgtataatcccagcagtttgggaggccaaggtgaagaggattgttcaagcccaggagttggagaccagcctgggaaacatagcaagatctcgtctttactattaaaaaaaaagaaaaagaaaaaaaaaagaaaatctgggcatggtggcacacacctgtattcccaactactcaggaggctgaggtgggaagatcacttgagccccggaggctgaggctgcagtgagccatgactgtgcactgaactcctgcctggttgacagcgtaagaccctgtctcaaaataaataaatattttaaaaattaccctatctacatggaccctgagtttcctaacaaccaaacacatacgtagggctctatacattttataaatactaactctggtattcttcataacagttccatgagggagatgctattttatcttcattttacagatgagaaaattaaggcacagggtgattaagcaatttggctaaggtcgcacagctggaaagagaaaagctatggttcagatccacacagttaggctccagagtctggtccttaatcattacaccaggctgagtttaggactgttgtgccatcctatagctgtagctagcagatttggtaaatctagctgtttttactacctgttttatctctcctgctagaatagcatcactaaggggccttgtattgttctttgaagttagtagacatgtatcaatcaatgtatgtttaaaataattttggaataaattgtaagcaactgatatgtggatataatagaatattaaaatgattctttttgtttcagtttcagctgagatgttaacatgataacataataagtcaaaaacacattactgtttccatcttacaaaatgaagcataaagttacttaagccagtcttgcaaaggagaacactgagaactgcttttagggtcctgaattaattacctacttctagtccatcaaaatgcagaaaaaggcaagaggagactgacaattagaagaggatttttggagacagttgagatgtgatgtgatttccacatactgcagggtggaagtctgcttttccctatctcaagtgcaggagaaagggacattagtggaacatctaagaaaatttgatatgtgtcttctgggacttggtgggtggcagcggtcaaggtagtgagcaaactagtatttgactataactgagaaatcttcaagggaagagactgtggcttgctgatgcccagtggccaagcaaagagatattgatgtaccaggagccacttgtgcattagggtttgttaggacaaaggacacttgtggaccctaggttagagtctgtgtagaattgtattgtatcctgtttagcagggttactaaagggattgggctgagtggtgaagaaaactgagaaaagaaaagaaaaaaaaaaaaagaacttggaattgcagtgatagatgaccagatggtgaggtgggaatcctaaatgaccatctgaaggaagtgcatttactacctcaatggaattgcaggtaaattctaataatggggttaaggtctgtaaagaaccaaatgcttccgaaaagtgcctccttaagaactttaagtataggctaagctcaactagatggctacaataatactagccaagtaaggtcatttctgccctttatgtcttctttcttctgcttcatccctggaggaataagagagggagaggaatagtgaaagccatggaaacaatcgtgctcctcccagtgcaagtgggggctccactgtggctgaagcagggataatgaagaggctttaactgacttctgctattacagaggagtaagctgattttactttttatgtctaaaagtgaacggatgacctttttactatccaagagggagcaaagcactgttgagactccctgtggacttccctggtggttagaaagaaatatttttacagaacaagtttaattcctgttacaccttgggaagtactttcaacacaacaagtacaggaagatatctgttactctagggttgcccattgttttagggtctcgtctattatagacctggttcttatccaggatacactggaaaaaattcttgcagtttcctacttattatgaaacttattatggaagtaggccataagagcctattttcatcagagtattaattattaagaaggtctagattcagtgaatagaagcattgcaatgttaaaggtgaaaaatgcactaaactctgaaataagtccctttaacttaaccttaaaactttctgcaatatgaaatgcaaaatgctcattttctaggtgcagaaatctccagatttcataggatttggtttttttgcaacacaataaaataaacaatttagaaacaatgagcatccgtgatgcttggagaacatccgactttttttttttttaattttatatatatatttttttattatactttaatttctagggtacatgtgcacaacgtgcaggtttgttacatatgtatacatgtgccatgttggtgtgctgcacccattaactcgtcattgacattaggtgtatctcctaacgctatccctcccccctccccccaccccacaacaggccccggtgtgtgatgttccccttcctgtgtccaagtgttctcatatcatttgacttttaaatgacgcccatctcttcttggagatgttcagttgttgcctcaacttcaaatgtctttgacatctcatggatttaaactctagagttagctagaatggaactgaaggctatcaaaataagggttcaaacaacaggcccgaccctaattcagacattatctacttcaccccaagttgcatcaggctttgaaaaacagtttaattataaatgatcgccaaagagttttccctgaaaacaataaatttaaaatacacataaagcacaaaatactaataacaagcatatttataagaccggtatttactatttaattcagaaactatagatattcttacaacacaaccatctcatgtttataggatagcaagtcatttaaattatataagcaataaaacgtgctaaactttcttgccaatgcgtaattacaatttaaaagaattcatttcaaactcttattctctgggattaaatatgattgtcttggcaaattctcatgaatattgcattagcaaaaccagaagtcatttcactggacatgtctttatctccctgtacatgtcttgatctccctgtactgtatattccttgaaatagataactggctcaaatcataatttcaaaaatctcttataagaatatcagtaacgaggcatttataatttaatgaagactttccatggattcattaaataaacagtgacaatggtaattattgatttttttacaaaagctcatttctgaataaagattatattattaaaccaagttaaagggaaacatcatgaaatatgacactgggaaggtccctgaaatttctagcaagtggcaccatagtttaatgcactgtctaattccatatgaaataacatatgcacttgtaagttttatgttttaactaagattaagatttaatggtgtaatcaatatcttgggtatacttcaagcaagatgtctgcatgttacagatgcatatataatatgtgcctatgaaatggataaagcagaatacacgtaagtaaagatttcggtctacatgtggcatacagacatgttacataagattttagtgcactgtttcccctcaccccattcttggattgttatatagaaatgtttggctcaactatgctcaggaacagagaccagtaacaaataaaaatgtctctctctgtgtctgtttactatactcctagagagaaggaccaaacattgtgagcaagtgtgcaactcaggagggcatgtagattagcagggagccctgtttacgttctgtaaacttctgtcatgcaccatagtacagtccagtactccagggccccactttggacagaactcaacaatgtctttaaatgctctctctatgcttgtactcatttcagaatacagaaagactcccatagtccaaatctacattgttgattgaaaccagagttgggtgaatggaatgttttgcttctccagagactaatcctcaccagggagcaaaggttttaaggcatgaaggggagtctggagcctatagtcacagttgttggactatgcaacactgcagacagtatcagagagccatctgttatctcacctaaaaacaaacacactcagataattgctaatttagcccaaacacttttttttttttttgagatggagtttcactcttattgcccaggctggagtgcaatggcacgatctcagctctctgcaacctttgcttcctttgttcaagtgattctcctgcctcagcctccgaagtagctgggattacaggtgcatgccaccacgcccagctaataatgtatttttggtagaggcagggtttttccatgttggtcaggctggtctcgaaatcctgacctcaggtgatctgcccaccttggcctctcagactgctgggattacacgtgtgagccactgcccccagccacccaaatacatttctaagtgaattacttagaggccctcttggctggtagagactctgtttaccaatttagatggcctataatggtaagaagtggttttaatctagttgttttaacctggcactgagatatacatgccatcctctaacccccaaaaagcaacaccaccacatcaaaaacaagaagttcctgctgccctgtctcctattttctccattaaatagcgtctgtttaaaattcattcaggtaactaataaaaagtatgtaatatgcacccagcattttcctactactgggaggagaataaaaacaggtaaagtctgttttctgctcctgggaaaactttcaatcaaattgggaaggtaaatcgtgcatgcaaatactcatacccacaaaagagttgagggagtggtggggaaaagcacaggtgcattgggggaagcatctgaaggatctctggaagcctcaaactgccatgggagcaaaccagcatttggacagctctaacactaccagcaggttctaatgcaactcccagggacatagaagttatgttctgtctaccttctatctctcctttcaggccccacataccagactactcactatgtgccaggtattgagctctatacaatgtatctcatctaaaactcccagcagacctgaaaggtaagtgccattgtctctatctccttggaaactttaatcttgctgaaatcacacagccaataattatgggtactgaaatatgaccaatttggtggggcattctaaaactgaataatgtcagttgtgtcagtgttccaggaaaatgtcttgaaactaaggcacccttagaggatgagtcaagaggagggttactacagggtgcatggttttgtttttggttttagttttttttttttttttttttttttttttttttttttttttttttttttttttggctagttacattttgtagcactacacaataaggaatcagaagtgggcaagatatgtgggcaataccacctcagaaacatctcatttaggagtaatacatttttaaaaaacagccttttcatttccccatcaaatcttcattaaggatagtgtatcttttctaatatgtctccatcctacaggatgctgtagctccttcaatgagactatattctggcagcgatattaacttcctggaggcttaaattcatctcttggtcctaagaatgtctaataaaattttctaagcctgtgccagtcctcctccacacactgccttaggtgttagtttttatatgcccatttcaacccctcaaacctattaaaaacaactttagggtaggaaaaaagcctggtgtattcctcattgtatccttcaccacacttcccagaatacctttctttacttttgcaaatttccaatattctttcacatcaattttcttttttttaattgagatataattcacatatcataacatttgcccttttaaagtatatggttcagtggttttagtatattcacaaggttgtgcaaccatcaccattatttaatttcagaacatttgcatcatgctccaattttcttttgatgagataatgcatacaaaattcttagcacatttaatggctacatagttcctgttagctattagcattattattattattgctacaattattgttgttattcatcactttgaaaaacaatgtttagcttcaccgtagtttgatggaagttaattaaaatattgcttcaattatatagacatttcggttttgctagaggatacatttttaatgattacaacttgtgaagcagggtatctattttgtaaatgggaaagctaaagctcagaaaggctgagacttggccaaagtcagagcatctatctatgacttggatcaagagaggatattctaaaatctacctgtgctcaactgtaagataagtggttctcccgttgattatgctgaggcagagcatgcttgattagacaacatccatgtcccctcccatctcaatattatggttctagggaaatcctaaatgtaaggcaaagcagttctcacggaaaaaatttagatattactagttgagttttttgaaacacattgaaggtgcctaagtttgaatttgagtctctcttagatttccttcaaaatttaaaaaaatagaaaaactctaagattttattgtgtttttaaatcagagattctccaatttaggaggagaaagaggactttgcattaggttgaagtatcagtaatctgtgaagccttttgtgaaccatgtatgtttcttcccaagaaagtataatctctgatggaagcgcttgccattattgggaagagcccctgccttgtcaggtatgtaggatttagtggtcgtaaagtgagaaaaaggatggacagatcttgagctccagtgataacatcaaaacacttcagtgcttctatttcctcattgtctctccttagatgaaattaaataaaaaatcaaaacaatgtcaagatgaatttagtccactaagtgactggctgctggatctttgaatggggtaataatcttgatatcggtattttaagatattctcaattttgtttcactaataaagccaatactggattattctttacacagtatttgagaagacattctcaaaccattatgaagttctccagtgtggccatgggtacagacatatcatcaagccttttcgtgatacttcccccttccaaatagcatacgtttgcagatatcacgatagctgtagaataaaataaagctaccttagcctcttgtgaatcagagtcatctcattgagataattaattctgtatctccatccactgagacaacaactactatgaagttgaaatagttgcctttaaatgtgtccttatgtgtaaagaatgtcttttattatttttctccctgaataatcaatgagcagaaatcaaatagaacaagaaagaggcattgacttggtggcctatggaaccttcttaatttttcacaggtaatactttccatttggatagttagcctagtggtctggcatcataacaaatactttaggttgctgtatgaaaatctcagcgtcacactgaattaagttaagccttttccaaagtgtaatgagctgatcagatgtgtattacttgtttttgttcatttttttatatttaaaaattattgttgctttaaagacccttgttggaatgttaaattactttttcttgtacagtcacattgtacagtaattcaggaaactatgggcaatacattgtgtttcaggtgctgattaaaaccacaatctttgtttattctgcatctgcctgaatccttgtctttggaccattgcactctttgatattacctccaccaggaactgaacaggaaaggggcattctatcaattctgctaattgttgacattttttatgtaaaaaggttttcctataaaagagctttgggattatttgtggatttcatttacttgttatatcccaggatcatcattttccaggagacctgactatataattacaatctaactctaatgttccaaatttccatagcacaaagcccaacatttttcagacaaatagacagaacatccttggattgtaattttagtcctctgcatggcaaatgtaaccttagtaactcggttataggtaaaacaaaatgaaccttcgtattttagaaaatccttaaaagacgtgaaaacatatcaagagattaatgtaattattttcagtgcttccattgatataagccataagctacatacagtaaactgggaatggaaagatcagtttggaaggagcactatttttttaaattctatttgtgaatcatgacttgcaacctaaaaacaagagtgaggaaatgttttcaagtgtgtttgatggactgacttcctaatgatgctatgttagttttcacaagcctcaagaagagccctaccttgaaatgcatcccaagagaaaagctgacagtgctaacttttttcttttcgttttctctttcttattgacttctagtccaggactagctgtccgacatccttaggaaaaaaatgtgtgtatatgggcatagaaatgcatttaccaatgaatattttctaaagaatcagcaaaactctgttatccctgaagtggtaagtaataattcctacagccatcaaaaataaatctatgttcatgtgtgtgattgtggcacaacagaggagaatatggaatctctaaggcagaaattcctaatgattataacttttttcatcttcacaaaacagtaatacctccacaaaaatgaagtaatgcagaaaaatatttatcaagtgccttttagctgcagtgaattttgtaaaacaccataccactcatcccatgactcaaaactgataaaatgtgtgttgctggttatatttatatacatttattttcctcaattgcatggttttctggcataaatgacactaaaattttggaactaccataacacatgaagttcagtattcaccaatatttatgtacttattcaaaaaccacagactttttactatactcctggcactctgttaagttctggataaatatggttaacaaaccagatggtgctgctgtcattatgaagcttaagtctcacattattcgttacacattaaaacttactgtagcatatacagcatgctaagtttcaagaaggcaaagagtaaggatagcatgagaggaactgaataatttaagcaaagtctccttgagaagctgaagatgagaagaaatcaataatgaacatttagcattttccaggcagagaaaacagcatgtgcacatagcccagggagggattgtacaaagacagatccttttatgaacaaatgcagacacagatataaatatgtggactctttatagctattaagatgtgcaaattatatgtgaacatgtacaggtattcaaaatatttgtataagatataaaactaggttatggaataatgcgtaacaaaagtaaaatatattatttgcacaaatagagcaattgaaaaatagatggtgaagcacatttaaaaaattttccaatcagagaacagaaaattgttgaatatatgtagaacctaacagtatgcaacctgacattcatctaattgtttattcctaagtgtcattcatcaatgtgcattatgaaatgcaatttataaaagacttcctgaatcaacagggactcacatctttttcaaaagtcacttacttctacaatgtcaaaaaagattcatcattctacgctcatatttctaaactaatgtaacatgtttagtttctttgtgtggtggaatgtcttgttaacttatttatccagagagcccttttatctcaagatgtagtaaagagttatccataaaatttctgccttaagatttatgtctgaaatcacttgactggtttttcaagtaccctccttaaattggtagaagaatgcaaagttttcacccttgaccctttcaccttcctgttcactcagaagagcagatgaacagggtttaatgcctgtgtcccaaaatgcagtcttccaggcagtcaaccaatcacttcaaatgagacgaaggattctctatccaattctacttccagaaaaattttaaataaatgaagttaaatgagcatttgccctgaaatttggccaggaatcgtgaagccaaaaacacgcgaagtgctcaaattcaagtaactcatggacgttttgaacttgagataaaagttcacttgtaacttctccagagcagtaaccactggaggctctttgaggtcatcccttcccattgtttgcctggaaaagcaagagaatattttgaagacagttgtggacgtttagctcagtaaagacagccgaaggaataaatacctggagcaatgtcaacttagcagccattgaccaaacaaacaaacaaacaaacacactttctctcttactgctccatcacactagcttttcatttccataaatgtctcatgttctgacccatctcaggcccattgctcttccttctgcctggttagctgtttccttgccttccccatcccaaaataattgataccctatattgtttggagataattttgagaacttaaggatagatttgggcattgaatctgctgaataagggatagtgtttgtgaaatatcatttcgtgaagcaaaaactcattagtggtcatctactggagtacaaaagacatctacttaaaagtctgggctgacaatagttgaaaagcaagagacatactgggaggccatttctcttctgattagcagaattatttggtggactctgactatttctgataaatctttaagtactaaatatcatagcaagaaatatactgttgtgatcttgcattccatttatacacttcccctgccaaacatgtccactgttttaaaataaacatgaacaaaacctaatagagaaggtaaaaatgcactgagagattaatcagaaacatcattctaaggccaagtggaaaccatatgtaacttattcagtgtttggtaataccagtgtcagagctctgaaatgagtgtggatattccagaagggcaggatttggcagcagatgcgtgatgatgataatgatgatgatagccatccttcttgccatgtgtcagacactccttctaagcactttacaggcaataatacgtatgaatatatatgattattttcatttaaatgatgaggaagctgagcctcaaaagcttgtcctaaatcacatggctaataagtatcagagctgtgatttttcaagcagtccaattccagattttgtgtgctaaactataccattgctcctctgaggaagtccaacatgcttacaagaggttgcagcttgtttagctgtggtattaataaggctctttgaaaaagagagacactaacatcctcattattgtatatatcaagtaaaacatcaagtacttttcagacctccactcctttaattctcacaataactcattttgccagcctaccaatctccatgttgaggatgtttaaaactcaaagcaaggaggtacttttctgaagtcacgcagctaaaacatcaatctagttacattcaatccaggtctatctggttccaaactaagagctttcaaccacatcatgctactccttctgcagagtcttcatgatcccctagaagtagtaggggccagatgagagtatcctagagctctagacgcttaccattttaggaggtttgtatactgataagttttccaagatgggggtggacagacgcagcaattcctctttcatgagcattaaattagtccagttgtttagaactgctagtaagtgaaatattaatctccattagggccagagcagactttgtcatacttcaagagccagaaatggaagtactatcttttaggtttaattgagattctggagtgtcagcctattttcagagtctgtaagagaggaacactcagagaaatagccagtgtctttcctctacccaaccccttcccacctagtttacatccagtttttctctagtatgttttttgtttatagccaacagatttatttaaatcatatttatcattgcttgctattttgaaagatgtgcctcaagcttccaatcaaatccaaaagaatacataatcatcaaaacaaggttagtcatggagttttctactaaataacatttgtgactgaaataggcaaggaaatgagagatttagttgtagtttcccaaaggtaataaacctaatatttaaaaagaaatagtaataacttaccagcagctcaggtgttccatgtgtcatgatcaataaccaagtaaatatagatctgaattttgtagccactttggttgtatcaaaaaagccactgcatggtactattacatacatagtttatatggtttagaagaaccatataaaccaccattaactattccttttatcataataataaaaataataggtggagttgctgatatataaaatatgaattgatccattagaagtaattttctattataatttttcaactttcttagtcaatttcagattatgattagaaatgttaatgttaatcttgtttctctaccatttaacccctctcttaaaaacataatgaccacttcttagacccttttctactctccttccatgtatatttcaagttttctacttataatttgtaattatttaaattgttttatttttatcttagttgtttgaaatcaacctctacattattaccatcttttctttctccccaagcttataagcattggtctagcatttaatgataacttttaatttgggatgattatatccaagatgctgccccagaatgagagttttatgaatgcttaatgcaaggaatcataaagcttataccagtgctgccctgaaaaattaaccaaagaaaaccccaaaactctttctccttaatcaaagaatatgctttgatgtgaacaaaagagagaagaatatttaatatcagctttggttgcactgcaattagcaattaacaagtaataacctatgattagttcacaaactccaacaaatacacttaatgacaggtgactaagagatgtgggaaacatttaagttagggccaagatgaacaaatgtgaacctagcacaatttggtttggtaacattaagcttttgataaactttcctagtcaaaattaaattattccatattactttgaagtaattataatacaattttctactttaatcagctgtctcaaactttgtgatcacaagttattttatgcaaaaaaaaccctaaaagaaattatgaaagatttttcaagaaagatttataaacttaatctttcaaagtatctcataaatgtaaatgcatgcttagcatttttaatggattatttactcatcatttagcttaaacatcataatgtttccaatctatgttacaagagctaagccatttcaatgctttttgaacaagttactctgttgacattggcacagaccaccaaaatgcactgattatggaagatatacggttaatgcatacagtatctgagcattgatagagcatcaaggcaaaagcaggcaatacttaagttctccaaataaatacacaaaaaagagagcttgatgaccacctaaaataacttttcaacatggaaaggtgagccttgcggcattccacatacagattagctgagcctttcaaaggtattgttgaatttatctatttctgagcatatcttacttttaacccaacttaattctttggaaggacatgcattacttctgatacattaaaaaaaaaaaaaaaaagacccttttcatgctcttgcttgctaaaactctactagaactttcaatgacaccatattgcctctcagactattcaactggaaattgtatcaggtaaactctcattcattattgcactacccatcttttaaatttttaaagagattattaggggctgtttaaaattattactattcttccacttcttactttttttaggtttactctcccatcacaattattgtcacatgctacattccagactacatatatatatatatatatattttttttttttacccaagtactacaatagaaatgtgatacatcaatggattgtaagaaaaaaaaactacccagctatgtacctggttatattcacacattgttacagagctgaaacggattaattaggcagttaataaaactattacaacaataattgcagaaattactaacgtaaaagtatcttggcctagatagtttatgtctcagttaataataatgttgatagtaatactaataagttctaattatcaatgaccatttgctatgttcccaatttagtcttttaaatatacctctgaacagtatttggctcataatggtcacaaaacaagtgtttgctaaatattgactaaattcttatattaactctgtgtgagacagatgccattattaccttcacttaataggtaaggaaactgagtcataaaaatgtcacttgctcacagtcactccactaacatttgaaggatcaggatttgaatccagatctgtctatctccaaagtaggtgttcttaaccactactgttttatgttgcctttggaaaaatatccaagaactagataattaccagtgatgaaatctgtttcagaatatagaaaagtataactcccctctaactccataaaattaaaacaaaattacaatccctcctaaatgtataaaattagaacttccttatacaaaagccaattaaatgtagcacacacacacaaatccattgaccaatgtatattttaatcataactcactataataaagatggctgctgcatatattgccatttaccatgagtcagtccttttgtggtgcttatataataaccgattttagctttacaactctgaggtaaccattattaagatcattttacagagaaaaagaagtggcacaaatttgcacagtcactgtgttaacctaaggactcaaacttggtccttttttacttcaaatgctacataaagccagataaagtgtatgtcaaaaactctgagatatttcaaaattgagaaatctattaacatgcatcattaggacaaatgagaaaaaagcaaaatactaagataaattctataaaggtatttgttaagttcactatgcatttttgagatatttttaaaaatcacttggtaaactagaacaatccgttgcatgataaaactatttctacctcaaaccaactgccaacatcatgcttaacactaaaagcgttcccaatgaagtaaaacagttttacattgtcaccaataggtcttagcgttggtttaaacatgtcaatcaatgcaatatgacaggaaataaaaataacagtttaaattattgatagagaagaaaacaaaaacacactacttgctgtaaaccgaaaccacactgttggatgcaaatatagccatttaaaataaaatgagagagctagccttcagaaaaccattctaaaaataagataaacataaatgcatacattctcataaggagtggcaaagatattgagcaaaatgttttggaataaagaattaaaatgtgagtttaatgaaactatataattttttggcaagtgtttctaaatatagactctgtgtgatggatacattaaaaattattatgttattttctttgtgttagaaaatgtccataatggaaagaatgaacaatggcagtctgcgaaacaagagtactgcaatttttgtctctaactatatttgtaatcttgaacaaattacataactcctctctcttgctttactttcctcatttagttcatctttttctagatcatcctttctggttctgtaattctattttattttcagttgccttctcaattttctatattgcaatatattttaattcataatggttcaatttgtgataatcactgctcagccacaaattgaaaatttagccaaaaaaaccccacagaaatggcattgctttgactttaaaatagcatactcttcctgtcttttttgagatctaaaattgtttatcagtttgcggggttctcttgggtttattgtactattagacactgacacgttttaaaggatccttaaaaaaaaaaagaaacaaatgaaaagaaaaagaaaacaaccaaatctggcttgttctgggatgctgagatgtcttgacagcaattactgcagtagagactggtgaataccctattttcacagctgatgttttccttcaaaattgcagctaccttcactttggttgaggccagggtactatatttagatagtataaatgtatccagagagcaatctttcacgtttatttgtagagtgggtttatttttatttattgatgtcacacaaaatgatgtttcctcggtttctgctgtatataacataccaaaaaataaagacggtctagaacacaaagtaagaatatattctgtgtgattatattgacaatggtttcgatttttatgcaattatactcccataatgttgaaattgttaacacaagtctatgtttactatgtaagaggaaactttattatgcataatgaagatggcatgggaataagggagtctcttatccttcctgtcaacctaaggccaatgtgtaatgcaagaaacaagtaggacacagggaaaagcaatagccataaccaagagaacatcagctatccctccctcctcacttagaaataaagaatgttggccgggcgcggtggctcaggcctgtaatcccagcactttgggaggctgaggtgggcagatcacgaggtcaggaaatcgagaccatcctgtctaacacggtgaaaccgcgtctctactaaaaatacaaaaaaaaatagccgggtgtcgtggcaggtgcctgtagtcccagctgctcgggaggctgaggcaagagaatggcgtgaagccgggaggcggagcttgcagtgagctgagatcgcgccaccgcactccagcctgggcgacagagtgagactctgtctcaaaaaaaaaaaaaaaaaaaaagaaagaaagaatgttgagaaagcaaagcattagtttatacaaccttcaaaataaaaaataatttcaagtcaaattctttttccaactttatatgtggggtgtgtgtgcgtatgtgcgtgcaaattaataagtcctagacaataaaaaattgatagcacataaatggaggggccaattctagcacttctttttgtcttttttctccattattggataatagtggttaccaaatagaattcaacaacagaactgattaaatattttccccctaggttttaatttagactacacaacatgtatttcagtacttcacattattagttataaaatttttctattgttcccctattgaaagtttaagagaatgcccataaactgagtttccttttagaaaaaaatcaaataatgtcaacatcctttgcatctcatttcttctctttcagacttatgacttaatcctcattagttataatactttattttcatcttttttatttgattatttaaaactttaaggtgcaaatgggttcattttggagacgataaacaggaaattttaagatttctcttggcccgttattttagattgtcccgtgatacactgggggcaactagcgaaagaaatgataatttgccaatgactcttaaaatactgaatagtaaaataacaaaattcttagaattgggaagtgatcttaggcccaaactctcatgtgataacagaagcccttctaaaaatatctctgacaaagggtcacttaagttcaacttgaaacatgccagtgatgttattagttctcaaagcagcctattcattattaaaatccttttgaattgaaagttactctcatgcggcatggtggtcactcccgtaatcccagcacttttggaggttgaggcgggcagatcacttgaggtcaggagtgagaccgcctggccaacacggtgaaaccccttctctactaaaaatacaaaaattagcagggcctggtggtatgcacctgtaattccagctactctggggactgaagcaggagaatagctatagcctgtgaggcagaggttgcagtgagccaagatcgccccactgaattccagcctgggtgacagagtgacactctgtctcaaaaaaaagaaaaaaaaaagttactctcatgggtctgcactatggatcattttagtgtaatctgcaccctcttgccaaatcacagccctttgaatatttaaaaacagttattaggccacattttccccacagtcagcccaggttttctgctggaaaaatcaccttccattctttaactatcaatccttaaagtttttataaccattcacctttcagctatctagtttgttaataagcttagatgctaatggaccttagcacaatacactaacttcaatgcaacgtgtaagatgggtaccaaaccgtaagatataaaatgggtactcaacagtgtaatatgtttcttaattagggcaccacttttccatcaaaattgtctgagtttttttttttcctttaatagctgcactcactagttgatgatctcagcttttagcaaactaaaattctcagacctttgcacattatgtattagctagatatctccctgtacttattcttgtggatttgaaaatgcaattataggactttaaccaccccctccagatctcccatctgtgttgcctttgcttaaacctttttcttcatccaaaatactcctacctctgctgtgcaaaacactttatcttgggcttaaactcccttgggtccttattacccctgctactgtatcactatgcttaatggagaagatgaaatttacataggaggcaaacaatccaggtttctctcttcatctgtcattacaccatcttactgaagctggtcccttcgttgttcagccttctccggtagacagagacaaatccgtgttacacaagtctgcttattccgactttagtcttgatgagtccacatttactggctcagtgcattctcgctctctctcactcaaattatttttggttttgcaggcatcctttgaaatacacttttaaaatattttgagttgtgaacttttagatggagataggattccatgagggtgcaagggctgtttcatggctttggtatgcagtgtaagactcagagtcaaatgtgtctgggggtgtgtcccaggcccatgtggggcaagccactgtttcctttactaaaatgcagcataaaattcatacctgcctcagaggtcaaggaagaattacataagattaaaaaaataaaatgtttaaaataatatctttatcaaattaagtactcaataaatataatctattaatatattaattatactattctagatataaaatgatcatcaaaagaaatcagaaaatgacaaactctttgctttttggaacacaagacatctggtgcctatgccatttctgttgccaacatttggaatgtgcctcccctctcattgctcattatctccaaatatccaaaccctaccttccctttgatgccaagtcaaaatgtgacctcttcttctgaagccctcattacccctagatttgattcctgctcagtgacgatcttgaaggtatggcatttttgcaacacatccttcaatccctatcatctggcataaacctggatcacagtaggtacttaataaatgtctgttatatgaatcaatgactacctttcccgcagccatcattaatttcttcctctcctgattttgtatatccttattgcacataaatatttaccatgcatcataattatttgtgcatgtgtctcttctgccttgcaggactataaagctttttgagcactccatgtcaaattgacctctggctaccttgcaattccttaatacatactagacactgaaaaatacttttgaatgaattaatatctgcttttctctattgctacagtattttttgtccatggaagttctgtaatctgtaccaggaaaataattaaccataactcacctttgtaggaaaaggattaaccataaactgcctttttctgagacatctgttccataatctaatgaccaacgctatttatacagttgatctatctacaaccccttcaactgtaaaaagcatatggaaaatgtatgttcaattctagaggaggaatattttggctatccttttgtgactccctttatctttgatgctcacgtataatccaccttaaaaggctgtgagtgaggcagaaggaggatcacatcacttagatgagatcttgcctgacaccactagatttgggccttcctatgaaactcccaagtttcagttattattatatcgaaatgacttctattgaacactaatcattcaatggtcagttaatttttattgagtatctctatgtacacaggagactatgtgggatgctatagaagatacaaaacaaactaagggtctgttccctgtttggaaggtaagatctatatatacaagtatatacacaccagtgaaaagtaatatacaaactgaaccctaaaattacagatgtaaaaaaatatataccacagactgggagaaactatttgcaaaagatatatctgataaagggctgtgatccagaatagttgtgagatccacacaaagaactcttgaaactcaacaaaaagaaaacaagatagatttaaaaatgggcaaaatatctgaaattaccaaaatgagatatacaaatggcaaatacatacatgaaagatacatagcatcatatatcattaaggaattgcaagttaaaactacagtgatacaccactataaacctagtagaatggccaaaacctgggacactgacaacaccaaaggctggtgagaatgtagagcaacaggaactcattcattgtcagtggaaatgcaaagcaatacagttactttggaagacattgtagtagtttcttactaaatcaaacatactcttactacatgattcagcaactgaactccttggtatttaaccagaagagctgagaatttatgtccacacaataatctgtacatggatgtttatagcagctttattcaaaattgccaaaacttataggcaaccaagatgtccttcagtaggtgaatgaataaataaactgtggtacatccaagcaatggaatatcattcagtgctaaaagaaatgggctatcaagccatgaaaaaacatggggaagtcttaaatgcatattattatactaagctaaagaaactaatctgagaagcctacacactgtatgatttcaactgtgtgacattctggaaaaggataaactatagagacataaaagaacacattggttgccaggatctagtggggagagagggatgaataggtagagtacagaggatttttagggcaatgaatgtactccgtgtgatattataatggttagtactagtcattatacatttgccaaaacccacagaatgaacaccaggagtaaaccctaacgtaaactatggactttgtgtgataatgatgcaccaatgtaggttcatcgattataacaaattaccactctagtgagggatgttgatggtggggagactgtgcatgtgtaggagcagagagtatttggaaaatctttgtaatttcgctcaattttttttttttgtgaacctaaaactactctaaagaataaaacttacaaaaaaacatatatatgttatgtgtatatatatatatatatatatatacacacacacacatatatataataatacatattttatataccaaagaaagctgattaaaactttgtttagaagtacagtaggaccacagaagaaacaaatttctgggggtactcaggagtttacccgagattacgtaataccaacaggaatcaatgtttcttcagcacaaactgattttggaatgatcgaaacaatgtatatgtactttctcatttaatatccacaacaaactaataaaggaaatactattattatctctattttgtaaatggcttgaaacttattatggtgaataacttcctcaaggtcacagaaccagtgaggggtataagtgagatacgaacccagtcctgtccaactgcacagctgaggttcaccaatatcctatacttccagtcttgggaaaagaaaaaaaataaaaattcagttggacaaaagcaacagaaagagaagtccaggtgggagaagtctgattaacttctggaaactttgcaatctatgacagttttatgattcacttatttttatttaatatttcttcaacactactagtctatctccaatgtgaacagaggcaacagtctttctgttacataagaatcatgtacatatgtatgtttatattcaatttataagcagtctgtctttttaagaagacttattaaggagaagtaatttttcataggatcagtcttggggctaagcaattatatttgctatctttttaatactagtagtcatatttcttccctaattgattattgaacctttctaaatatgtctgaagacatagattgaaattatcctaaggctcgacctctttttttaattgtgactaacaaattttaatacaaggcaaacagcaaaacatggcaggctgaaggagtaatttcttgcacctatagccggagtttttttaaagagctacgcaatttttgttgatcttccactggcttatctacagcaattgaagtttatcagaaagatttatgacatggtattgcaggccctaataaatgactttgggaagctgggaaaactcactaaagttaaagttattatctgaacctcatagggctaattagagatacaacctgaagtgttgagtcagcagtaagaaacacaacacgttatcaattaaagcctccatctaggcttggagaagaggtggggaaaagaaaagatttgcaatgaaaatgaatcatatgtttaaacaccagagccaaaaattagtcctcaaaagcatttcctgaactctctggaaatgtcgatggggtcagctctctgcttaaaaagggacccttccaaggcattctcaaagtaagttaccaaagttgctttgcatatgtataacaggaagatctgaacatatacagatgtgggggttccagaaagcaagaaaaaactctacctcttccccacatctcttcttctgaggaataggcaaaatcttccttccccaacacagctctgtgacactgtcaatttaaaacattttcatgcaaatcaagttaacatttaaaaaacaaacaaacaaaacttgcactatgaatgacgtaaccccttctcaaatactggactttaactactgccattgaaaacagggtggtttttcttaagcatttctgacttgatgctgctgttttcctgagatgcgaccaactaaaaatgacttaaaaatccctgcaccttcctggtattaatggaaagaggtagtggggtgttacagggagctaacttttttcatggttttcttaactgagttacaaaaataacagaaaattgcctctgtgcacatgtgtttaatgtgtctatgcatgaaaagccttggggataaagggagaagtagatattttcagaatgtttgattatgattgtttgtatcagaatctgtttagacaagaaaatcagaactgaaagtagacatatgttaaaacattttcagcccatatccttctgctttcatgttgaaaattgagggccataaaataataaacatgtattagatttattgagttcctttaagtcggcaagatccccagagtgttgtgcaaaataacagcaacttttgaattacaaaattattacatgttcccatgaagattatttaacccagagatgaataaggagaatgggtaataaagagacctgagagggattttccacacccttctcctcaatccataatttaaatacagtcataaactgtgagtaagcaatataagcatttgtgtgcagcatatatttgagcctgaaaggtagaaggcagtgtttaaaaatatgtttttaataaagcctataatacagaatagacaaacaccaaggtaaagatggattagaagaacaagtattaaatgaatacaccttctagcaaaaatcatttcttgttatgtgcctcaaaaaagaacaatcttctttagatagtattttaagcaactgactagtgtgtatgtctttacacagccatagaagagtttcaatgagtacttctcaccgattcagtgagccaaatcataaagcctcaggctgtcagaaaaaaaaaaaaacaaccaactgtaaattttgacaagaatgtgacaaaaatatataagatagattcactagcatttctagagtgaaaaattactagaattggcccacggcctctattgctgaaaaatttaatgtaattactttttttatgatattgtctagactctccagcattggcagaatttttgttctatgtctatgctggaaataaattaaataaagacctaggttttcttccttctattgtaagaactatgtcctcttcaagatgaatgtgattatggtttagcaaatgaatgtgaaggtaaaggtgtttaggagaaaatacaaaagtaagatcttaacgttgtacttaacagaatgtgtccgttagtaagaatactaaaaagcaggattgtaaggaagaaattctccaatgtaaaacagcttgcatgtcttctgggaatcttgtaaaaatatagaatctgattcagtagatctggagtgggcctaagagtctgcattcctcacaagctcccaggtgatgctgatgccgccagtctgcaggttaacaccttaagtagcaaggttataatgtatggggaagattcgtggatagggtcagtcttttaaaaatctttaaataatttgaatgtaaattatatgaaatttctctgtctcctggtttcataagtgttttcttttttttttctttagacaaaattggaatagcagtttgactatgacattctaattggtgtgtgtttcagctagaggaagattataacaaaagagtatttctccaaaataaagttttcctttattttgcttttgtaagtagctcaacaaaaaagagagtgtggctctgtgtttgattttacttcctttaaattcaaaagcaggcactaaaaatacctttgaaaactatagtaatgaactactgtggtactaggctcaagaaatctggggcgttcctatggacttagtggcaattgaagcagtcagattttcagatttagctgccatcagctgtggattggacagtgacatagtctaggacagatgtcaattttagccttcttctaacataagtctggaatacattttaattcaccagcaggaaggattttgttgcatgtaagttagagtttaaagccaggtttatttttgtttgggaaaaattctgtgcatctcaaaaggcacaatacctgtgtgttaacctgtctttttttttttttcggttggtattacagaattgctgataaagctttacatttacattggccagtagactagaacagattcctcacgtctctgtaagagctttgtgctgctcacttgatccaagttaaaatctctccacatcttaagttgaaaattaacatacgggaatttaatcctgacatagccactgcatcaacttttgtctagtttacgctttgccagaatgtcttaccattatgtgtctttatcttttggaaggctaggtatattgaaaatcttttaaaaataattttaagaaaagaatgtaaacaatagaaatttattcactttcttatgggacacatttcctgccaaatgctccccacaaagtaaacaccttagggtcttttttatttggaaaatgtaaggagatacgtaagtgtggatatagattcttctaaaatgtcctaaaagaaataaaattgcaagttttcctttgtctttcatcagagctttctttgtcatgtctaaagccccgcggcagggattagggagatgcaaaaccttactgtaaacagggaagggttgaaagaaaaggttcattaaaaaagaaaaaaaaaaaaactatcatttgaatgtaatatgtgaaaaatgtttcttccaggttgagtgaaaaatatactaaaaaagtgtaatcctagcttaagagattttgttttaaaatcctaattctgctaacaaggcaaaaggaacttaagatacggatgtatataaagcctcccggttcacccatcagtctttgaaactgccacacctaaactatctgttttagtgccattctcctatatttactccagtcatttttatatttcagttttgctcttaattttttttcccaacagtattcaagaagaaggataccaaaaaaagcattcccataagtattgtaaaaagtctctctcatgggtttgtttttagaaaaatgttaagccatgtttttggttcagtggaagaaggagcctgtgatagttttaacacgtgtacccaattagttgttctggacttcagcaaatgttctgcttggagcagctgttaacagattcttgctctattgttaatcaaaaagccaataataaaaaggcaaattaaaaggcaatttaatattatacttgtaattattcactttgtttctcatataagtgcaatctcatttcaatgcaatgctttcaaagaaaacatatataaggtagaggaaaatatcaatataaaattaaaattttaaaaaatggtactatatacacctttataaaatatgactagggaactccaaaaaaatgttcaaggactaagttccaaatacatacgtatgcacacacaccaacatgcacacatgcacacacacataaatgaatgcatatattctcaggcaaaaagtagaccttaggcccagaaacaagatatttgcaaagtattgatcagaatactatttatagtttatttttagggataaacacattaatgtaacttcatcttcaaaactttttaaaaataattacttttcaaaataggcaatgtgctatgcaatggagacgcatctatctacaacaggaaatgaaagtacaaacatccattcccacagtcttagattgttgtttaaatatagatatatatttcattaaagtataaaaattaagtcattgacctttactgatttgataatagtacttagtctctatttattaaatattgtcatctttctggaatttactataatacataccggttaagttattaaaatttaatcttttcacatattattaaacaaaacctctcacttattctgtccttactgtggcaacaactgatgccacaaaagttatatttccactaaagcattttaagggaattttgagtaagttacttactgatcatttgatgagatctgttgactaaatgtggctttaattgctgatacttgaacttagagtgcgatactaacaggatttattattcactaagcacttacaatatgccagacaatgttttaagcactttagttatctcgtctgtttttttgtttattttttgagaccgactcctactctgtcactgaggctggagtgcagtggcacgatgtcagctgactgcaacctctgcctccgggttcaagcgattctcctgcctcagcctcccaagtagctgggattagaggtgtgccaccaaacctagctaattttttgtatttttagtggagaccgggtttcgccatgttggccaggctggtctcgaactcctgaccttaagatccgcctgcctcagcctcccaaagtgctgggattataggcatgagccactgcccactgcgcccagccttatttcacctcatttaatccttacaattactttaaaaagtaggtagaataataaactccattttacatatgatgaaactaaggcacaaagaacaatgatcacacagctagtcagtggtagaactctgtaatctgtgggttccacatctgccagaggatgtatgtaagtgatgtgcaaacactactccattttatataagggacttaaatatcaacactatggattttgttgtgtgtctgtgtgcaggggaatgtttctggaaccaatccttggaggaacaactgtaccttatacactacattgaaggctcacaataaaagtctttcaaccaggagaacatagagtaagatacaaaactgtgggatatagactatgactcttttgattagtatggaagaaaacatcctagtattttgttattggaagaaaacatcctagtactttgttattaaggattagcgagattgaatcattgatgtacttacagcaaatctaaagtaaaccatacaaaatagaactttcctcaagatgactagaggtcaataaagctatgggttatttacagtgtaatatgaaacagcatacaaccgcaagggagaaggacatactaaataaacaaaacctgcaaaggcaattttcttcagagaatctcctcatgtacaaaaatatatttcaagagaaagtagtatagttactgcgttttcataaaaagtctgtttggtgataacatatgctgaatacaactaaaggcagttcttcaagtctaggcagacaagctgcagtacagcagatacacttgctgtttaaatatcccttcaaaaaaaaaattccatttgtttaccaaaatctattcacacttgttgaaaagcatctttcttcacttatctgaatgtgacaatgaatcaaaagtaccttctcttctgttaccagaggtgataagggagaaactgagatcctcaccagaggctgaaagatgtcttttcagtgctcttgaaagcaaaggctaatttttccaaacaaaaatttctccctaaggagctgtattaatgaggtccaaagtaatgcttaacccttgactactctaattaactcaagctgactggccagaagccctctttcctgtggcctatatgggagagatcacaaaagtgcatggtaaccctatccccacttgctgttttcacaaaacatggggctttgttctttgtttggcggttgtgaagacatttcagtctcatctgacatcacctcctcacatggaagaagtgtgcatagaaacacctagcagcaggctgcttgtctcagtgtgttccataacccttgctagcacaaagactcatttccagctcccagaggtagcatccattaacacatgttccttgagaaatctgacttttcttttcaaaaatgggaacgagtgtattcttgctatacttttttccaaatgctccaaatacacaataaattatcaagtaatcaggcctagttatgcgattcccagctttcaatacaggtatattagaggaattcatttattcactcatttgtctagcacatctattgaaaaccttctacatggtagatacaaggctaatttggtttcattgaatctttcctaagcaattaagcccagaaaaatttgtcttctctctgtttgctagagcgatagatactaaagtatctataatactcaatttattagtagtaaatttaaaatgtaattacatttatttcaacttacatttaccaatgagtacctttgatatgccaggcacttttctaaatgccagggatacagtagtgaaacaaacagacaaaaacctctgccctcctgtagctttaattctacaatggaggaacagaaaataacttcaataagtgaatgaaatatataatgtgagagagaggtaaaagaagtgagcaggtggcactgaaagagtggacagagaaagcctcactagaaaggtgaacttgtaaagatgaaaggaggtaacgaaccatgttaatgtctgggaaaaaagcattcagggcaaggaaagactacatagaaaggcttggaggtgaaagcaaacatggtatttggttggagcaaatgggtcatgtggttggaggaaagtaaataagggttaaagtgtgtgaggggtgcagtcaatggtaaacttttggattttactctggggaagataggtactcattagaaggttttgaacagataattgacacagtctgatttagggttttaaaaagctcattctcagagtctttgggaataggttgaaaagcatctaaaacacaagttcagagaacaattagcagactattgaaatactatgaagtgattaaactttattgaattttaattataatcaagcacattatggtagaggcaatgagatttactgatagattggatgtgagatgcaggatgaaggaactgcaccttgaactcaagatgatttcaaggtttttggaaaaggcaacaggcagtatgaattgctatcccttcagatggatattgtggaaggagtaaattttgaaaggaatatcagattaattgttgacaaccaaaatttgtataaaatcaggtaataaaaaggggatgtgagtttagaatataaaagtaaaatgtggacgtatcacatacagatggtattaaaagccgtgagagagaatgggatatccaggggagtggctataaatagaaaaaggaagaggcccagacctgagctctcagggtattgaggaagaaccagagaaggagaccaaggagaaagaacaggaaaaacagaagaaaacccaggaaagtgtatagctctagaagtcaagtgaacaagtgttttgctgaggagggaatgatcaacgatataaaatgctgcttgtagtccatgaatatgaagactgagaattgacattgatggttactgttcaccttaataagaatattgaatacattatttacctaattaaattctagactcctggtagtcaggacttgtcttaagcagggaattgagactgagtcaaatttgaaagttattttatacttaagttgtctagaactctgaacatcatttttcatatcacatacgatatttcattatagattctagtgacttctcaagaaagcctactttttcccattgttaatacgtagaaccagaccaaaataatagaaccataaaatgttaaagtatccagtttggtgattattacaaatgcatacagttgtattcaccatagcagcaacatataaaatatttccatcacccccaaaacttccattgtgccctgctgtgctcagttcccttcctccaccccaacccctgacaatcattcatcagacttacctccctgcaattttgacttttctagaatgccttagaagtaaaatcatttaagaatttaacttttacactattatttaaaaataatttcatcagtaaatatataccaaccataacttaaatgtttaaaatatatcttttcttctcactaccacatctttagtcttaaaatggtcctcagagatcccagttcctcctgctgtgaccttagcttctagaagttctttagcccctttgagtttataaatacattgatttataattcatcatacatttattaataattatttcaaggaatagtcagaactcatttgcatatatatacaaacatagatatgtatgtaagtaatatgtatacaaacatatacatgtacgtacatgagtaacaacagaaaatgagttctgactactccttgaaatagtaaattattaatttattgttttggaactgtctctaatcctttatattctgaacactgagcacaataacagtaactgtaatggtcctataatcaattattgatatgtagaaaatgttgcagctacattacctatgaaatcacaatgttacttctcagtagtcctaaatttcagaagtagcatttgaatgtaaaaattggcacatttgaatacaatctatataatctttgtcgttgttgctgttgttgttgttttaattcagtctcttagtaacacagaaatgtatttccagagttttccctcttatgtgcctttaagcatataagattacacatctggctttgtaccaaaaacagggcccaacaggatatgaaatcctggggataacagcaacctagctatttctttttcaagaatttttttcaaactgagccagaaactgaaaagacagatgaaaatggcacaacccggtgacaagagagcaaagataaatcacgtttccttccataaaaacattaagatcttggctttaatattaatatttttggttacagttaagctttaaagttaatgaaattctcatttgtatgctgatcttgggacatgaataccaagttgtagatgggatagagattagcaataaagaaaattaaggaaaagaaaatgaaaaattcccatagagtttaacatgcatacacatatgcccacactcatatgtgggtaatatgagagaacctgcatattttttggaggttgcctttttgcaggagttgaaactattcatcattttgctgcactttcctgtggtataacctaactaagatttttgagcaaaagatagtttttgtttttggaaaattatgagtaacttatacgtgacctgtttactccattaggaaatatgctgttttattcaatggatcataggaacagaacgaagcagaacaatagcaggaaagaaaaaattacagtcttagaaataaaaacgtatttcatccattttggcaccaggactgaattaaaatgctgccactaggcaggattttaaacatacacccttttcggcatacaattttaatacagaaattgagatattaggcatgcagcgcatattagaacattgctctttctgctgcaggtgtgtttgactgaccctgaataaatgtcaagaaaaacacctttcctatcttttttttctggctataattcaccttctcttaatatttaactattgctccatcattataacaggcactctgtttaagtcgtgggtacaggtaaaattcagcagataaaaaataatcatattggaacatactaaatgtaatggagatttttggttgagaaaaataattggtactgctaatataactgatatagtcatcatatttcctatggatttacaaaaaaaaatttaaaaaagcaagtaagatataatagaagcaaaaataggaggtgaataattttctgtctttggaatcagtgtactttattattacacattcattctaagcctacgtcagaaaatacttgaagcaaataaatagagaacagttttcttttcttttttcgtcccttttcttcaagagaacatctcattaacattaacagaaactgtgcccagaaaaagccattaacattaatggaaactatgcatagaaaaacccctagattagtttttggtcttttaaggagcttatgcattgctgcctgtcccaaaaagacaggatgggaagatagtaatcacatttttgccccatctttttaaattatatatttcattaaattatatttaataaatcctgagttggaaacagcacaaggaaactcaagctgcaataatatttactctcccaataaacctggagctttcacaaaccatgtgtcttactgagagtcactgaacaagttatacgaccatgattctcatgaacatcctctttgtgcttgcaattaggctgcctgccaggagttgaaatgattagcagtaaatataaatttaatagctttgctttgcagttccccagtcactcttggtgcctccattcactagggagataatgtgaatcagaccctatcaactaaacatacgacaatagttgaatctgaattaaatatgagggaatcttaaaagggcaaggtaaaataaaaagaaaaattaaaatatgttctctatttaatagccactttacatttacaccaaaacactgcgctattttttataaatatcagccaaactcaaagtattagtacataaatcatatataatctaaaatttttaaaaacctgataaaaagaatgcttgaaaaagtataggttttcttttttttgtcacttgaaatagaattgtgaaaaatatttacatttcaaatatcattttgcttagctgttagagttccttagagttcggttttctgaaatttaccaatactttctcatcctctttcacatcatcatcagggctccacaggaaactgtcaataggtatcaatttaatgtgccttctttactaggtgccttactatatgtcttatcacttatctctcaatttaggagacacaaaactagaagacagcaatgaccaggaagtcttgtggctatgctgtagaatgatgatgacgtatataaaatatggaaagtctttatgctttgcttttgttctcatcagaaatagtccctaagtcttaaattgtgataaaatactccttcacattttctttcaggtacaataaaggtcagataaataagaagcaaaagaaaaagagtcagggaagagaagaacagttttcggcttagcctgatggcaaagggcttttaaacactcctcaaggaacattaagcaaaaatgagcctactgaaaacaactttccttgattttactccccagttactttcgttcttctctataacttcccttatcctttcatcatagatgtcttccttcatcactattcaatatttaaaacagctgaaagattggttactgggtaagaaaaaaagatacgatagctaccaggttgagcagagatatctttgagctctaccatgatagctgagatgtttgtcctgctcagcactgcctggcacatggtaggagctataggtgaaaagatatctctgagaagatatgagtttgttggtactagggcaaagcatggaggaaaaaagaaaaaagagatagagaaagaccatgagtcataatgacatctttcgtcccttcgaaccaacttttcttgagtccatagtattatatgctccgatgctttagccaattaagttaaatccatccttatgcattttaaagtattcgaactaaaataatatcatcaggaaacatgtgagtaaaagaagggccacctcattaccttttggcaataaaaggcagagtttaaattataaatatttacagaaatatatacaccaatggatttccaagaaaatgtgaatgatatgccacttaggaaaataaaacgatctcccagtataaaattaatctcactggaattgctgaatacacatctgatgctcaaaaagaatactccaagaaaatataaattgtttaaatataagtcttaataagcaggatgttaaaaactaaataaagtgacaggggatgcggtggctcaagcctgcaattccagctctttgggggagctgaggggggtggatcgcctgagatcaggagtttgagaccagcctggccaacatggcgaaaccacatctctattaaaactacaaaaattaaccgggcatggtggcgggcgcctgtaatcccagctactcagagggccaaggcaggagaatcacttgaacctgggaggtgcaggttgcagtgagccgagatcacaccactgcactccatcatgagcgacaagagtgagactccatctcaataaataaataaataaataaataaataaataaataaagttatgatgaataacaaatcaaacggaagcaaactgatcctcaaggtggtaaaactcaagaaaaaccctatgattttgctgatctcttagctgatgccacagaaagccaaacacaaacaaacaagagaaattatcctatctgaatacatcagttttatgatatttatgtaactactaaagcatttttttttaagtataactgatgcaaaactggaggaacgcaaagtcagctttctttgatcaaagctcctataacttctgattaaaataataattggatatagttcggactactccacatacattctttcactgaaattggacataatttagtgaagcaagatgctgagaagtctactgccttggcagatttccactgaaatatgtttaaaagcatagtttttctccacatggaaaataaattgtagaaaattaaatgtgagtttatataggattactttttttaataaaataattatcagatatccaaaaagggaagagaattagcaagttaaagaaattttattttgcttgaacaacaactaagtttcataaaccatgctccatgtgtcctaatataaaaacaaaactattaattttaatgtacagggctatgaaatggaatttggaaattatgttgctagaccaatttggttcctttaaaaaaggcaatctttatagatgcccagcaaaaagaaaggagggcctatttagagccatgttagaatcatgtactgtccaggtattaagaaagccactttggccactccaaaaaacaacaataaaattatttactttaaggcaaggcagaaagtctccacattaaatttttgaatttttacttgaattgactccaaaacaaatcaaactgaattacagttgaaagttaagtgaagctaaatataatttatattttctatatcctattccaaaacaaatattttctatgtaatactccaaactataaacgccagacactatgatcagcacatgttatctcattttttcttccataactaatatataagcaggttattattcccgttttacagataagaaaacctagagactgtaattaagttttcaaaggcctctcacagttttgtcgcttctttccactgatgtcctccctagtcttgttctgatgtgtgcaggagtaaagatttctatttttccatctggaggaatttcttagtggcacactccctttaatctgtgtagagagctcaaaatttccctcaattctcttgatccactccaaaataaggatgttctgaagatggtcacagacaaacaagcagggggcagcttttggtagaaggagcaataatgtccttcttaggcatcctcttctcagaaggaatcaacatgtagcccataaaaaacagaacccccatctccatggctgcttcccagagctcagagaaccaatccacctcctcaagtacaagagcagcaaaagaattggggttaaaatcttaactagaaattaaggaggtatcttctacttaagcagatttcaaaccgtgctccaaggaatgctgttacataatatattctatattctgcctctattggaaagaaaaacatgcaaacaaacaaacaacatcccaagtatccaaaaccaaaacaaagtactctgcatgtgagcaagtttggaaactctagattaaataaagttcagcttttatactgttttcattattaaccatttatatgttaatcagcattatgacctccgaaaaggctttaagttcatttatcatctgctgaagtagttcggaaatcctgcttcatatatcctccaggtgaagacttgaaaagagcagctgcagcccaaggcatttggttgaggattcagggacttggaaggccaattcttttccggatgtaacgactaataatatttaatatacaattttgaccaaaaatatttttgcatgaacatggcctaatgtattttacttaagtatatctttattggtaccatattaagaaaagcttattccttcttgaaaccatgtttaggcatcagttgagcacctctgaaactcattttaattttgcaggactctcagattattaggaagcaaatattcaatggggtcaacttagacaagatttccaaaaatgtgttcctcagcttgggttgaaagctgtaaacatgttcattattaatcttcaagagaataatatttatgcggcccttttccacttaattaatcattaacacctttgtcccagagcatcttaaaaggctagtgtttcaaggactatccatctgtttgaataccattgataaaaccttactgtttaagtttattcaattatcatgaataatgaattagagttttctttggtcagtttatctcttcaagatatcactaagctcagtcttgtaaaccctaacaaggtccagttttgaactagttacaatttaggaggtttaactgtcattaagatgcgaatgactcttccagaggacatggaccttgtcttgtacatctctgtgatctccaaagagctgtgcacagaattgacactaagttcaataaatgtttcttcaatatacgaagaaatgctctgttgccacttaaagtgcagagcagttttcatcttcaaagcactttattcacattaattcagctatttacattttgctgatgggtaaacggctggagaggctaaatgggctgttttaaaggctagagagagaaaatcctgcctgtcaggaataaaaatttgcaattactgattaccagtcatatgtccctggacttttgtaggaaaaaaacagagggacaaacaaaggccacctaggtagtggttatcctactgtcaggacaagtcaatagcaggtaaagaaacaagtacactagacggtccaacagctctattgaacaagtatgggggaaaaaaagttatttttgttgtggttttcagtgagtgtgtgcgtgtgtatgtgtgtgtgagcagtgttgatacacactgtgatgcagaattacctttttccatttgcaattctaaaacaacttccaggtgccatgtgctgtttacaaaggaattgaaatacatttgacctcaagcgtattttgctctggcaaagtgtgctaattgtatagatctaaaggcagcagcaacatcatcatttcaaaatagacattaagacaattaaaaaccccatgtaactctactgcaaagtaaagttctcatggagactgtgaggtgtgtacagatatgctgtgtcatacgtttctttatgcgatagtttatgtcccaaaactctttttttttttttttttaagatggagtcttgctctgtcgcccaggctggagtgcagtggcacaatcttggctcactgcaacctccgcctcctgtgttcacgccattctcctgcctcagccttccgagtatctgggactacaagggcccgccaccacacctggctaattttttatatttttagtagagacagggtttcatcgtgttagccaggatggtcttgatctcttgactttgtgatcttcccgcctcggcctcccaaagcgctgagattacaggcatgagccaccgcgaccggcccagctcttatctttttaaaatgacttttttgatgtgaattgggggaggacagagacaagacttcttggccatgtattgcttcagttctcagttgtgtttctctctattccttggaaaccttgactttcttccagtagcttcctggaaggaaaatttgaggaaacgtctaatgtacatagatactgtgtgtatagagaatagtccagttaggaaagtactctatgtaagttctgaaagtctggatttagggtcttttttttttttttttaccttgccatctacttctttccaccctgctaaaatcttagtaattaagtcataagagacatcttccttttatacccaaaaaaacacttgatgagatagaaaggagctgcgtaacattatacttcgtttgggtgtatcttaggaagagatcctgttcccttaggaagtgcaagggaggtggtgaggacataggcaatcaggaccaaaagtgtaggtgctattctaaaagcagtaatttagtagtcaggtgtcagatgaagacagcaaaaaatgcagttttgagtaactggagatggcaaatccccatgtagctggcttaggcttgaactggcaggtacctgacattcaatgcttgaagatgtagggaaagtggctgaggcagagtgctgggtaagggcaggactgagttggttggaaatgggcgtaagtacagcctccagtgtggaggttgctgacaactcagcaatctggtttcagaggaggtctgaagaaaacttaatgcaagatagtttgttagatcagaacaaccactgaaaattctccagaggaaataattgtgcttataacataggtggagtagatatgccacacccatttgacacccaaatcttcatcagcttggatagtaccagacagactcttctttaggtccacagggatttttttaatttctgacaatttctagattctaatccaaggtgacaactcaagaaaaaaattagtaaactagttgtgttctggaaaagaaaaataaattaaagccacagacaagggagaagaaaaacttctatgcttggccaggtaaaggcaagctttctctaggaagtacttatagtcacataaatactcaagaaatcatagacttctggagcaagaagggtcttggttatcatctggactaacagttgctattaacagattaaaaaactaaagccatgaggaattattttatgaaatcatacatctaactgacaaaatgaagactaggatacatttatttgcttgtgtctaatactcctcttcaatttggaaacctccagtgaagcagaacacctaataaaagttaattaggaacaggtactgctgagaccttctctaaaccccaggagcagatgcatctctttcactcgcctggttacctgaatgtaactaaacatgccatctgattgaacaaacaaacctattcttgtatttcctgggaagatgagcccctggatatgaaaatctcacacttttaaggcaaaggacttcaaagtagtccaagggtaagtcaatcagtaaaggaatataactatagacatgcactgtgtgatctggtgttaatctagaactatgacattttttgaaaagcaacaaaaagggtgttgaggtatagctgccaaaaccaattaaaagtaaccagaaaaaaaaaaaaaaaaaaagagaacactaagcaaacaggttttccctcaccatatttctaacagaaatgcatggccatcattaaggatattctgcagaacctattcaagaaagactgcacgtggtggataaccaaataaaatttccttgtacagtcaatgtcttggcatgcaatgggtcccgaggcataaatgcaaaccattaacaaagctttattaagaaagccttcaccatgctttgggaagatgtttgatacaattcaggttaagtgctgatcaataacctggaaatcaaaagaaccgatcacagaagcaaaaaaagcagatttaggcagattcccagccccatcccaaatgtgagatactgacaccaagcataagaaatcatcgctttttctctcccctccttcccccatcacacataccaatgccttttcctcttaagtcccctagctgcaaatatttcttagtgaagtctattttaccccttttacactcacaaactgagtcgcaggttgtacattttgtgataccatcattgatgaaattgatgaaagcctctaatggcattagaaaatcctgaaatagcacggctgatatatacctggcaggtaattgcttaaaactccagcagagatggatgtctaatctattcttaaaaatatgagcagacagatagcagttcacccctccactgcctctttcttgttctcccccaacaattctgctagttcatttgagtgtttcagacaagaaagcaagaatattatgcaccagaatataatgtggcctttcttgcacagcttctctttgcaatcccaaagctgccatttgcagcttcaagcaacagaaaagcatgcttactgttacttaagattaaattcttgataataagcagatttattgactcatgttttgaatacatatttattgaggcactctactagatgctgggcaaagtgataaccagaaatagccagccagaaacactttccacaagtcattaccagagatttaagccacagtaaaaaggtggaggagaatagacgaaaggttttagggggaaccccatactcaaactctccctcagaaaaacaattattaagtcttttcttacaaactgtagagtaaaagaagctgcccaatcgcggtggctcacgcctgtaatcccagcactttgggaggctgaggtaggtggatcacgaggtcaggagatccagaccatcctggctaacacagtgaaacccatctctactaaaaatacaaaaaattagccaggcatggtggcgggcgcctgtagacccagctactcaggaggctgaggcgggagactggcgtgaacctgggagtcagagcttgcagtgagctgagattgcaccattgcactccagcctgggcgacagagcaagactccatctcaaaaaacaaaaaacgaaaaacaaaacaaaacaaaacaaaaaaagaagctgcccaataatgtctgagcaaaatggaggccatgattattttggctgtagtgttttagactttcatgtaggagagaaggattcgctaattggttttcagtcaaataattctactgaggaaaaagaagtattcctgaaagaaaattgagacataacatggataatgtaaagcctatatttaatcttggtcaattccattgtctcattttcatgtagatgtcaaacataccagcaaggagaaaatggttcaaaaatgcaacccagggaattgccctacttttcctacttgcccagtcttcaatacaatagatctttattctgttctcattttctctaacaaaatctccttgttcggaagagtcaaaggaataaatggttggaaggttaatctcctaattactttctcccttcataaaataatttatttaattgtggaaattattatgcagctgtagagggagagcatattcattttttttcaggaagtagttgagcaagcctgacttacgccaagagaaaaaataaaaattcctgagaaaaataacaaattgttcaaaatgagctgggttaagtatccaaaccaaggaacaagttcatttaaatggttactcaggaaatcttgacggtgatctaaattcaaagttgcttttgtttttctaggaggcctggcttacagaaagaacatgataggttcctaggatatatcttaattttgtacttcatttaatattgttaaaataattttgtctctaatatcacagcttgtaatatctcaaacaacactgattactgattggtaatgcaccatactctaacagatatttaatctctatcctctccttccctagaaaaggtgtcatggaccccgggatgtattatacattgcttatagcattttgctgcaactttaaggcaaaaagaaaaaaaggtctctgtcctaatcaggcataacagccatgaaatcctatgtgcaaattgaatatcaaactaatactgtttttactaaccaaaatccattatctaaaagtttgaacaagtgaaaaataatttatttatttgttatggtcccaattaataagatgagaaacttaacagaataaacatatgactatccatttgtacacatctaggaatggaaaaatgacccactttaagtacaaaaaaatgagaataatctataaaaactaatgaatcagtccctttaactttgtttattggaattacaatatcaaagcatttctaatttgggttaagtaaaacatacaccaaagaatctatagacagtacttacaacactgtcagttgagtatttggctttgatatagctttgaaaggtaaaagacaaaccaagtagatttttttttacttggggaagaatgtgagaatgtgttaagtagctcagagtaatcattccataatgtgaacagataccaaaacatcacaatctaccccataaacatataatatataaaaatattatttgtcaattataaaaagcctatgttaattaaactcagctgaaccctgatatatacaaaccagtgatgcaaatggtgttcaccaagcgcatactcttagttggtgagcatctgtaaacatgctcgttctcagcctacagctactaccgtttggagatcacggtcagtaatgatgaccagtctagggaaagttcatggatagattaagtcactgggctagtatggatttgcactgaaattccaagcaaagcctctttcatttagtccaaatcttgttctacttgactgcaactagatttcccaatagggtctgtcaatcaaaattaaaaagaagaaatgtaataactttaatttctttctaaatctagagtcaggacaaaacttctaagtcattattaactggtactctaccaagaatatagctctcaattattcatttcagttcttaattattccctgtttcaaaaaatagcctgcctgccgctcataaaatcattagctggagagaaaagtgggttcaattttgattggaagtaaaagatatggtaggatgtttgtgaaataatgcttgaaaagtaatgttttaaaaagaaaaaaataaaaactttgttttgttgtacttcttgtttatagctttcatgtaaaacaaactatggttgtttcaagatggagcctcacgttcttagatttggtatgtacaaacaatttctcctttgacggaaaatgagacattttactttgccagttactttggtttacttgactggacttgtataattttaatgcaagctaagccaattgttttctaacaaaagctgtcataaaaaaatttatgcagccttggaaatgtaaacgtaaaaaagaaatgtaaaaaagtaaaacgtattcatcattttcctgcaaattgaagctaattacacttagaattacttgcccttccacatatttcatttacaacccatatgatcttctcagagtctcatacttaagttaataaattcagttggaatttttaaacacatttataagtatgtatatattggaaatagcaccacatgtaaggcatctctgaattttgatgagttgggggttaggtggggacattacacaattattctggtttctaagattaaaaaaacaatcttcctacaagaaaataatgcaaactgaagagagagagattctctaccactcttgaagaaaactttgggccttggggctgagaaggaaaagtaactcaatgagccatttgtaacacattaacactaattcttaaatgctatttgtggttaaaaagagatgaaatagacaaataacctggaaaaatctgtgacaatagaattcaaatgtaaattatcatgtctcactgccccgttagctatccaaaggcaaaactccattatttcattccccttctcacatctattacttattttcctttctcaattagttttaattaattgtttcttaaagtgtacttacacatttaacagtggttactgtgggctgtgccgccctctgattattagtcttgaagccatcttatgttattgttccattcctcacactcaaaaggtccccaaagaacaacctcctgaagttaggaccaatggtccctttagtttgtcataaaaccaaagtgatacatgtgtttaataacacagaatgtgtgccataaaaccctgatttgaatagttcttggaaatgtaggccaaagacgtcagatgaaacgtgccaagttgagaggtgcagataaaaggtaaaggtttattttgtaaatgtgtaatattttgatagtcaccagggaagaaataatgttactgcatgtggacgggcaaggtggctcatacctgtaatcccagcactttgggaggccaaggtgggcagatcacctgaggtcaggcatttgagactagcctaaccaacatggtgaaacgccatctctactaaaaatacaaaaattagccgggcgtggtggcgtgtgccagtaatcccagctacttgggaggccgagacaggagagttgcttgatcctgggaggcagaggttgcagtgatctgagattgtgccactgcactccagccaggcaacagagcgagacttggtatcaaaaaaaaaaaaaaaaaaaaaaggtactgcatgggccatcatgtgaacctgaactaatgttattccatcacgtaggatgatggcagtcacatcattaatctaaaatattcactagtttcttgcaaggacattaagtagacagattcaacaattacttttgctagataaagttagggcaaaagtatgacggacagctgaaaagttccattcttttcaatgtcccagcagataaattagtagcttaccagtaacatcaagcattttaaaaagagaggaaaaaacaaaacaaaacaaaacaaaacaccaccagtaatgatccagtttaataacctcatatatttggcttggggtaaatatcaagtggtgctgatcagtggaattacagatgtaattggaaatgttaaattttcttcttactcgactagtcacatagactattctatctatactaaggaaacatttataagattttttgcaaatcgacagaaaagagtcatcaaggaaaaaatatgataatttataattctgtttgttttaatgaggaataatatatgtgggagctgaaaatgttaaaatatatcaaatatttcaaatataacaaaatatttaatcaaagcaaaaattagttttttttaaagactgatacattctttcacctccatttcaatatatattaactctcctaaagcaaattagttaatacacagagcatttttaaatgaattataaggatagccattcaagaattgtttatcctggaaaaatatcagtcacaaattaaatgtaaaatagtgagcaaatggattaaaatatatacagcatgaaagattgctttgtctcttaggacttcacactttaaaatgattattattaacattgaaatgatttatatcagtgaaggcagacatacacctgacttcagggaccaatacaatagagagtatttttgaaaaatgtatattctctagacttgctgatttaaacctcagcttgtgaccaagaattttcatttttcagaacctgaccatgttactcttcttatcaccgaaatctgataaccactgcagtaccaacttcaggatgttcctagatacctttggatatgttaaaggaatcctaagatggttgagggcactccacatttatctaagcctttagaacaacaatcacaaagtccagtgactacagaggccagactttaaaaaggaatagggagaaataaagtattgccgacaggagagagccttccctgtttcaaggcagtagcaactattcacttccattcgatactctcctacagaaatgtagaccactttgttcgatattctgagcttttttctctctcttttttttttttaatagtagagatgttgatgtttatgtgaaacattctgattttcaaatgttggcaaccagtttcgaatattttcagtgtgcaaccaagcactatgcttgcaaataaaacacaggtatgggaaggctctgactgaaggacaattaatttacaatatctgattgtggtaaactatctgaaagatatagaatattatgttctgcatatatatgtgttcgtgtgtgtgtgtatatatatatataaaacaactacaaaaaattatattcatatgtatatacgtataattttcttctttctgtgtttacatatataaagcacagattgacaagctggcttattaatactaggtgtagatattttgaaagagataaacaaatagtattgaacgtatctaaacagacagccaaatcaacaagttgaatggcaacaagtaagacgtacactctatgacagtgactaaattaaccaagagttacagataagagagtgattagcatgcgataagaacattatagaggactacctagagaaggcaaggtttaaattgggccatgtgctgggaaacctggatatctatatgcagaagaattacattagatccctatctctcatcatatacaaaattcaactctaaaaacaataaagatttaaaggcaagacctgaaaatatgaaactactagaaaaaaacatagggaaaacactctaagacattggtctaggcaaagattttacggctaagtcctcagaaacacagggaacaaaaacaaaaagagataactgggactgtattaaactaaaagcttctgtataccaaaggaaaaaatcaatagaatgaagagacaacctgctgaatggaagaaaatatttgcaaactattcatccaagggactaatatccagaataaacaaggagctgaaacaattcaatagcaaaaagccaaataaacacgttaaagagtggacaaagaatctgaaaagacatttacttaaagaagacatacaaacagccaacaggtatatgaaaaagtgttcaatataactaatcatcagggaaatatgaaaatccaaacctccatcagatatccttacccccgttagaatgtctaccatctaaaagacaaaacagatgctggtgaggatgtggagaaaaggcaattcttacacattgttggtggggatgtaaattagtacagccattatggaaaacaatacgtagatttctcaaacactaaaaagagagctattacatgattcagcaatcccactactgggtatttatccaaaggaaaggaaatcagttcaaaggaatacctgtccccctatcaccatgtttgttgcagtaatattcacaatagcaaagacatggaatcaatcaaagtatccgtcaacaggtaaatggataaagaagtggtggtatatgtacacagtggaatactcttgggtcataaaaaagaatcaaaacctgtcttttgcagcaacatgaatgaaactgaagggcattatgttaggtgaaataagctaggcacagatagacaaatatcacatgttctcacacatatgtgggagctaaaaaagttgatcttatggaggtggagagtataatgatagataccagaggctgagaagggtgttcatgtgtagaaagggggtgaagagaggtaggacagggggtataaacatacagttagatggaagaaatatgttctaatgtttgatagcacagtagggtgactatagttaataaaattgcattttatatttcaaaatagctagaagagaggatttgaaacattcccaacacataaaaatgataaaagctcaaggtgatgaatatcataaatccccctgacttgatcgttacacattctatacatataacaaaatatcacatgtacccagtaaatatgtataaaaatgtatatcaattaaaaaaatcaaaccatgaaagctaattaagtttaaaaaatgatttcatataactttagtaagaaatactttaaaattccttaatgctaaaaaatttatcagaccagttaatatataaattttagttatataagcatttaaaaatttagaaatattaaaaactggaaataattaaaaatcaagataggttggacttaagaggtgtggcattaagggagatcagatacaacagactgagcaaaagcaagaaggtgagaataaagcgaaacccaggcatagaacctacaaagaatacagtaagaagtcaccagaaatgtcaagcagactgtttgccagtctgaactatcaccctatccccgtaacagaattccatgaaaaactaagaaaaaataatatgacaaaatatatgttttatttccttctttatgagcctgtttggttaacattttataccatgcaatgttaggttgagaactaaaccaagaaatatgaacacaggaatggaaaatagaaagaaggaaagaaggaaaggagaggaagagaaaggtagtaaggagggaaggaaggaatgaagaaagaaaaataaaagagaatgaggaaataaagaagaaaaatgtaatgcaccatgaaaaggagatacatatacaaatatgcaaagggacatgcagaaaagaaacattgaccaattaatctcattaatgggtacagctcgaaaactaatgtgcttaagtacagagggaacaatttaggataaataatatgaaagaactttatagttatgtaagaacactcaggcaatggatcatgctatcgagggaatttagagacactcttggctggaagacactaatttattatgcgctgatttaagtataattaaaatcaacctagatattaaacaagggaaacgatatgtaacttttagatatccatttattacctaaggacagagagagcagcaaatgtgcaaatgttctacagccagattaatcttcctttaaaaagctcccattcataatatcactcccttttgaaaatactttaattgactctacatgatccatccaaattcataagtggagtattcaatatccatagtctggctttaccctactgtttcaatcatgcctcccacttcttctagatgctggccatctacactcattaggttgatctactccccatactttagggtgcacaatgtttgcccagcgtaattgctcagtgattttttaatggatttactgattaagcttcaaaggcatttccaactccacagaatgtatgctaattctaacgttacccgtatagaatactaaaaaaaaattttaacattctccaaaactatggctatatttttctcctcttccattttcatccttaggatggttttccaaagtaaaacactggcctgtgaaagctactgaaataatcttggtttcttcagtaagaaataaattattcactatcatccccactccaatgcaatcatagcagaattatctttcaaattatagccacatggtttctgaagactaatgaagaggctcagcccaggagacagttttgggatccaaaaaatacctttcagtttctgctctttctaattcggacagtagcaatgaggccacactgattcaactggtaagcttccttcatatttttcattgttgttttttcccttagtttcaagccctacctgagccttgcccacgctaccaccactctgtctgaatttttgcacctttatttcatccaggttgatactcacagcccctgagttttcctgactgtctaagacaacagtctaaaagtgaaaccagaaagctaggggggagaaacagtgtcacacaaaaattctggcagatactgccacctacagggattataaggtcatccccaactcaatctcctaaaaaatcactcatttataatagagggggaaactgggcatatttgaactacacggataaagaagaagccaatttcatcaaatgataacctttgatttagtgtatggaataattatatatgtatatatgtatgtatgtatatgcatatgtaaatcaatcattaaacagggccaataaaaacagggctgtaagaaagaaaattaaaggagaaatatcaggttgtgccagtcgataatttctgttactagaaattattaaaaatcatattggacgagttgattacctatttttggttctatatgctcttgaaaagtttatgtaacactgtatacaacatgatagaatatttacctataaccaaggtgtctaggggttgacatttttatcctataatatttgaaacttaaaattatattttagttattcacaaataattcattaaaattcataaactaaatgataaactatatcattcctgaaataactaatataaatgtagctatttaaaatatgagatgctggctatttctgtgatgatttaatgccatgttaacaaatatagagaagaaaatagtataaaagcatatttttagtatttactgtttaaaaaacctttagatctatgatttttaaaaactgcatttgaaaataattacaaacatatagaaaaggtgcaaaaaaagcacaaaacatccctttacccaagttcacctattactaaaatttaacactaggatttttctcaatttatttaatttttttctctctctgtccacacaaatacacacacacacacagaaattgttttttttcctgaaccatttgatggtgaattacatacatcatggcgctttacctcttaaatattgtgtatttcctaataataatatcgtcttacataatcataatgttaccaaccaaataatctaatctaaaaagtagattatttgatctcatctacaatctatttccccatttcctgtcaattgatccagaaatatcttcacgctatctccccctccagaacaagacccagtctaggaaagctataatctttgaatctgcttttttaggggagaagaaggaagagattccttattttttagctgcgtaggctcttagctgtgtcaccattgcaaccaaatggcttgagtgtgacaactcccattcatctttttggtctaccttttcctttaatacatcttggagtcagaagatggataataaattattttggaattatagatgggtaatatttaatgcccaatataagaaggactgaagacttctaaggtttgagggcagatgattttttttgcatgcatttgacagctcaattgatttttacttcttcataagttacctaagtgctatggataggtgatatggtactactttaggtgttgataactgaattatgtcagtagtctagggatgacaaatagccagaaaaaaaaaattcattagtttccccaaattggtaaacagtttttgggaaattggaagaataatatgagtgtcatggagacactatcggctaaattgacaatcagtaagaattaggtaactgaaaacctagctctttaagtgtgtatgagaggagagaaggcgggttaaactggcagttataattaccatgattcattcaaaagtatgaactgcagtagttactatgcatttccaagtagattttcaaaactcctaaattggtgggagtctaaattcgttcaaccattgtggaagagagtgtggtgattcctcaaggatctagaactagaaataccatttgacccagcaatcccattactgggtatatacccaaaggattacaaatcatccttctataaagacacatgcacatggatgtttactgcagcactattcacaatagcaaagacttggaaccaatccaattgcccatcaatgatagactggataaagaaaatatggcacacatttgttagattatatagagtaatgctaaatatttaaatcagcaaatcatctgttccattatagttttttaaatgattattttgccactacccaaggatgctgtgaaaataaatgataagatattctatcaacaaacaatgaggctttcaattaaagctgattataacttacttttaatgtatattgctattatacttaggctaaaaaaccagtttacgttaacatagtttttatgttaggctaaacatcaatatacacaggccaagttttctttgaataatcttcttttgttaatgaatggtccaaatctttaccccacctaaaattcctttctttgtgttttttacccattgaaattctgtatcgtcatacttaggtcagtcttctgggaagtcttttctgaaggtttcaatttattcctcttaagaatttattttgcatttatgcattctaacactcattttcacattaccacttcatgttgtaaaattttcaagtaattttagaccctacataaataattccctaagaataattttgttaattttatcctattttgtttcccctgtaacactcagtacaaatgctctctgattggtgggtcctctataatagttggctatttcagatgaatggtaaaagacccctctcacatctgggatcatcaggaggtcagagtttcagcaagcattgcagttatgcaaatttctatttgttactattacaataattgctagcagctagaagaagctagagtaatgatgtattttttcaaataagtgccttagaagattcctaggaaaagctaattgcaaacacctaggagagaaggcatatgcattatctttatctgtatagccagagtcctactagttacagagtggcaaagaagcagcatccaaataacttgtcttaggtatttgtgaataactaaaaatttagataattgcatttgaaaataccatattttagtgcattctatatgtggggtccacctctgaacacttgcatccctagagttaaagagagctagaaaggacaaatggacaacagacagcgtctctgcagacgaggtgattctttgagatgttattaaaatgagtgctgttcaactacgtgattgactgtaatatgaagtcacgtgtggaaaaaacaaaactacaccctgcattataaacaccattctagtgataagacatcctctaacccacttgtaaaattaagaagataaaaaccacttagttagatttggcttaaccatagttaaaacaagtttctaacatgaagtaaaccttaaccacaggcttcttctttcagaaaagcaaatacaaaacagttatagctagaaatcccatggtgtcttttaaagtactgaaagttttcagactatattgctgaagcctgttgcatgtagcctatgcatgtagctgcttgtctcctgtaggaatcctagcttacaaagtctagatgtgaaataggtcctgggttgagtggggcatctataagttaaaaatattttcaactgtgtagagttctacaggttctccagtcttatgattgggagaatggtgcttgctgactgtcagatgcttctattctcacatccatcttaataatatattcacacaagcatatgctgttaaataaacaaaagcagtactgatgatgatctggtatctgtgagtgtgaaactaatttttttttaagttgtaagtcatttgcaacctagacacttacagagattattggggtaaaattgtggactctagaggcaacagctccaccatttattgattacatgactagcaagttacttaacctctgtttatgtcagtttcctcatttataaatccaaagctaatattagcttctacttcatgaagtctctataaggagtatgctttttactcaagcagagcacttgctacattgctcaaacaatattagcttgtcttaataccattacacaaatacatgaagggcaaaaaaaaacaaagtctaatttctccaataaacaaattgctcatgtcatcaatctaatcaccatttgattgagtttagttgtttttcttttcctgaacacaggtccattgctagacatgcacttgcttatccagagggccaatcagatttctgaaaaagttccaagttttggcatattcctctctttctctttgactgactgacccatgattcagaattgcaatcacaaagtgcccctgatgctactgttcacactgtcagaggatagaaacacacaaagtttaatcagattctcagtagcaatgtgatgtcaatcgggatgattaaataccagccattctaagcctgccttgcaattgttgtctgagaattcacctgagtcctaaggaatgtgataatcctaggtctgcagagtacactgacccagagaaagaccactgacaacatctacatctacctttcttttggtatgggggtgccagagagggttaaatttacagtgtgtataatcatctctgggttgaaagtctatttgccaggttcatattaacaatatgttttctctaagagcatagcataaagtagtgaaaatagaggtctttcagcaatgcatggcttttgcctacagcagcagagagggaaggtggaaagtcattgctatgaaagaggctatttgttgtttataaagcataatttttaaagataaattgctggaaacatcgatgccatgaacataagtagacattgttcactttatggaatccattttatatccatttgcgctgcctgcttatgaaaggaataaagggagaatttcagaaatggctaagcaaaaaagacaaagggtggccattttgttaaagttttaccatccaagaaagtgctggcaaagaagtggagatatatccacaccaaattgtcaccactactgataaataactcagagaactgatctatataggtgacaaatcaaaatggatatttgcatacaaagagaagcaaatgatatggaataccatatcatatcctcatgacctagtgtcaatgtgactatgatggaagccataagtgacaccctcagcaaaataattcgaattcattctagtgctcctgggctcccatagcaccttgtatatacctctttgataaaacttactatgttttactcttcctccttacccagctagcttttacactaaactgtgagctatttgggaatagagattttactttccttatctttatatatacatagatttatctcagtgccaagcacataataaacaccaaaaatgttgaatattgattggattctgtgctttcatctttggtgactagtttaattgaaaaaaaaagcagtagttctgactcaagagaagacttgagcccccagaaataggcttgttttcattattatctgtaagtattccagtatgttaaccatgccatttaactcactgcctgtatgtagccatatgcatatcagctgaactattgatgccaaatgaaagtgggattatataattcaaaccaccccttgggtttaaatttggtccaagacttgcactctttatatttcttattttttttccttctattagtgaatttctccattactcctggggaaatagataattctcctttaagtagattcaattactgtaaagaaatcacacttgatcactttgaggagatctaagctttgctcaaactacaattcaatgagctgacctagagttaatcaccttttactcattcatttatcaaagagacaagcacaacaatggatggattttggcatgcagtcttcatgcatgcaccacattaattaattcctattaaggaggttttaccagcacttgcaatgaacactaacacttataaagacagcacagtccacattcttgctgttctgtctacacttagacatcagaactagcaaaggatgtattgtctatttttttctacataaaataaagcttactactttgtgcaaaccacttacctactgataagtccacactctgctagtttcagtgttctcctaaagaagcaaaagtatattactgctaaatgttcctgtaaggactaatttccagtgaggtgtatctgtcattttgtacatctttacaatttctgaactgcagaaagataacaggttttgtagaataaagaagaatcatttaggaattaggtgttagatacctatctatatttttttgtttctactcagtatcacatttatcttctgcgatttataaaactatacctccttttacaggaacatgatgcttcccatatcacatccaaatggagcccatagggattgctatgttcttacatgaccatacacccctggccagagttggtagattgaggagtaggctcaaactgggccaaacacagtaccttacctccctgaacacatttgattggtccaggagtgggtacctcacttagcccactgcatctagagccaagtgtctattcccatctttatcctgggatatttggattttagatggtatcttcaaaaaactcagatttgtttcccacaggggctaaagatttatgcaataaaacttaagagttctcagaaactaagtttttcacctcaaggaaaagcctagtctgcagtgaaaccaaatgaagctgacaagctgagagaggcaaagaggaaaaccagattgatttctgacagtgcctgaatcccgagggctggacttcaccactcttctttcctcagctttgttatttaaggtttctttccattctgggagccaataaatctccccctttgcttaaatacttcaggctgcctttctgacagttacaaaccaaacaattctaatcatattcattaatagtgcacactaaaacacactgtcaaagacagttacatttcagactcttcaaaaaaaaatcaatgaaagtgacagaagtttaaaataggatatcagtatgcaccagtatagcattcttatttccccatgtttcttctctaatcaccctactagattttcatagagtgtttaatatgagggaaacaggggaggttaggcctcaggcttctagtttctaatgtatttatagggaaagaaacaattgtaaactagtaccaaaagctccaaagctttaaaacaagcaaataaaaaaaaatcaataaataatatgggatagaaacagaaagtagattagtggctgcctgggactgggtgtgggaactgagaatgactaaaaatgggtatgaggtttctttttgcctgatggatacattctaaagttggattgtggcaatggttgcaattacttagtaagtttactaaaaattagataactgtatactttaaaaattagtgagttttatggtatgaaaactatacttcaatgcagctgtaaaataggcaaataaagcaaacaaaaatagaaataaagagtatgagcaattctacagattttaagcagctagagaaaatgattaccaataataatctttaggaattaaaattaacaccaatagaagcagcatgctgtaaatgtaaatatagttcaatatttcatttttaattttttcttattgtggtataatatacataacataaaatatactgtcttaaccattttaagtatacagttcagtggtactaagtgcactcatattgttgtacaacggtcaccaccatgcatctcaataactctttctatctggcaaaactctattcccactaaacaataactacccatttcctctctctccagcctctggcaatcatcattctaccttctgtttctataattttcactactctaggtacattatataagtagaatcatacagtatttgtcttttcatgactagattattttacttatgacaatgttctcaaggttcatccatgaaccctgcatatgtcagaatttctttccttttaaaggctgaataatgttccattgtatgtatacagtagtccctccttaaccacagggaatatgttccaaggcccccagtgcacacctgaaataaggcatagtaacaaaccctacttacactatgtttcccgcagcttttatttatctgggaatatcttaatttctccttcactttcaaagaacagttttgccagatataggattcttggttcacagttttgttttgctttatttttttattttggcactttgaatatatcagcccattgccttctggccttcaaagtttctgaagagaaatcttagctaatcttattaaggatgacatgtatgaatgacttgcttctctctcactacttttaagatcctctctttgtcttttgacggtttgattctaatatgactcagtggtttccctttgaattcatcctactttacatgttttgaatttcttggagttttatatttatgttttcattgaacttgggaaattttcaggtattatttttttcaaataatctctgtccctttctccttctcttctccctctgagacttccaaaatgtgtgtgttcatttgtttgatggtgttctataggttccttaggcactatttacttttctccaatcattttttactttctgttcctcagactcagtaatttcaataggtaaaaatcttgacctatcttcaagctcagtagttcttcctcctgtctgctcagttctgtattttattccctctagtaaatttttcatgttagttattttatttttcagctctagaacttgtttgcaatttttaagattttctacgtctttgttgctatttccattttgttcattcatagtttttttcttaatttcttcctttattcttagagcatttttaagacaattgttttaaagtctttgtctagtaagtttgccatctggtttttctctggcacagtttctatttttttttcctttaaatgagtcatactttttcccaattctttatatgtaattttttttttgttgaaaaatggacatttgaatttaatgatatggcaactctggaaatcagattacctcccttcctaaggattgctgttttttggtttgacttttcatttttgttcttttgggttcttctgattgttgcaggctgtctttgagccagggatcagcctgagctataaatttgaggtcttctcaagtttattctgggctcatgcctttccctgagtatgcacaccgactttctaatttcctctgcatatgcagttgcttttgaatgtctaaatctttattttctggctccaaaaaaagaaagaagaaaagaaaagaagaaaaataaagtgtgtgtgggaaagttaccaggcctttaaatcctcctcttagctggagggaagaagggtttgcaacaatgaggagagggtgaaatgatgagtccccacctctgtatctgcacctacatggtcagagacagtagtcagaaatcaaaacacaggtctctggtatttgacactttgagtcttatttgtccatcatggcttctacaagctgcatgcaagcctaacacagtatggggagtagagaagatagatagttgctgctaaactaaaactgactaaaattaaccataatttatcatccaagtcttcccttagaagttatacacctttaatagactccagagattaaaaatagttacttcagacagattgtatcagtgcaattattgtctatataaaaagacagattcctggtgcttcctttttttagatcttcccagactcctctttgaagattattttttatcctaatctacatatagtttcttcagataaagatctgaataaaaaaaagactacgcattgagtacaatgtatactgctcgggtgatgagtgcaccaaaatctcagaaatcatcactaaatcattattaagaacttattcatgtaaccaaataccacctgctccctaaaaacctattaaaattaaacaaaaaaaacagtgtggaaaaaattaagaagcatgggaattgtaaataatcaaggatgtataatatctatgaattttataagatacaatgagataaatagaaaaccttagacagctttctatccggtaaaaacaaatggaattgaccatctattgttaaaaaaaggacagttctaaagatcagaggtcaactgtgagtgatgtgagaatataattagccacagaatattatagtacttcaataaagaaaggctcctatagttaaaaacatacaagtcagacaaaggaagaacaatacatctatgatccataaagaattaataaagcagaacaaaaaggtattctgcagatataatttgcctggatgttttgcaaaaacttttatgaagaatttttcaaaagaaagtcatggaaaataaagaccaaggaggattttgaatacaaattaaaatttcattgtttgagatcaaagagtatacctctaataagcattaagaaaaaaaagcatttaaatgtaagcattttaatgtattaaaattattaagatcactgttgcccaatagattatattaaacaaccttaacttaaaatgaaaaaattgaataaaagtataaaatcattcaaaattgtatctatagtggaatttcatcaaagctgtaaaataactctaattaccaaaattatatctattttttaaacctgttttcctatttaagttgattactccgtgaggtaatttttactgccccagtaatgcgattcaagttttttacatctttccacagattcttttattatggaaagaagacactaaaatactatccagttgaaaatgtaattcctttcttaatatatcccaggttatttttgttagtaagtgaagtattcagggaaaatatctctagcatccccaagtctatagagtagtgtgggtaatgaccaataaggaactattttggggtacattcatttattattttgcttggggccctcaggcatacatatacacttccctatccctaaaatacaaaatctgctacccaagaacaattaagaaaaaaaaaaagaagaaaggagggacgaattatgataatttaattacaatgctgacaaatgtatacatgaagttcaaaggttattctcatatgctccttctaagagtacaaattgttatataatttggtaagatccttctctagaataaaaaacaatacaagtttaaagctttaagattggatagtatttttgatcctgtttttttccaccctgacatttattttaataaatacatgatgcatatgtagaatattttatctaaaaagatgttagccacctttttccttataacagtgaaaaacggaaacctctgcctataagtaagagatgcataaaataagtatggtgtattcatataaactatatgcaactaataaaaatgatggccaaagttttcacagtagactgagcaaaaaactatgagacagtacacacatttctactgtttaaaaaaaagtagacatttgtaaatttgtacaaaaagtagaatgttcttaaaaaagtagaaatttatttgcatatttaagttgacaaatttgttaacttaaaaatctaagttaattcacatgcaaataaatacatctagaattatatatatatcaatatgtttttagcatttatctctggatggtgagattataaattattttactttgttctttgcttctctttgtattctataaagttcctacaataaatacatattacttttggaataaaaaaggaataaaggttatttctaaagttaaagtaaaaaaattaacagtcatataatgtaaaatgaatgtgaagataccctgaaaatacagagtaaagggatctctctctaggtagtaaaaccaagggctaagtctttttagaggccccattaaataagtaggatagcaagtaatacagtgtatgagaaagggcaaaggtctcagcactagcgtgcctgtgttttaggttaggttttaccatttagtggttaaagactttgggtaatcattgtttgacttttcttactttattttttgtccacctataaaaaattacgtaaatggttccttgccttttatcttacgggttacctcaatgttcaaacatgtgcatgaatgtggacacattttataactataaagcaataatgtaagtttattaaaaagttgttaaaataacattaaggagaaaagcagacaaccaaataatagcacaattcagtgaaaaaagaaaaaaataaaccaatacaatgtaaagtttcacacgccatgttttaatccttatctagttccttcattgaaaggaaattatatgagtatgtaagataactatcaaatcctacccttttcctaaaacatcccctttcaagtcagttgcaagtaaactcttaacaacaaccacagtactgctattggtttgaattacctgcaacatgtaaagcatatatgcgattcacaaaccactaaagtgctataagaaaatgtccttttggttgtctcttatgtaccacacaaatgctaaaagaacaataacaactaatattttcattgaaagtctattatgtccctggggctgtactaagtgctttgtatgtattatcttagttaaaccatttaaccatcttcttaagtaggtgttattaagtagccaattcaaagacacatagaggtacacaggtggggcaggcattaaagcctatgtgcttaatcactacataaaatgccttctgttttgcaatatgaatggatattgtggtgaataagatatgggctctgtctctaaggctactgacatttaacagtggaggtaagatatgcatgcattcccaaacaaaattcaagttgagatcatttggacttctctctaagagtagttggcattgtatctgcgtcttaactttaagcgttttcaccagtcattcaggcacagaaagttatatatgtaaagacagaatataaaaaagataagcataggcgtttataatatttacatatgaaattatgtatgcaatatacacattacatattattccaggaatacgtattttattcatgagccaacattatgctacttgagggcagaatgtgaccaattcttattacaagactttcacataatataggacttacacactcagaggcagatgctgaataaatgccctgagctgtgtttttaagaatatttgtttcaaggtacgaacatgacagatttggccatagggaaggtgaagcaggggaaaggctagtaagatagacgaaatgttgtccagcagcagaaatggaggcagtaagaatggagaggaagaaacaatgcaaataaagtccaccagcgttgggcagtctgtagtgagaaaagtttaaagatctcttttaaagtggcactctggatttccaaggaaaacactctattgtcaagtaaagtgaatgtgttgcttggtaggatgatcttctgaacacattgaatttgaggtattgaggggccatttcatgactgggattagagctggggatatggatttaggagtaatcccccgagagtggatagatgaaaccttgggagtagctagtaggggagagaaacaaggagggcaattataaaaaaaaagaaatgaagctgctggagaaagatccttcaggaatatttataagaagttgagtgtgtgtgtgtgtgtgtgtgtgtgtgtgtgtgtgtgtgtgtgtagggggagtcaaattagaggaaggaattaaagggtcacaagaatctatccattttccaccacatctgatccataatttctaaaagcttaaatagaatccacatcattgatagatttgtctttctataagtctgtggagcgttcatcagagcccacaggatgcaaaagtagtacaaaatgcccatcaaaatattctccagcttcaatccatttaacataatttaactaaggtaacataccttagttaagacaatcatcactatttgctgacattcatagacagtacattttcttacaagcatttacttcataaaacaccaagagaaattaaactatgttggaacagagtgatgtctaacacaactggaaaaggaaaaaaagggttctggacattgttatcccaatgttaatgtcctaatcttgatttttcttacaaagcaactggttttctttgaaatgtctaattgatgaatacaattaaaaactaaagttctttgtgaaggaaaaaaaacattatcttcagaaaccaggaagctgagtgttaagccattgctttgtttcaaatgcagctgtatcttgttgcatgatagcatttatggcatcaccagtggaatattgtttttaataagtgcaaaactggtgaagacattggtctcctttagaaagaaaaagttaataatttcttctccaccacatattggctaccctgtttattaaaagatagacatttttgacatttggaaagcaataattgattctacaatattattaggagtccatatagatagtgaacctttcctgtcaggatacgacaaaaaacgcgtaagatagggacatccaaggatcacctaccattcatcacacgcaaggtaactgctttcccctaagttcactcaagcagaaaatgaacagttgccaatgatgatcagagagatagaaaatgctgcttccaggaatgaaagtctctttgttgttgttgttgttgttgttgttttaaagttaaaccaatattctatatacttttgctgaaatagcaagagggccagatttgataagatcacagtcctggaactgatcagttgctccttgatgtgtttacagaattttacaatcatataaccaacagatgctcaaaagtagcctcaaaaccaacaaagacaaacattctgttttcaatctttggtgaattattttgaagtttcaaagcatattgctcagaatggaattttacaaagataatctttagatcttagttatttggaggattataaactataccaatttactgttctatcattggaagaactgcaagtattttttgctccccacaaaactaaatctcctctgaaaatagaaacctatttcaataattcaatttgtattgcaatcaatacaaattgattgggtgcaataaaaagtacagctaattcttagaaataagcatgcttatgtcattaaggctaaaactgctagcatgagaagctcaagtgaaataaataaagtgtattcttataataagcattgccaagccattggtagttgaagacactattcaaagatgcaaccttgtctttcattggtgttctctgtctgcatagaaagggctgtgaaaggagagatgcaaaagaggcaaagaaataggaaaaatgtcttgggagaaggaaggatgttccaatgatatggaataacaacaaaaaagttaacttgggacaagttattatttaataatactggagacaattccaaaaatattttgaatcacataattatgctgtggaagaaaaaaaaattattcaacgtccaagactttgtgtttgtgaaaaaactgtcctctttattttatagcccatatattctaaatgtttacaaagataaacaacattgtttttgtgaccattaaaatatgatatgtgaggaagtatgcagggcttgggacttgaagattctgcatcaaattcagaataaataacctgtgatttagctacaattcgggccaaaccttcatggctttttgacatcaagaactagtacatagtgagggatcaaaggatgcaaaattgagtgtaatcaaggatatatgattttttcttctatcaggtaaggtacaactgctagtattgatgaaatgacaacttaaaaaaaggctttctgggccagacgcagttgctaacgtctgtaatcccagcactttgggaggtcgaggtgggcagatcaccttaggtcaggagttcgaaaccagcctgaccaacatggtgaaaacccgtctctactaaaaatacaaaaattagctgggcatggtgatgcatgcctgtaatcccagctactcaggaggctgaggcaggaaaattgcttgaacccaggaggtggaagttgcagtgagctgagattgcgccattgcactccagtctgggcaacaagagcgaaatttcgtctccaaaaaaaaaaatggctttctgttacaaaaatgacaggtcagtaatctgttacagaaaaatttataataagaaaatgtgagtaggtaaacacacctaaatataccttaaagattgctcaaaaaaagactcaagtggattaaggacttcccaaagtattcttagtggtgcttgtcaaacactatccagaaagccctcggtcaggtttgtaatcttttcggtagtgttcatttgttgcaataaaataagtcagcagttttaacaaagaaaaaaattctataatgtttactgtttaatactaaacacaacagtgtgagattatttcctgggcttttaaaaattatacatatcttttttttagaaacctttacaaggaatagtagcatcctatgaaaagttggcttaatatttgattatatatggtgtgtatgattatctccataatttgagacattaggctattggtcagaaatgtgatctccactgtaacagcattttaggggaacaattatatttgatatttctgttttcaatttatagtgtctattctagaaatataatctgccataatctgtcaaaactgccaagactgtttgtagtacttcaatggtactttacagctaatatcaccaccacccaacacccatctgcataatgcatttaaccttacaaagaatacttttatctattatattacttcattttcaaaatggtcttataaaacaggtagagcagggattttaactgaatttccattatgaggaaaataaggtaacaacccattcctggcaaaatctggactagaattcaaatcatttggctccaaactaacacatgcttctccaaaaagcagcccagtatttccagcgacttaatttaatgaacagattcaagacatgggttaaaaatgttgaggatgtcaggctgactgtcactgagtatacttcttgggtaaggggcatccttactcctgttaagatgatcttactaacagctaaagcagactgggagaattttgacaggagaactactattcttttcagacacagatagttcccttttggtgaaacttgttgcaatgttccacaaagtgttaccgcatctggaaagtccataataattttgatttatctgcactgacagtcagcagtatgttatattcactgttgcataatattattatctgttgatcttcccagtagataatatattcctcaaaggaagaatcttgcttattttttaactctgtttagtgccagccatgttgaagttgctcagtaaaatttgtgggaggaatgaaggcaggaaggcaggcaggcaggaaggaaaggaaagaagggaggggatgacgaagttttggaattttcttttgcaaaacactctgctaattgaatttatgacacaaaagagttcagggacaacaacaagaaaaatgtttgaagtcattgtagcgaaagagtatctcaaaaacaagtaagagaatgacttaatccaaccacttgatatgaaaattaccagtaattagcctgtgttaaagagatcaacttttttacacaactcagcagcaaattggttaacttaaccaaagttatgcccaaattgctccttatccaaactgatttctatgttttggtttcatgaaactgatctatcattcaggacaataaactaaataagaactaggcgttttatatagtgttaaggaaaaaacatcattactggcactagtatcaaataatattgctttctttggcaagcaactcaaactaggaaaatgaatttattaaaactcttcatggaccttatatcaagtctgcaatctcctaaatgtaaaactctgcctataaacattgtcagggtaaaattttgccttaaaacagagtaattgcttctatttcctgtgatgtttacacagcaactccttcagaattactcttaaaaagaaatagaaaagaaaatcaatagcaacagtgcactatgaaataaactttgtggcagaaatggaaccagaagattaagataaaaccataaaagtatgaaataataaaaagggcaccaaattcactccataaaaaagactaaacatgatttcaaatgtatattacacacacacacaatggaatatagacattttgtatttcacaagaacatttttataaaaaataatttgcaaaaattaatccagtagcaattaatactattctgcctaacctcatggtattgacaaaccttaatcagatattatttgtaaaaatatactttacagcattattacaaatgtttcattttccaaataaattatctttgaaatatttttactttgtataaaatttttaaaattcaagaatcatatactctctcttgttaaaaatgtcaactactaattacacaacttactataactgcttttactatttgtatgcaacattcttcttcattatttgtgttctactttgcttgttttccaaagtctctggagatattcttgtaagacaaatttaaaacatttatcaatttttatcttaaatattaatttgagttgaaaattagacatgtttaccttaaatactgagcaaaaataatttcaactatatataacagttatagatctatcaatccaaaatgtatatatatatatatatatataaaacaatactaaatgtagtatcttaagtaattttgaaactaacatgaatttccaaatgcttctttagcctagcagacgtccaatgatacacggttgaaggtaactgcttcaatggcaatcaatcattaaccatcaaatccactcaagactagaatcaaactttcttctattaaattacccgcgcaaaacaactgagttttcccatccaaaccattggcctctgcaacttgtaagagtagagggaaaacagacagatctacttgataatcaatttaaaggttatcaaggctttctttacttttgctaacacagtttctattttgagccttcttggccaatgtgcttctgcctaagtgtcacaatctgttttaggtcttagctaagaaaatgtcttatatggtttttacagttaaggattgacaactgccttttgcttttgttggtaagcactcctctaaagttctcttgcctgatcaaacctcacaaaaatagaaattggtccttattctgaatgtttaaaagtccagtaagcatttactttttcttgacgtgtgttaacatatacacgttttgatctactcttgaagtaattaatttaggaaagtgaattaccaatactgtacaaacacatgatgccatatggattttcagggctgaaccaagttcataagcaagatggcaatgaggagacatctatactttatcttattgcaactaccactttgagctaagtacacagagcttgaaggagaaatcattacttgcttctttggaaaccaaatccatcctctcaaaccctatggttttcccttccctttgttaggccatactgatttacattgtatttcagtattgaaatttacatcagaccaatttcacattgtttagtaacttgtgatttatgtagtattaagattaattccattatgaccaatatcctgtcatatcatttaattacattgacatttattgtaattacatctaataaattagatacatttaaatacattccagctaagaatttaaacaaatgagagccacctggcacaatgagagaaactgtttcagtacagagacggcaaagacactctctgctccccaagttaaaatgatttagtttgacacaacctggaggaatttattctgtgatcacgatattttctcttttgcataagatacacaaagtttgagatggaatttggtggtaattagaaggcagagaagaccataagaaatatgggaggtcatgcttttctcttttcattaaaaagttatctaaaatgatagcataatccttgatagtcatttttaattggcaattattgagtacacacagtgcagccagaattgaactgaagtgtcacattgtcaaatgtgacttttcctgttgcatttgctttggcagcttgaacataactattaggaccaagaagaaataaatacttcacattctaaagaatatggggccagatcctctttccagagctatgatcaatagcaacccccaccgcctaatcctccttccctaacacactttctaatctacataaggtgatctgaggatcagaaaagagaaagagacaacgcattcttaatggagaatacagaggttgtgttctccgttctccgtcaaaacacccaatttaagtgcgattgaactccaaaataaataaagacagggacactggcatgtcacttccagggctctgtacttactgtcagtggagtgaagcaaagaacttttaactcaatttaatacatgatccctgtggcttgaggctatacatgaggagagagaggtgtctactcctcacctggaggtttctgaaagcaagagactctccaaacaatctatcctagggtgaaagaacctaaaaagccaaggagaaaagccctctctgatcctcacaaccccctgaggttgctgaagaagacctcaatgggtaactgacctcagtgggtaactgagcttcatgtggagaagtatgaagtagaaggtggaagaagaacgacaaggtggtctagataacagtcatattaacggatcctcatggaggagtgagggacattagctgcttatagaaagtacggtagcaggagcaacagcatgttgtgtttacacactttgacatcatatatttctggatgaagcctcagcactatttttttttctttttctttagacacagtctcactctgtcacccaggctggagtgcagtggcgcaatctcagctcaccgcaacctccgcctgccgagttcaagcgattctcttgcctcagcctcccgactaggtgggattataggtatgcaccaccacgtctggctaacttttgtatttttagtagaaacgaggtttcagcatgttggccaggctggtctccaactcctgacctcaggtgatacacccacctcagcctcccgaagtgctgggattacaggcgtgagccacccaccgcgcccagccagcactgtcaactcatttaaggtctctgagccttactttcctcctctgcaaaatgagaacaatgtgctctacctcacagggcttttatgatgaacaaatcggacaatacttttagaaatgatgtcaaatgattacactatgcaaacaatgatattattacttaacctatatattacattcaacttcactgcttgctcatattatcttactatattatatatattcttaggacagctggagtcttgtactactttatgtcttgtgtattctccaggtgtgctatatttagcataatctaagaatgatttgcaatgacccttatctttgtataattctcttccctttgagtgtgtgtgtaacctgtaaatatgacaatatatctcaccaatgatacaggctgagcaagccaaatctaaaaatttgaaatccaaaatgctccataatctgaaactttgcagccaatatgacactcaaaagaaatgctcattgaaacattttggattttggattttcagatttgggatgctcaacttggtaagtgcaatgcaaatatttcaaaatctgaagaaaatccaaaatctgaaacatttctggtcctaggcattttggataggagtactcaacgtatgtgtgtgtgtgtgtgtgtgtgtgtgtgtgtgtgtgtgtgtgtgtttgtgtgtgtgtgtgtgttcaagaatggaaaagccactaagaatgccctccagctgacaaccagcaagaaactgggacctcagtcctacagcctcacagaactgaatactggtaacattctgaagaagcttggaagcagtttcatcttcaaatcctcaagataaagagcccagtcaactggctccttaatattagccttcttgagaccctaagcagagaagcaagttgagctcccacagacatgtgatctacagaaatgtaagctaaaaaaatatatgtgttttttggctactaactttgtagtaatctattatttagtgattgaaaactgatacagatgctaaaacctatttattaaatgcatactatttattaaatgaaagccattgattgaatgttcatgaagcaattaatatataatatctgagaacatttcatgtgaggtcttgtctgaaaattcttctgaagaattttgaatccttattagaatctgaaaaaaaatctcagaggctaatcacaactaggattaattggaagacatgaataagcacccctggtgatgtttaaaacatttgttgagggtagagtggtagagtttagcaaaacctgtagtcaagtaggatggaggctcggcaccaatataatttggccaaaaacttccatggtttactcataggctgatggcatgtagattacatacaatgaaatgataatttttatgttaaggagagaattctcaaaatatttgtaaaaatgggcagtttgggatggctttatggaaaagtggggttcatgttaagtctcaacaccgagtactaatgactaaagtaaaagaacactgatgaggaactaaaagaaaactacagagataatcaaatctgctcccctgcctcaccccttatgcattataatatgtcatcattccctgccaaaaatagaattccttttattttagtatatctctagggaataagatcgaagaacactctcctaggaatttaattatccttcgttggaggaaatcctctcgctcaacatgaaggcaaaaagtaaaggccatttcatcttgtcctgcctcccccccgcctgttaattttaaaacacatgtttagatactagaatattttaagaaaacagctaccatactggcatctggtgctattggcaaccagtgcaaggataagctccagtgagaatttaaaaatgccttttcctaaggagaaactgttaaaaaaaaaaaacaacctgattatcaattgttccccaattcatgaggaaaaagaacaagtattatcaaagagctaatttataaatacctggatttacaactcttttccactaagtatttccaaaataattgttctcaaagttaactgtacactagagttaactagggacctttaacaaattttgatgcctagtttctatgcctttaaaaattctgaactaattggtctggagttcagtttgtttattgtgataatttcaagagctcccaggtaattctaatttatggcctctgagctatggtccaggattacatgcatagtagacttctgaagaaagacaaccatgagttcagtttatttctccactagaaggactggattttagagatctctgaagtaaaatatccatgcatatttgctctgaaataaaaatgttacagaacaatgcttttatttcaaggtttgcatttttccaaaggttttttttttcaattcctctgtttgcaatgcagcaatatcttgtttgaatgcaaattaaatcttcctcttaataagaaggatgtgtctctgcctcaggaccatgtacaaacagtctggtgatggcaggcagtgacccagggatgttcatgatggactgagagagacatggcaaacattacaagcatgcattgcaaatactggactgtggaaaattaatagttttaacccttaagccaacttcacctggcacagtagcatattttagcaataatttacctacattttacactaacttgggggaattacagacacaaagttggaaataaaccatactgaagatagcattatactttaccttggctgaaacttgggaagcaacacaatttggcctttatatttaaaaatcacggttcatttgacgtcacataaatgtagagagaagagtggaaatttgagtgagaaaagctattaggaagtatatttactagagaaggaatagaattaacagaacttagtttttttcatcttacattttcttttgttgataacgaatcaattggaacatttttgaggttgccagaatcttctgattctggagcctaaataaggttttttactggcaggttgaccgaataatagaaatttcatggccagaggccaaccaacactttataaaagccctctggaccaggtggttgacaagcccaggacttacatgaatgcaaccccagaagaaaaacttgcaagtgcctcttcaatagccatccaagactcttgcttgaaattcaaggcagctgatggtgatttcgtcttccatttacaacttctttattcttataaaaagaatgctgtatccttttctttcctccccaacaccaacagttcactcgttcaaaaactctaaggcattcagttaaaagtagatgaaaatattgtttgccagaaacatcttcaaacagaatatgagttttcacacacggaatgctcattagaagcagaagcaaacgtatcactgtaacataataatagctcatattgagcaagtactctgggctgtgtgcctaacatacaatagctcatttaattaaccataatgttgggtggaagctattattttcatttcacaaattaggaatctcagacacatagaacttaaatcacttgctgaaagccgtacagaaagcagtaaaagatccagtattcaaaagtaggtaatttggccaaaagtgtccactcttaattataccactctattgtagctattgtgtaaagtggcccatgagaacaagcaatgggtaccttgccccagtggaaaaagataaattcagggaagtttcttgggtaagtttatttctgcactaagtgaaaatgttaaataaaaaaatatatggatgaggtaggcagggcccagtggctcatgctagtaatcccagcactttgggaggccaaggagggcggattacgaggtcaggagttcgagaccagtctggccaacacagtgaaaccccatctctactaaaaatacgaaaattagctggtcatggtagtgggcacctgtaatcccagctactcgggaggctgaggaaggagaattgcttgaacccaggagcggaggttgcagtgagcggagaatgcgccactgcactccaggctgggcaacagagcaagcttccatctcaaaaaaaaaaaaaaaaagaaagaaagaaattatatggatgaggtagatggaggacgggggatggaattcctggcataggggatagcataactgaaatcaaaaaggttgaaacaaagcaaaacaaaaaaacaaacttacattgtgtgttgggcagtttggtacagtaaagagataatataaaaatcaaggagatggcactggagaggtgaactaggagaagatcatggcagtcttagtatcacaccaagaactttgactttgttctacaggtcagaaaatctcaaatatttctgatcatgacccacagaaaaaaatatattttacttggtgacaaatacttttttaagcatgtattttacttctatataataaaagtttatatatctttattatacatgttatttataatacgtcatattatagataatatcacacacacacacacacacacacatatgtacactcaaactggttgagcaccctaaatccaaaaatttgaagtttgaaatgctccaaaatccaaaattttttgaacaccagaatgatgctcaaggaaatactcattagaacattttgttttgttttgttttgttttgttttttttgagacagtctcactctattgcccagtctggagtgcagtggcacgatctcagctcactgcaacctccgcctcctggattcaagcaattctcctacctcagcatcctgagtagctgggactacaggtgtgcaccaccacatccagataattttttgcagttttactagagacagggtttcacgatgttgaccatgctggtctcatactcctgtcctcaagtgattcgcccaccttggcctcccaaaattctgggattacaggagtaagacacgatgcacagccatcattagagctgggctctaatcatcattcatattttatattttcatatttgggatgctcaaatagtgcaaatattccacaaacaaaaaaaccctgaaatctgaaacacttccggttcaagcattttggataagggacattgagtctctctctgtctgtcgtgtgtgtgtgtgtgtgtgtgtgtgtgtgtgtgtgtgtatgcatctgtatagttggcccttgaacaatgtgggggttggggtacccatacactctcagttgaaaatctgtgcataacttttggcacccccaaattttaacaaccagtagcctactgttgaccagaagccttactaataacaataagcagttgataacacatattttgtgtgttatatgtagtatatactgcattcttacaataaagtaagctagacaaaagaaaatgttatttagaaaatcataaagaaaatacattgacttcattaggtggaaattaatcatcataacagtttcatccttgtcaacttcacattcagtaggctgaggaagagaaggaagaggaggggctgatcttgctgtctcatgggtggcagaggcagaagaaactctatgtataagtggacctgtacagttcaatcctgtattgttcaagactcaagtgtgtgtgtgtgtgtgtttgtgtgtgtaagagagagcattttatatatatatatatttgcaattgaatgaaaattttcaagaaaattaatgaatcttactattcaaatattcatattttctattctatttcatatcagttctagactatttaggaaatgagtaggcctctcaattcatttttaggccccattaatgagctataatactgtttaaataacactgttatgggtgttggaaatatatgcgctatcatcaaaggattttgattacaggagacatagtttagagtgttacttcaactgggtcactctgatagcagtcattagctgtctgaagatgattttgagtcatttgccaagctcaggcaaaagagaaaaggggagacaaaatcaagtctacttagatgccacaaaaaataaattgaataacttagagtctccactaaaattataattctttattagaagaatgttaaagaaatgatccgaggaccactattcttgaatatccttaaaagtgcaatacaaagccagttagattagcagggttactgacatacccgcctgaaggaaaggaaacaaacaggcgaccactggtgccctccagctctagatttatttccctggtcactgactatctgaaaactaattttggttgcctgagaataaaaagtcaaaagtacatgagattgctctgaagaggagtctacagaaatgtattagaaacagatgaatagtcatgaccctctttactcaatccactcttacacaaatgtctatgcaactacagaagagaattcagtacctatttatcaataaaagaatatgagaatgtttctgcaggctcctaaaaaaaacctttcctatgaacagaagataatggggttattatagacaaggcaacagcgccttctgaaatattgcaaactaattaagaataattattaataacatttttggtggtattgtcttatgcttgactaatttgtaaatattctggtatatttgaactttcactattttagcctgtaccctattttttagcacagattttaattagaaaaatagaagtaataacaagggaaatcacatgttaactaatgaactgagcctaacaacaaaaaagacacagggaggcccttgaaggactctctagcttgatgttcttcttggaatctagggcagggcaaaagtcctaacatcactctatggacaacagagatgaaccacatgagccaggtgctagaactgtgatatttatctctgtttccctgtgtgtaccaccaccccacaactccaaaaaagaaaaaaattataaacacatccactaaaattggcaattctagagaaactggatggcctgttaacatctggctttcccaaaactcaatttttctgtaactcattcattttttagcctttgattctgaagaaattacttgcctcctggccagccacagaggctgacgcctgcaatcccagcactttatggggcaaggcaggtggataacctgaggtcaggagttcgagaccagcctaataaatatagtgaaaccccgtctctactaaaaatacaaaaattagccaggcgtggtagtgggcgcctgtagtcccagccacttgggaggctgagacaggagaattgcttgaacttgggaggtggaggttacagtgagctgagattgtgccactgcactccagcctgggcaacagagggagactccgtctcaaaaaaataaataaataaaaataaatgaaattacttgcctccttccaggcttgctatagataaataaacatatacgcgcaatctatatttctccattacactgcaatcatttccttgtcactagaattgtatcttgtagtccaagaggtaagtaatcggaactgtcaggacaaactcttgggactgtaaatgtgctatctggagcataactatcctaagaataaaatccaaaagcaaaaactcatcagaaaagatttgaaactcatttcagacaagatgcagactataaacaaataaatacacaatatgaaagcaacttaagtctcatgatggaaagattttgatccaactgattattattgttcctagttcaaaatattttaggccttatcaatggcaatgcataacaggaatgactaaggttagcttttcagtgaatcatcagagtagtgattaaactgatgacatacaagactcctaactggattttgaagattgagtacagtatccaaaactagcactggaacaagacaacaacgttcattcagcccacaagaaaaccagtttaaaactctgaaacaatgacaccatgagtatatttgtgataattatttgccatgccaattatattaaatcatgaggaggtagtacacatctacatgcataacgagcccatttttatgttagcatatctccaaggactttcctgctgtgtattttatactgctactgccttatattttatgttagcattaatgttttaattttcatatacatatccttaggccattttacgaagggcgtggctttaaaaattcagttgatatattaaattaatgttaaaaaaaggtcatgtaacaagtagtcctaaatcagttctttgtgttccctctgtacattcaaaccttctaatatggtttatttattatgggtaatacagaagtaagatctgggctctaaactctgaccatctgtcaggttaacatgcatatgcactaagtgtctttcttcagatgatggatcctaccacaagtcctccctaaaacaatatatcaatccccttccccacaaaaataaaaaaaattgatttatatcaaaataaatacataaaatagagcttctctctaaattggccttctgattagaatactacttcatcacctcagaaaacctgtcttaatattatacaggtagaataatttaccaaggtgtaaagaattttttaaaaaatacaaaaaagagacaaaatagtgtagtgattaggaataaaagttctagaacaagacgatctctatcagacccagttcggccattgactgtcttgtgagtctggtccagttatttcaccttttagagctttagttttctcaattcaaataagagtattcaccacaaggtttatttaaaaaaataaaagatccatgtaaagcatttgtatcaaattcaacatatttattaatattactattgttactaatacacagatgacttcaaaagctgctattaaaaaccaagtaaggatgtgggtggcatgctgtattttagattcagattcaacagccactatactagttacattcatatgacattcatatcacattaacgtcatagcacagcacagcaattaagaataagggtctgtctggttttaaaccttagttctatcacttattagctgtatttaattcagtaatcttcttaacagttctataaaacagataatagtattacataccttataatgttgttggaaggattaaataaattactatatgtcaagctcttagaaaaaaaaatttgctgttgtaattatggattttatttcagaacggaaaatgtccaaatatttaaaaagccagaagaacaacagaaccagtcttgtagtcactgaagtaatgataatttaaaaaatcataataataaccattaaaacagtaacatgctatacttagctcaagcgtagcatgctatcatttgcctacaatttcactatattacccacatgacctctcaacaagcctgtaatgtgggtaggctatagattattgccttcaaattatatttcatgaacttgaggttcagaaatcagtgacttgctaagccacataatagtaggtgttcgagccagtgctagcatctaagcatgggcctcatgatccaatgccctttccacttcactccttcacaatggccgaagaaccaaattcaaggcaaggccatccaacaggccatcctgataagaacccctcctgaaataagacaacacggtcacacaaatcaagtgcacatgctttctaactcaatggttataaagaagttataggtaacaactgatacatctgcacaaaccataaggccattaacacaaagatgcattttaaagctaaccagttccagcagattatattcatgtaaagagaatttggttttcctttccttctgacacttcattttccctttgtctcccaaatctgttaataactatttttaggcagatggagcatttcatgaatgggtcactcttaaaaatctcatttggtttccaatttttcttcaagcattaagacttactacttttagattttttggttattatacacaaaagaatatatgtggatagaatatacacacatttatgcaaatatatatatatatatagcatgcatatatatgcacatgcatgtctatctatacatatacatttacaacaaagaaaaactgcttaattttatgtataagagattcagagaactagaccaggtaacactcagaatatacacattattaaggagaaagcaaaaaataaaagagaaatcagtaaacacacaaatcttcccattgacaaggttccctttctgagcttcctttcactttacttctgattttcttctcatattatgtgcttcaggtaattctgcacattttcttctcctgaagagaagccatcaccagaagaaaaagccatgaggtctttttagagagaagaaattcacaaatactgttaggcagggaggcagtcaacaagcacttactgaatccctagccccctaagcactgtactaggtgcttagaactgagtccctcctgctattcagttagaaggatggaaaagctatgacttctagtattagcactgacctagttaagccatgaataaagaattaaaaggttttcatcttccaccatacaagttaagaaaacaaaaccagaaaccttgatatatgtttttcagcccaatgcattatggtttcacatatgtttcagctcttattgaaattttttagctcaatttcttttggtctagaaagttaaaaaatgtccaagtcaacaactcagtaagaaatttagaaagtttccaaacaactcagttttggaaactttttagttcagcatttcccaaactctttgctattgacattttaggctagaaaattctttcttggaaggagcaggggcctttcctgtgaattttagagtgtttaatggcatgcctggcctcgactcattagatgcctgttatcacctctccaaccgagtggtgacaaccaaaaatgtcttcagacattgtcaaatataccctgggagcaacataattcctgagtgaaaactatctaggccaaaacttcacctaacacataactctattagatggatagcatgaaaggatggcatataaaggtctggaaatagaatgacattaaacttaaaataatcagcctttttcctaaaggtatttttattcaccttgtacataacattgagaaaacatcacttgtccaatatcaaaaattggggaccttaaagcaatacacccctggtcttcccaaatcactgctctggcttgctttagtttgtaacattaaggctctgtttcctagaaagtccagagctaagacatacaggttgctttcagttcttcagaggcaaggaaactaagaaaggtggtaatcataagaacaccacacataaaaagaaagggaagagtaaaccgagtttctgttcttaaaagaaacagtgggaaaaaagagaagacatacattatcatttcaaagcaatttatcttaacaataattgggcaaaagacattgtttttagttgtgttcttgcagaagtaatgtcaaatttacttgaaagttagagttttagaaaattttagatgcagggagtacatgtgcttgttacatggatattacttgtgtaatagcggggattgggtttcttgtgcacccatcacccaaatgttgaacattatacccaataggtaatttttcaactctcattcccctcccaccatcctcccttttggagtttccagtgtctgtcatctccagaaaatcagataacttaaaaggtttcatgcacgttaaatagttaatagttgttttattacaccaaaggaaaaatgaaaaactgtttttcccaaaacagcataaatgtttattttctgtatgtttactttgctgtcccatttctataatatagaaaagtatattatttgaatagctaaatgtatttatcataaatatattacttttatataaatatagtaaatatatcttttactttgggatgtaaacagagctaaaatattatattctcaaaagccccaaaatagtccttaaaaatcattgaattaatgtggttatttaatcttgctcagcaatttgatgcaaacgcctaaatacaaaaagtggtttagtaggtactacaaaggaaggaagaaggaaggaaaagacttaatactctagaatgtttcctgaaaatcagaaaacaagtagcattcaattgtagctaaactaactaactaactctctctctctctctctctctctctctctctctctcctcctctccctccctccctccctctctgtcacacacaaaaacacacaccacaaccctgattaaatacctgttggaagaaaggaaggaagcatatgaggcagcatggaagagagaaagagagtgacaacctcaagagacatcattgacttgagttctagtcctatgatggatttcagaaagtggtcataatctctttaggcctcagtttctcatatgtaaaatttgagggtttactagaagatacatgtattctcttcaatttaaacagtccctgattcatagtgtgtttcagattagggtagtaggaggaagattctgagtttcagaatctaagaaaaattaaatgatctaagttacattctaaaatcgatatgagctgcaattctgagaacaacttggccagctagcccgaatatttttggcaatgccagcaacagattggctggatggcactgcacaagagaatctttttaacacagtctgctcaatctggtctatccaatgttctgcttgggataactttaaatttgggttgacttagaacttgtccttggtatctcactggctgttaagaggacagtccatgataaatgtcttcttcattaaaagtcaattcttgccaactttttcatgctactttttttctacaataccacatataatttgagacatactgcccacaaaacagaacctacagaaggttggaaacaatattctattctctctttcagagacatgtaacattaaacagggttcaaagggaatgcattagaagtttacagaggaatttggattacaaatggttcacaggaacagtaagtacttttttttggcttaccagctagaagtgggacataaggtaaacaagctatgagtagatttctatagaggtaaaacacctcatgttacatatcaccacacccctgctgtataatacataccataaagtattattacaagatttaaatatttacatcaaggtttgccaatgaaaagagctttgagaaccatgttagcttgtagctgccaaagacacaagtaacagcagtagttgaaatcaggcagtagtctggggaaaatggggaatccaagaacaaagccatgtatgaatttctccctgtcttccatttcaaagtgctctttgtaaagagaaatacctaacaatgcttgagaacagtttatatttataattgtaataaaaaagaaaatactgaagactgtatttttaggtgtcttagttcaaaggagcaaaacactttgtcatcctaatcagaaaagacatttaagataacaactggagaaaagtagctttagaaataagtaggaaacatgtcctaagatattttaataatgtcaagcagctatttgcacaaaaatatggagctgctccacatttcactacatcttccagggagacggtagtagatatgagtaggtaaacatccctaacctgtctagtcacatcagcatattagccacagagaaacaagatacataaattctgggaccacctaaagtgatttgttgatcagctctgtgcataattactgcttttgtttaattacttttaattacctgtttttcttttgtccttatgccctgaggtgagtttttcatcagtaatgggcatgattttatgaatatcacatgcaaacaagcaaattagacccactgaacttgggaaaccatttttccccatcccttctctaaaggttagctgctattttctgaaaatgatattgattctatggtaacatgcacaaaggcactaatcaggagaacaggagcttttgtgaattcagtaaagcttataaaatacctcattataacatgctaccaatctatgaccccaataatagcagtcccaaaattataaataaattagatgtttaaattgttacccttttttatactacatagtgtaacacacattataatttccagaagagctcttaaagaaaaaaaatgtggagaatgaaaattgaaaagcagcagctgcttaggagtgcttaacctagagctagacgtccaggcagatcgaaactgcctgctgctcctccttcccttttcctatactgcctacaaataatcggtttgatttttcataccacgattttgattaagcactgtgtcattatttctgggtaataaacagtttttattattttcagtttaaagcaattattgccaaaaggaatttttaattttaatattaatttatttagagacaggctctcactctgttgtccaggctggctggagtgcagtggttcaatcagacctcactgtagccttgaactcctgggctcaagcaatcctcctgcctcagcctcctgagtagctaagaatacagggcggtgcccccacatctggctaatttaaaaaaaaaaatttgtagagacacggtcttgctgtgctgcccaggctggtcttgaactcctgacttcaaggaattctcctgcctcagcctcccaaagttctgggattacaggggtgagccactgtgccaggctcaatttttgtttttaatgataatagctaattctgatgagaatccttgaagcaaaactctcacaccttgctagtgttccagcatgtataatcccctgttatagcctgaatgtgtcccccagaatatgtgtgttggatacttaatccccagtgtaacagtgttgggagatggtgtctaatgggaggtgtttagataatgagagctctaccctcaaaaatggattaacactgcaatataaagagctttggggagaagggttctgcccctctgctcttctgccttatgaggaaaaggattccttccctctgggggatacagcactcgaggccccatcctaaagcagagaccaaacccttaccatcagacaccagatgctggagctttggtcttgaacttcccagcctctagacccatgaggaaaataattctattctttataaactacctggttttaggtattctgttatagcagcaaaaatggactagagacatctccttttaaaagtcttgcatgcactgataattgttgatgtggtaaattgaattaaataaaagaatctaaaatgactgtcttaatttttttaaaaacagttttccattgacaggtgttcaaaacagcattatttttaacttttgggtttgtgtagtaaattaattaggggttttcttttatatttgtgttttccaatttttctttaaggaggatttagtatttataattacaataatttttagaaaaacattctcatttaaccatgaaaagagttttaaggtattcacaataacgtattagagctcagtagctttaacacatttctttctacaggtacatgacataagtgcatgatgatatttactaaaggatagaaagagaagtcttaactatcttgaaaacatgaaacaatttaatggtgagtttaaaaaaaacctatgtattgcaattaattgacaaataaaatattgagacatgggctttaggttcctctgaggcaaaaaaaaaataccctgtttattaattttttgtccccttctccttgctgttgtagaatatatgaacatggtcttataataggttcagaaccatggatagcagatccatgcttttaggtagatgcggcattatcttaagagacaaagtatctgctgatcttcagtctgctttgtagtggcctcgttatgagggcaaatcagttaccttctctgggcctcctttgcctcactggtaaagcaattcattgccttgcctttccaataggggaaaattagactaaataaattttggccatttacagctgaggactaggacttttttttaatcgttctgatacacaaataaatatgctctgacattattccacggatgagttttactttttttgtttacttgaatgagaataatggataagaaaaacattttcaataaggttaatttatcaatatatctacttccctattgtcttcagtccatagttctagtaatgagcgcaccacaaaattgataattccatcagattatcatggaaaacgagcattgttgtatgaacgtttttgtgactactgcaaaggtcaggaacaggtctgctttgaaaacttcagataaagatagtttttaaaaagttccttaacacacagtcctaggagtacgctattaatttttcaacttaaaaaactaaggtttccatatcttttttggtagcttcaagggaaaggaaaaaaaaaatgccttcacattcctaattattttgaaatatttttcattggttactacttcttaaaaattcattatccttttttttttttttacttttagattttatcaaaaccatatagctatttcctctctgattgacaaataaagccactatcggtttggcacaaaatctagaatatggtagactctcaataaatgttagatcctctttttcttctctcctattctttcctatttctataaggtacatttcataagattttacatgtggcattcatcttctagatcaaaaaatgtatcatttaatggaaaagaataaagtttaaaatcctagattagtgtctgcgggtgttggtaaagctgaatggctcccacgttttggataatctcattcaatttttcttccatatttttccttgaatttgccactttctttctttcaaaagccaaggctctcaatatgtttggattctctgttaagttatgctgtttattcaatggaggcatgaattcaaatttgtccacataaatttgacctcctaatgctacacgttgttattggatttctgttgtttctcttttaagtggccctggttgtcttaaaacctgctcattccttcttcgagctgtcgccatcctctacaatgctggaaattcacaatcatgaatattatacagggagatacaataaaaatctatgtctttataatagagtcaacaggtataaaaagaaagttatttcaaataaaaagtttaatattctacatttcataattattgggaagctttgagagtcgatcccaggaatgctcttatcacattattcattgtggagaaaaagttcagtaaagtaaatatagtaattagagctcatgcaagaccatcagatggtaaaatatctaaattatctcactagaaggctgtttatagcaagggaaactaaaatatcattctaacaatgtatacataccatagagagaatgatattgagtctaaacctccaattaagtataggcattaaggatgcacatcattagaaatatgctgtgacttttgtttcagccaattatagaaggaagttagagctaagaatttcttgaaaggtgattttagatgtgagtgaagaggaaaagacaggaaataaagctatcatttattttttgtcttaggacaacactgaatatttgtcagaagcatctgctccttaaataacacaattgaataaaaattggcatctgaggtttgaaagttaatttcaaaggtttattataccacagggttcatatttagcagctgtcaatttgttatcgacaagtgtaataaaattcagcaaaacttgaaatcttcccttgccaaagagacagctgtttctgaatgttggagatttggggagtttttttttaaaccaacctctatttgaaaaagaccttacttttatttatcaaaaaagtcatttgatgataaaatattgatattctttaactgtgtttgtaaaaaaaatatatatttttaaatgtgggattttgttgttcttgctgattcaatatttgtagacagtgtttcaacctgggtaatgtggaccctccatgggatatctggcaatatctaaaagtgtttctgtttgtcacaactagatactattggcatctagtgtgcaaagaccagggatgctgctaaacattcaataaaatgcaggacagctcccacaacaaaggattatttggctcaacatgtaaattgtaacaaccttgagaaaatttgttttaaggaaactgatacaatggatttagattaaagattagtttgcatttacagactttctaaaccatggttttcacctggtggggagctgcaggcaggcaccggttgtgctttaagtaagtgttatttgaacaacagagtaaaactccttagctcgaaattatagcaagtacattcgcactgatgtaattaagtttgtgtcagttacactgaatatatttctatgtacaacattttgtaactgtgctataaaaataaatctgtaaaaagttcgacaggaagtttctttaggtagtaattgttttctacagatgcattagctaatattctacacagactccataattcatattaaacaaaaaacttgaatattgttttagtcctaccttttaccccattattttctcaacttgacaatactaataagcaaatctatattttcaaacaatatctctagatcacacattccttaaataattattttaagtatgctacataaccaaaacagacattttcagggccgaaataaggaccagggatccacattttgttgaatgtctactcagtcattgagaaaagtactttttatttaatatcaatttacttcaataaaaatgtcacctaacatgtaaaaatacttaaagagagagtactatttaacccatgaaaaataaaagaacagaatgagacagctgcaaaatcaaatgtatttaggtgttttagctaaaagtatacattattccaataaaattaccttttgcaaataatattactaagaagaaatttaaagaaaacatactccactatcataatggtgattttcatttaaattagaaacacatttcaaaattcatgaccttggaaactctcatttcatttgagcctccagagtagtgtgctgtctctctctgtctctctgtctctctcaatcttttaatttaacaaatacttatatagcatttacaatatacttgataattgtagaaatattttacaagtattaactcctgatgaccctataatgtaggcacacatattatcgacattttgctaacagtggaaccgagtcatgcagggattaagtaattggccaaggtcccatagctagtaagtgacagaggtaggatttgaattaaggaagtctggttccaaaagccttcctctttagcgccacgtaggtggcctcccctcttcattacatagtattacaccttttatttatctcaaacttgcccaggtagtgtgaccttggaggagacatatgtgaaaggtttcaagtcaagtcaaagcctgtgggaaagtgatggggagaatgagagaaactgaatgatctcaccagctaatccatccatggagatgctttgttcagaaatctcttagaattagaagtacaaacatagttagatctgagttgaatgcatctgatctataacttccatttgtttatggcacacattttatatcactgacaatttcttttttctctacaaggagaggcagtatagaatggtgtttaagagcacaaactcaggagttaaatctcctgggttccgtttccagatttaacttgctattaccatatttgtattgtatctcttgaatggtgaacagagaaaatatgatgtagtcaagaagttctctccttcctgagcacactgtcagattacacttccccacttcttcctaagtggggccatgtcattagttttcaccaataatgtaagagtagaaataaatgcatgatacctgaagcctcagatgcattgagagccagtgtactttgtctttgctcttgttcctgccttgtctagcatctggatgcagaagatctggatgcagtgaaagactcaaaggcctaaatgatggtggagtcacaatatgggaggagtctgcatccttgaatcatcacagggattaaagcctccaccctgatactgaactatatttgactgtacaataaacatttataataactcactgaaattttgcattatttcttacaacaactagcttttattatactactatgactgcacatcattcatgtgagcaaaatggtcactcttttaaacttcaaattaccttggtttaaaatagttttactcagtgtgtgttcctcttcaaaagagctttgataagcctcattacctataaatatttttctgtatagttccaaatgttaaaataacttagtagagatgcagatatttatagcagttaaatactgatttataaaaccacacaatactagtacaattgatggaaaaactcataaactaagtaaaatatattgaaactatctgccagaaaacctgcattttccatgatttgaatgggccacttcaatgaacagaacaaataaaatggctcttgtggccataactctcacaaagaaaattatttctgataacaataccatccttttctgtaaatgtatactacgctcaactaacaagggaatctttactttgctacatcattaccaaattggtaaataaatctaagtcttcatgtcaacatttcaagaagggctccctaaagcttgtaaattgtcaaagatatcagattttaaaggatatgaacctcttaaaaagtacttggatgaaatgttatgttcagaatctcaaatatgaattcattgtgttcttgtcagaagttacatcatcagggtcctgagctggtgctggttcagtcccaaggaaaagaggaaacttgtgtattactcagccctggcagatgagtagattcttctataaccttttcatcaccaaatgtctcaacgaatttaaaaactaaagattatttcttgatttggccaggttccttgtaatcttgacagtaagaagctcagaaaaatttcctttgctgtgcatcatgtatgctttactcaaaggccgaaaagacatagaatgcttcttctgaactttcatttaaccagcggaatttgtgagggtataatattcatatattttattgaggagatataagcaatatctcttaacatgtagtttttaattgactattaagatacacaatcttttaaaaatttcaaaatgactcaacccaaattatttagaatatgatttatttcaaaacatttttaaaattccttccttccacaattgtttattttgtctatccagttttgtaataaatgctatatatataaagatggttcctggcattaaacaacatctgcaaaacagtgagcaagaacaagatatttctagaggtaagtaaggtccactaaaacaacataaaatcatagttaataacatcataaagtcaatggctgattctatgttttaaaatcagacaaacaaaccaataaagatcacacctaaaacatgtgcaactgtatagcataaaggagttcagaatgagactcaaccaaattattgcgatcatgaatattacacatcctgagaaacaggaactgtcatagcagtcttgaccacatgttcacatactcaagttggataaaaggaaaagtccaaaatcttggcacaccaaggtaaaaaggtggatatatatttaattaacatttaaaacaaattttcccatttctccacaaagagctcattttttaaatcttaaggtttagtgaagaagagatttcaagcccactgcaaaatgaataacattcttttattatgctgttgatctccaaatatgcaaatgcctttttctttaaaaaaaatagtggtagtttgaaatcaggtagcatgatgcctccagctttgttctttttgtttagggttgtcttggctataaggagctcttttttggatccatataaaatttaaagcagagtttttttctaattctgtgaagaaagtcaatggtagcttcatggggatggcattgaatctatacattaccttgggcagtatggccattttcgcaatattgattcttcttatccatgagcatggttccatttgtgtcctctcttatttccttgagcagtggtttgtagttttccttgaagaggtccttcacatcccttgtaagttggattcctaggtattttattctctttgtggcaattgtgaatgggagttcactcatgatttggcactttgtttgtctattgctggtgtattagaatgcttgtgatttttgcacattgattttgtatcctgagactttgctgaagttgcttattaaggagattttgagctgagatgatggggttttctaaatatacaaacatgtcatctgcaaacagagaaaatttgacttcctctcttcctatttgaataccctatgtttctttctcttgcctgactgccctggccagaagttccaacactatattgaataagagtacaaggctacagtaacaaaaccagcttgatactgataccaaaacagatatatagaccaatggaacagaatggaggcctcagaaataacaccgcacatctacaaccatttgatctttgacaaacctgacaaaaacaagcaacggggaaaggattccctatttagtaaatggtgttgggaaaactggctagccatatgcagaaaactgaaactggatcccttccttataccttatacaaaaattaactcaagatggattaaagactgaaatgtaagacctaaaaccataaaaaccctacaagaaaacctaggcaacaccattcaggacataagcatgggcaaaaacttcataactaaaacactaaaagcaatggcaacaaatgccaaaattgacaaatgggatctaattaaactaaacagcttctgcatagcaaaataaactatcattagagtgaataggtaacctacagaatgggagaaaatttttgcaagctatccagctgacaaatagctaatatccagaatctacaaggaacttaaacaaatttacaagaaaaaaaaaacatcaaaaagtggatgaagaatatgaacagacacttctcaaaagaaggtatttatgtggccaacaaacatattttaaaaagctcatcatcactggtcattagaaaaatgcaaatcaacaccacaatgagataccatctcatgccagtcagaacagagatcattgaaaagtcagcaaacaacagatgctggagaggatgtggagaaataggatcgctcttaaactgtttttgggagtgtaaattagttcaaccattgtggaagacagtgtggcgattcctcaaggatctagagccagaaatatcatttgacccagcaatcccattactgggtatatacccaaaggattataaatcattctactataaagacacatgcacacgtatgtttattgcagcactgttcacaatagcaaagacttggaaccaacccaaatgatcatcaatgatagagtggataaagaaaatgtggcacatatacacaatggaatactatgaagtcataaaaagaattacttcatgtcctttccagggacatggatggagctggaaaccatcattctcaggaaactaacacagggacagaaaaccaaacactccgtgttctcactcataagtgggagttgaacaatgagaacacatggacacagggaggggaatatcacacacctgagcctgctgggggttggggggtaggggagggatagcattaggaaaaatacctaatgtagatgacaggttaatgggtgcagcaaaccaccatggcacacgtatacttatgtaacaaacctgcatgttctgcacatgtatccaagaacttaaagtataataattaaaaaagtggtaaaataaaatgaaaatcaaagtatttcttagctagtatatttcatattatgtgtaaggccatagcaaaataaatcagtatatcttggtggcaaatgatcaattgacaaagccttctagaatgagtcatctcaaaactggtaagaaggaagtcactcagtataagcagaaagggaatatggatttgacagagtattcaaactacaccgaagcttaaacaccactttactgttcattttatatacaatagatctgaactctaagaggcctgcaatcatttaaagttattgaattagtttatcaatagattttaagcattaatttggttgagtctcattctgaactccttcatgctatacagtttgcacatggatgatactcagatgaagtattctgattgacttttctacatttcacaaatcaaactcaaacaatatacaatcatcttgaatgaagtggtatgagattagtagcaaaaggctgaaagaatcagaaatgagttctaatactatgtcattgataaacaatggacattttaacttcaggatactaattttgaaaatggagacactacattctgttcaactattgggactataaagaaactagagtaagatcatgaaaatggtaaatatcataagttattatctccaattatcacaggaaagtttgcaattaaataccattttccttaaaagagtaagaatatatttcaactatgaaaagtttttttctatatatgtatttttttcttaaagtggaggtacaattacactacataaattagttgagaatgccacaccaaatattgtatatgcttttctcagggatgcataaaagtttattcttgggtgtgttctaacttcaaagagaattttgtctgaaatatatgggacatttttacatctcaagcatataggcaatcatcataaaaaagttatttagtttctagtattaactaaggctttatttgatagcttaatgatctttaaaataaaaacaaaacattgccattttctgttgatttagcctctcttctatgaaagtctccaagccccattatcacaccttctaactttttttttcttttttttttttttttgagacagagtttcactcttgttgcctaggctggagtgcaatggcgtgatcttggctcatggcaacctccacctcccaagttcaagcgattctcctgcctcagccttctgagtagctgggattacaggcatgcgccaccatggccggctaattttgtatttttagtagagacggggttttttccatgttggtcaggctggtctcaaactcccgactgcaggtgatccacctgccttggcctcacaaagtgctgggattacaggcatgagccaccacacccggcctacacctcctaacattttaaagtgttaacacaattcttttatttacaaaccttttattttgaaatacagaatcacagaaagttgtgaaaatgtaccagaaattcttgtgtgtccttcactcagtttctttctttgagacggagtctcactctgtggcccaggctggagtgcactggcgtgatctcagctcactataacctccgcctcccaggttcaagcttttctcctacctcagcctcctaggtagctgggattacaggcacatgccatcatgctcagctaattgttttttgttttttttttttttagtagagacggggtttcactatgttggccaggctgatctctaactcctgacctcaaatgatccacctgcctcagcctcccaaagttttgggaacacaggtgtgagccaccatgaccggcaatttcttacaatgataatatcctgtctagctatagtacaatatctaaattaggaaattgactttggtctagagattattccgacttcactggttttatatgtactcatttgtgtgtttgtatagttataggtagttttatcatatgtgtagatatatgtggccaccaccacagttaaaatacagaactgattccatcatcataaggatccctcttgctacctctctttggcttacacaacccctctccccactccatccttgagacttgtcaaatcaataatctattctccatctctataattttgccatttcaagaatgtcttctaactggaatcatatttatgtaacttcttctgttggactttttcattcagcatagttcccctgagatccatctaagttgttgtgtgtatcaatagtttattcctttttattgttgcatagtattccatggcataccatgtaatatgttatacactgtgcataacacattttaatacatgtattaacttaatacagtgttattaactctggaaacaaatttttgtttgtgtttcttcaaacatacagcttctaaaactgaaaatattggctaggaagacatatctaaattataaagaaccaattgttcatatgctatataaaaatgtttggagtaagagggcatactttcataaagtttttttttaagtcctaaaaagaggattttatctaaaatagaatgcagcttctaagttctaaaaatattatatatcctattgagtagctcagtttgtagctggaagaattgtgcctgtatcccagaaggtcttataaataatttattcaatttcagtatttaatttaattcatttacaaatgagatgaggttagattattcagtgtaataagaaatctgttagagaaaatagtatttttcatagttgattattatagtatcattttctttaaagcatgaaatgcatcttttaaaatattgattagagactataatgtaactttgctgtaattacaatacttgtcttccagatacgtcctgaaaatagttggattaaacaaattagtgaacatccattcaataaaatactatgtagcaatttataatgatgataaagatatacaatttaatgacatggggatatattccttagatgttagtaatttgcatagcaggttacaaaatagtttacataatataattatatttttgtaaaatgatacctatatatccacacaggcatacaaatcggaagaatatatacttttttttggggggggcggtgggggacagagtcctgccctgtcacccaggctagagtgtagtggtgcaatctctgctcactgcaacctcctcctcccaggttcaaatgattcttgtgcctcagcctcctgagtagctgggattacagacatgcaccaccactcccggctaatttttttgtattttttagtagagacaaggtttcgccatgttggccagactggtctcaaaatcttggcctcaagtcatccgctcccatcggcaggctgggattagaggtgctgggattacaggcgtgagccacccgccccacaggaagaatacgtaataattgtgtagtaaaatacatatttttaaaggggcattctgggctactgttgtgtatattactctttaaaccctttaaaatagtcttgaactcaatctgacaagattactgttctcatgtaagaacaatattttccttttactacagggtcaatattcttgcacaatagtattgcattcctttacttattcagctgtacctaattagttaacaagttcactttaattattttcataaaaataattccatttttgatgatccttccatatcctcatcatcaataaaagcagcagtcacatagcactgattaaagaaattacttcaaaattaaaactacaaaaataaaggcttcaatatcatagtttctctaaatgtatcaaattcagctgttaaatatatttagagcctacgagtgttctggtattgtcccactcacatcttatgatttctttttcctttactttttaccaaacaaagctgctgtgttatcatttaggcatttataatttattcctgcttcttattttacaacaactttcagtgatatttataaactgtggcatattagtgattgatattatgtataaccttgggtagacttctggcagggcttctcttctgctctctctcctgtcactactggcagcatatacaaattgttaaattgccctgagtaaagctttattgtgccactaatatctaattttcttttgaattaaaaactacctttcatatattaagcatcaggattagtacttcaaagatacccattataaaatttctcaattaataagatactcatagaaaaatggggtcaattattggcataattatattcttttaatattttatatccattaccattctgtggtcacaaaactatctcaaggacatactgtcttttaatttggaaaaaaaaaagttgagcaatttgaaagtggttgtatgaactacttacagaaaacaaacgtgaatcctacactgttgataatgactattacactactattactccttacagtaacagctaatgcttgtgtagtagtaattaccatcaattaccatctatctgttatgtaatttaactccttttgtcttaactacaaccctatgagttaagtgacttgcccaccaatttactggcttaccctttggtcatcagataggggaactacaactcagacccaggtggtctggttctgattacataatggtaaaatggttattacagaaatttatctgaatatggactactttgtgactaatattcacttgaattttgtgtccccaatgcttccttcatattcaatcttacccgtgcctatactaatcatcaacagtttagcttgagagctgcagcagttgactagttttccaacagctaaacagaagattctggctatttatatgagcattctcttaatgctttactatattatgaactgaccctaagggctaaatattatttacaaatccaagaatacaaattcataaattctagctatttttatgccaacgtggactgccaatttgctttgaattatattaaaagttcaaaaactttaaagttctttacccccccgattccccaacttcaaaacgtattagctgttacaattcatacatggactagcattctaaagatgtgacagttccctttgaaagataatgtttggaagtctcaagacttgaattccagtgtcatctttgctctatgatgctggataagttacttaaactctctgggttttatttaattcctctggaaatttaaacataatttttatgagaatggacttttctaagatatttttacaagaatctaagatgaattagagattcacttaatgatgactgtctgaaggaacatgcatgaactggtctaatttaaagagatttctttgagtgatctgtcatttttctctcctctttgttcaaattaaagaacaacaacagataacgttaagtatttttatacttcctaaaaacaactttaactgacagagtgaaaggtataaaacttcaccctgtaataaatttgaggccatctttagacagaacaaaattaatacggccctgtagatgaaagatttacacagatcgattttctgtgcccattgacagagcaactggataatctgtggtagtcttttacacttgagcagttaaaacctcagatatatcctggactgaagattggtcagcagttcttttctggtccatgaataattaaaatcattcttattctgtattctataaatatgcagagaatgcaagatttgaaccatatacattccgctggagaagctgcttgggtccaagcgaacctcatcagcgatcacttcaaagatcaattcttcatgtccacagcatcatgtttaaatgattgtgtgtgatccagctgcttcttgtctccttgttgcttcatgcatgatctttactcatgatctcacaaactatagtgcttcagtagtaattctgcattttgtgctaaattttaacagtgattgccattttataggctaataggctgttgttgtgcatatttattataacacttttttcttttcctatcaataacagtgctttgcttagataatgagaagcaataatctctttaaaatatttacaagtctattcatcatgggaaaaaataatcttacaaagacagccttctccactggcattgcttttgattgtcactctcctccctcttcccaagacaggcatttccataattgcatcttatctttttgtatagactgagaaactggcaataactatgcctgggcaactgttttttgaggaaacacacaaatactacctgataatgtgattatatgcaatgatctaacttgctcttacttttaggactattaataatattaatgattttaaaatataatattatcatagtttcttattctgattgtagagtgagaagaaagaaatgtaaaggtagaatataataatagtaatattgtctgtacttaattccttggatggcctttcttttttggtttgttttattttttattttttaattttattttaagttctggggtacatgcacaggatgtgcaggtttgttacatatgtaaacgtgtgccatggtgatttgctgcacctatcaacctatcaactaggtattaggcccaacatgcataaactatttttcctgatggtctccctacccctgaccacccccacaggtctcagggtgtgttgttccactccctatgtccatctgctgtcattgttcagctcccacttataagtgcatgttcttagatatactctcttactaatctgtgtagggtagattcactccctgaagtcactcatggggttctaatttctatagctgagaaatgccttttagatgcccttgttctatcatacaaaaacactgttacttattagaattccagaaaagtttcctaaacaccatcaaaaattgtatggcaaagaacatgtttgtacctcatcaaattttatttatgttttgattatctaatgtgctagtcatgtttgtgactttccacacgaaatgatttcccatgttttctttctaccatgcaccatccttatcattaaggaacacaaatacatttaatatcaatgcaatcagtgtagaagtgaggcaatatgacacagtataaaacaggcagatatacagttatatatttatcaacatgtcccatagataacatatatctatattccttcaactaaaaagatttgtttaatattgccatttattatcccatatttctattttaaaatgttttgcagccataaaaacaaatgagatcatgtcttttgcaggaatatggatggagctagaggccatttttctcagcaaactaatgcaggaacagaaaaccaaatactgcatgttctcacttattagtgggagctaaatgatgagaacttacgaacacaaagaaggaaacaacagacactgagatctatttgagggtggagggtgggaggaaggagtggagaaaaaagacaactgtcgggtactgggcttaacagcttggtgattaaatgatctgtccaagaaacccccatggcttgagcttacctatgtaacaaatcttcacatgtacccccaaacctaaaataaaagtttaaaaatatatcaaatgttgggataatatggacagagtctcctagcaaactttttttcagaaaattatagtccactttttgatgacggtgatttcaaaggaaactatacttgagttcagctgccaaatctttgtttttttttagatgcataacagttcaagtaccattctctcttattttgtcacctgggaaagaggtcaaaagcacagtgggacactttacggggaacctgagagtctaagaaccattcttacatgccattagcatatcaattgatcatgaacatttaaatttggtagttttaggaacttagtttccttttcctaaaatgaagactttggattagtctctgaagcaactttctgctcgaaatgttgatgaatccgaatcaccttttcattcacttgaaatgtaatgacgtttttgatgtctacgttacagagattgaagtaacgcatctttccccttttacactattatattttgtgatgttttgctttaaaaagttttattttttattaatcttcaaatttcatatttttatccttgataacttccttctagagatgaggccagtgataagcagtatcttaattctcttctgtaagtattttttccttttgcatatgttctcccattcagtacagatatcaatttagctatttctttattccagacacaattctcctctgagattttcatcaataaataaagagacatgctaatatcacagctacttgacacctaccaaaaccctcattaactagtggactacaacataagagaatgaacatattttttaaaggccttattgcaagtcaagtcacaaagttaatacttccacatgtatttgccactcttttccttcaacagaaaaagaaattccagttggttgtaaagtcaaatctcttgtcttttcagtttaaccagctgcactctaagtctcaagacaactccctccttattctatgtttaattgactaccttccctatgccattatccatctgcatctttatgaacataatcaaacctccaacccttcagatcatctgtggggcattgctatcaccaaatagcaatttaatgctgagctttatctttcctggggattttataaagccttgaaagaataaagaatctagcagttggcacactcacttgcatgcaaacttagattgttaggaaaagaaaaaaacatttagataattaaataggatcatttaatagttcactcatttcataggatgagtgaggcaccaggggaaaagtggattgtttgagataacacagctagccatgatcccatgtaggagaataagactgctctaatatttcactctagcaccatccctattacatcacacaacttcccacacttccttcgtattttcccatgataaattataccttctgatttttccccaacctctcgaatgcccataatgtaactgaagaaatatagttccttaaaagtagctatggtttctaaaggcaactcaatgatttttaaaatacaatacaaattgttttttaagtgtttgttttgctttccagcttcaagcagaaccatcgatgtgacaaccgaagacaccaaagaagcagtcctttattattcaagatgtcattaaagtgcagggatcctaaaaccccattctagattatcccttagtatggatcaggctaaaatatttgcttcatgtgaggccctaggtcttgaatattgcatggtttcttgtactctgcaaatttcttctgaagaacccccttgggtgagtgactgttgtcagtatttatattaatgaacttttggagcacaggtatatctccaaagaggaaaggcctaattttgtccccagagctacaaaggtgtatggcatggctgacactccccagtagctgcccaaggatagcatggtggcagatgcattatcagaacaaaaagccaagagtgcccagagctgaggacctgatcaagtgaaacaatcagtcctctctgtgctactttgcaaatggttcatatacttttcaattagcacctgtcatctggatgcaccaattttcgcagaaatattttgaaaggacaattttatttcacgttagctggatgaaaataaaaccaaattccttctagtcagaaatatgtttggaaagattgaatccaaaggttcatatatccatcattggctccagatttcattataatgactgcaggtcaaggattcctgcaaagattttttaaaaaaatagtattttagaaatcatattttgaaaccaggtttgcttctgtttagttaactcccagagaaatatactgtttttggaactcccaaccccaccccaccaaaatataatttgcttttaagaatgtaaaaggattatggtttacacaagaaactaaaacaaatataagaagaaagtgcatgtatgccaaagtaatcgctctctctcttactcattctctctttcttatacacacacacacacacacacacacacacacatgcacactgacattaataagtcagtaatgagtatattagtgtctctatttaagttttctggtggaaaccaaactcttaatgctattttaatgaaggatttgtcagtgaattgtttccaagagtggtaagggagcatgcaatcacatttttataatgtttggcatcattttggggtgtaggaacaagcagattaactaactgaatgatacaaaatggtccactcctcttttcttaaaaagacacattgctccctgcaaggctgcatgaaatacaatttattctttttggacaatttcataaaacaaaagtggaaaattcatcctagaaaatcagatatatagaacactacaattttattactatttctggacaaattttcctaacatccttgcagccttctattatgattcacaatgtctgcaatgagagattagatgacagagtaacctattaaggaacagttactatgctgctggatgcagctaataattcctttatttttcatttttattactttatagtttatgaatgtacaatctactcattacctattataaatattttgattcagcaatggaaatatacaccagtaaacaaaacctacttgaagctttatgtattacatacccacccataaatgtatatcatagcatttgctgcctactagacttatttcttgagaatctagatgaactcttaatcttagctgtaataactacctgcaaacttagtatcatctctgctgctttcactgttttatctactgtctggagtcataattaattggcctcattactgtttctactatgaaatacagtcttctaagacattaatattttatcagagatactagtcttgacctaaaacagagaagaataaaaacataattgtgagttggaaatttttttaacaataacataaaataatcgatgttttggcaagaattatgacaaggctgcagatagcgacacacagctcactgagtgtaaatggagagaactaaacaggctctcattggtgtaacccttctaaaactctctagctaacattcatgccaaaacatccaatatatcaaagactttgtagcaatctggaataaaatcatttggtttcctctagactgtttctgcaagaagtaaatataacccagatacaatgaatgaaatgaaattttagtgcactgagttatggttttcaaaagtaagagcaactttagaacactaaatttaaagtcattcctaagaaccttctggaacctatgaaaattgtattaggttggcaaaaccttctctcgtcttcctatttctttttttcatttttcttgttctttttatcagtcaatactaaataagaatgtgctgcccaaaaagtgaagctataaatcgacttctgaaaagcttccctttttctccatgggtctctatttcattaggtcttcttttattttacttctgttgcccactgtttaatttctgaggccagtattttaatatcctttcaagtattgttttcaagatgtattgtgtagcagatcagtaaacaaatagttatttgcctcttactctatccaaggcaccgtactaaatgctatgcagaggtgaaaagtatgcttactgctatgcaataaattacaatctaatgaggagcataaaaaacacaataataataaaatagttcaagtgattttcaaccttggttgaacgacggaatcacacatagagttctaaaaagacttgacactaagaccttacctcaaaatccattaaactagaaactactgttgtcaatgtttaaaaactgaatgatagggacaatagtatggttaggatccagtggaagatgttctaaatgagtactcgttgtaaatagcacatcaagtgtccctcaagggcaaggatccagtggagctttaaatctacgtaacatgagggaaagtaatgcattagtactgttctaaagttattcatggaattctctcttctgatagcttattatcttctgagttcatagtagatattccatatctcaatgaactggttttattaggaaaagaaggtgtactggttatctgttgctgaataataaattaccacaaaactaaatggcttaaaacaaccatacacacgcattatcctcactgtttttaagagttagtaattcaggggtacttaactaagcagttcaagctcatggtctcatgtgattgtcaccaagtttctgaccctggctatagacagccaaaggcttgagtagggctggaacattagcttccaaggtagtgcacttacagagctagcatcacattgttcttagtccattggttttgtatttctccttttccttacctgtatttaaaagttttccttaagttctattttccccactgtgatacctaggactatcaagtctacttttattcaatacattgttactgagtatctctcctaatcaagacattatgccttctgtctttccaagcttgaatacatcacaagttaaagggggaaacacatttgttcacatgcagctactatgcctactgtactgttttaatttaccataatggacaccacaaacaaagggctacagcaaacgaaaggaggaatgattagttacacaggagtggtgtataggaagaattaaaaaagtaagctggggctgggcgcggtggctcacgcctgtaatcccgccacttttggaggcagaggcaggaggatcacaaggtcaggagatcgaggccaccctggctaacacggtgaaaccccgtctctactaaaaatacaaaaaattagccgggtgtggtgctgggcacctgtagtcccagctactcgggagactaaggcaggagaattgcttgaacatgggaggtggagcttgcagtgagctgagatcatgctactacattccagcctgggcaacagagtgagaatccatctcacaaaaacaaaacaaaacaaaaaaaaaggaggcaatggacttgagcagtaatgataaatttgagttttgagaggcaagaaaaggaactattgacttaagcctcttttctgggaccactggtactttgttatcctgcctgacacttatagcaaaattaacatatgtctaggctaaataaacatattaaggaggagatgatatatgaatataaagtatattaggggaggcagaccaaatagcttcaacatttatagtaaaacaaaatacaacatcattggtagcaagtgagagaggagggtttgaaaattcttaagatgtgaaaatgcatgaattttacttggaactgatccacatttttttttgtttagacttttaaaataactctatagcaacattcaataacttgggattgtactggaaaaagtaaacagtgaaagggacacagaccagaaaattaaaaatggctagatgtcaatgggagaagaaattgaaggtcccagagagggcagcctggaaaacggtaaaaaagatctcctgaagtctgagagggtataatgaatggcaaaactgtgaagagcctggagaatcaaggtcgtactgcaggtgaagagctagcaaacctattgccaggtcttctgataactgaattaaagtcataattcagttcttggggtcaaagattgaaaactcagtatctttttagcctgaagtcaaagaggaatagctattttcctcaagttttacaaagctaacaacagcaaggtacattggtctaactttttcttaacaacctagtgtaggaaacaaactctgaaaaaccaacagtcaaatgagctctacagtttgtgacatgggtctttacattcttgaatgtgtttctgttattgctgaaccttatttttgtacaagggtccatgtttgaagcatttgaaagatttgaaatgttggaattccatttttagctgacttttttatatactgagttttctaggcattactttggacaacaggttaatgcttgccttgctctctttggatgctgtctactccacacaggtataatcatacatacatttctatctagacatcatgaagattccacttctgattcacaagagctatcacaatgttgtacaagtccatattcttaggataaaaaggttaactctgtgtctcagctttgtgggcagaagaaaagagaagacatatgccctattatttgtgttatattacatgcattatattttcgaaatggcatttcaaagaaatagctacaaaatcaatagttcttttcttcttcatttttttcttagagctgaaaactgttcaacagctttatcgtattaaattaggctttcttaatcttaagcagtgactgggtgagttttcctggggaaaaacaattctgaattccacagtgtttaggaaataatacaatccaaatctgagagaaaaatttaacgccaatactgtgtaaatatttcacaaaatatttgttctcaaatattcaactttctatgtatacattatacagttttgactcaaagatcactaaaatgaacctaaaataaacccaccatggaatagtaacttccaataatcagtctttcgccttaagtgaataaggatcacaataacataaaatgcagaggctataaagtaaaaagcagcactcaaattgtagagctgggataatacaactaggtgaagttaaaatttgaaagaaataaatgggttggttttgagtgatggtactgcccatgattttttactttaaattttttgtcactattaacaaaaaataaagttatttgaaataaaaatataagaaataccgtgtgtgtgtgtgtgtgtgtgtgtgtgtgtgtatgtttgtatgtaagacatagaggaaaagacctaaaagatacaaaatgctaccttccaattcaactgtagctattggctctgtcagttttagccttccaagttgtttatttccatgagctcagacaaattataccactgactcatgtgctgctccctgggtgcagtgagaatattaacctttagaaggggccttaaaaatgagaagtgttatatgaattgatattttagttgtgtgttgtgtataaacttttctggatatggcttgccatttggttgggtgcttatttttggccactcaatgtgcataccaatgtgtgtgacttcatatatgggaataaatgttggcatttggattatttttggccaaagagtgggtgagaaattagacacactcaggagccaaaaataaccaaatggcaagccaattacataaatgttttctggcataccaaaaaaaatctggattagttatcataaaacaagagttttagttccagttattattactattactactactattacttctggtgttattcctactaaagccactaatctctattagacacttatgcttgttaaatttataaagtttaacatgaatcattccatttacaccaaacactaatcctatatatgaagtgaatatcagtactataaatacatggatatcagtcccacacaaagacaagaaaaattatgcttagaaaggttaagcatcttagtagagtcacacacaaataagtgacagagttgatgagaacccagacatactgaaattaagaatcagacaattcatctgcatggaaattctgctactaatatatcatgtggccttgagcactcatgaaaaactttgcattttagttttatcatctgaaaaatgaaaatgagtatatgtgctgtagaacatgagtgtaagtgctataaaagtagaaactgatggaatgtgtaaagtggatgattactgaaatattttccctttcctataaacctaatagatcatttattcttgcatctgagaaaaaaatactaatgatcaacagaagactacatgaaggcagtaactctaatattttcacggtattcttcaaagtttgaatatacattatagttcatttgaattctttcaagaatgccaagaaataggaccttcaaagtgcaacatacggaatatatgttataaaattctatgttgtataagtcacacagatgtggagaatggaagaaaactggacatcaagcagctaagcactttccacacaaaatcttgtacatgattgcttataatagcattactcatgattaccaaaaggtggaaataacccaaatatccatgaattgatgaatggataaataattgcagtatattcatacaatggaatattattcagtatttaaaataaatgaaatactgatacatgttacaacatggatgaaccttgaaaacactatacaaatgaaaaaagcctagtcacaaaagatcacgtattatattattctatttatatgacatgtccagaattagcaaaggaatatggagaaaaagtagtagttgtctagggcttgggagaaggagagagaagggatgtctttcagggggttccaaatttgattatggtgatggttgcacaactccgtgaatatactaaaaatcattaaattgtacacattgagtaaatcacattgtgtatgaattatatcctcataaaacaaatgaaaagttcaccaccacctcccaaagaaatactagaaaacttatttatttgcaaaattttcaactgcaaaaattatatgtgtgaattcattaaacacttatacagtacaataagttatacatgcatacacacaaatacacacacacacacacacacacacacacacacacaacaatttttttcctaactagacattttgaaaaccagttttaggacaggttgttgtaaacaaaagtattcacgaggtggtcagaccaatttgaaattatccaattggcattttcaccatgtctcatgcaaatgtatgtcagaagataataagatctcagaggacatttttttctttctagtcagctgcatctacccaggcttaatttcaatctattgctcctcattatatccctttggagagcctaattccattccccacttgatggccataccctctgtctaaacctgagcatcagtataccacatcctctgcagtaatcacacctcgggacagcacattaaaaattacctggaactcccaaggagctgacattatggaccctcaggttgacaatctgaaacaatgtctggaaggttttgttttgttttgttttcagctttgctctactattgaagtaatgtttgaaaacgtcatttgttaaaatgttaacaaagcaaagttatatataacatatatagtatatatttaattacatatgcaaatgtaatatatattttatttattatgaattacacaaacaatgtgtgtgtatatacacacacacacagaaatgggcagtacacacacacacacacacacacatacatatacacacacatacaaacccagtgaatccgaatctgagtactgcccattttaatatcatgtcataatattgaaattaatatactaagtgtacattaggttaaaaacagctgctcttctagcactcttcttcaagaaaaaatacatagaagaaattcataaaagtatgttagatgctaaaatctaaaattcagcagggacttaccgatggggtataaacaagattaatcaatacgatgtgctagatttcaggagaggtaagacacattcaccaaactatcttcacattttatctacctgatttaaaatacaaaatctttccatgttagaacaggtgtatgaatttactaagagtataagtagaaactgctattaaattgctgtggaaatacttttcatatttacctaccttgtcacaagatgaattttttaaaagaatacctctgtaactcacctcttgaataatcccttgtggtcacaatggaaaaaatatttttttattttgatacttactgatacatgttatgccttattatagtaacttaatatatacaattaagaaatatatatttatatatcttccccttaatcttcttaaaggaatttggtattattaatctactcttaccaataaggaaacagaaggttgcagatgttagataatttgcttatgattccgtagctactatgtgacggaacttgactttgaatcaaatattatacttcaaaggccatctatgttctttcaagcatagcagttgcctccacaaaagcattctgatcattgaagagtctaaactcaagaaacaaaatatgatcggctttagttcttctaataattgttctaatccatactattctgaatcagctatcatttgggaaagttctcttaatatcttggcccaaagtttacagctttttggccatttcaaatctcttccctgctattcagtaccacaagttagggcctttgttgtttccatgtagagtaggagggacacaagcctaggttggtatatggtttgaagacctgcttttcccctttcttctaggcccagcctcttcttagcccttgggtgaagaagaggagaaaaaggcaaaccttcccttcctggacttggtgagctgctgtgctccactagttagttgtggctggcttacagcctgcaacggttggcaggagaacccactgtctggtgtccaaatgatggtgttctgaaatgcactgctcatttccctccagtggaagactgaatttccactcaaccacttttgcaccttctcagccagtaactcacactaccagggtaccctcatccagtgggcagacctcttatgtactagcacaatgaactcatgcccagcaactttctgagatgtccaatgtatcaatgagagatacagacatcttcatctcacaaacagtgagtgtacaggttactgcaatgctgctacccttttgtcagccctttactgaccaagcaggtatcaaatgaaggaaatacagttccggtctccctcctctgaccattcttgcaaatctttgtaaatctttctcacagggtatccctttccagttttgaaaaggggatatagcttttcttccagcatatgacattcactaaaatgctatttgctccatttctcggattattttgatttagagaggaggtggtggtggagggtcttggctcctgtccatgagcctgcaggggctgtactccaccctgcttcccagaagctcttagaaaatgcaggtcctgaatatccactgtcctcagtttggggtctgagctaacattcagggacaacaagcaaaagctcatcccatttaattacacttgaaaataacacgagtcctttaagttgtagcccaaattttaaaaaatcaagctatctttcaaaacgtgctaacattcttgcgttaacacatttgatgttaaaacatttgggtcttgttcattgtctctttgaataagctttaatagatatttctcacacaaactacatataatatagagactgtatgtaatttccatttcatatttgcagcaaatgtgacattttcctttattgcacacctcttatttcttcattctcaactctttgaactctgaaagcccaagccttaagtcaaaaaagtatgagaatccatgtccacactttaaaaaggaccaagaacacaaggttgtgaactactctaaacactgaaagaacaatttaagtatttctatagccttcacccctggagtactccacttctttgataaagtgactatttttgcaaaaagtctagtgaagttcatgagtttcacttctctcaggttgagagaatgagttaacttggactctagcgttcattataaacactagagatttaatatatggccaaatgccagagagtctaattcaaggcattaacataaaataataacagttaccatttatgcaatacttgtggtgcactagcactatgctaggcccttcacaggcctagtttcaggattacagtctaactccatgacgtgggtagtattggagccttcattttacaaacgagaagactgaggttgaggaattaagtagcccaaaactgtaaaggtggaaataattggggccaaaattcaagtttatcagttcaaaatagtttttgaaaatctaccatatccatggcataggtacttaaataaaacaaacaaaattataccctttgagaatttctatttggttctgtcacaacacagtgcctacattcttacaactaaagtatgtatgtaaataagacatgtttcaataaaaacatggaaaacatttaacagatatctgatttattttcattaaacaaataatagatataacttggtgttttcaaattatttacacttgttgcaataaaaaataaaatgagaaatgtcatagatttaaatctcagttgtacttaaagcctctgcaataattcactttgtaaccactgtatatatttattaatgaagtattaaaaaataattgtgctatactatatatgtactgttctatgtattaacgataatgctgtattagtgatcttattaatgctgtttatctctcaactctctaacagtatattttccattcaaaaccaaaattataattacttgggtaaatattatcatttacaggcaaataataagaatttgaagaaaatcaaaacagaattggtccagtcaagcccaggcaatgagacccaatcacaaattcgtgcataaacttttgcctaaagaatagccttgttttgttttctccttgtatccaatcttaaaagtgttttaatgaagatttgaatattaagaattcattataaaaataacaactcatcatcgcactgtgtttggtttattcaaaaaactctaaagttattaatttcagcttcctaattagaataatccaattttaatctactggcatttttggagatgaatggattggtggtgcattattctaaaagttaaatctcattaatatttaattgcacccacattcacaggtattaattagaagtgttttatgagtcatagctattattggaaaatcaggtacaattttataattagcataaaatgaactgtaattttgaataatcactgatagtgatcatttagtagaccttgtgagattattaaacttgttgatccatataataatttatatgtagactgcatatcaccattatagtgatacttttgagacaattaaaaataacattccctttcagccaagcaggaacacatatttcattgttgttttgactatgaataaaaaccctttctgctgaatacattttaaagcagtagtagaaaatagataatgtactagttatgaaattgaataaagcacaatcaaaactataattttattgatatttatatattattatatgtttatatcaagatctttcaaataaaagatatatttagcttttaaaaaataaaattactttcacatacataagacttgcactttgctcaaacacacactatttaagtggtttaatcaagtctaaataatggatagttactagaaattcccaaacaacaaaatgacacagtgatatataagttaagttctattaaagagaaagcttttgaataatctctatccatttttctggctttcataataaaatgtggacataccaaactgacttgaaaaaaatttaaaagtggccactagattcaagggaaactttattttaggagaaaacttgttgagggaagttcctcttataccttatgtaagaaagcccaatataagaattaaccataggaactgctgaaaaacctccccttaaatgggtagatgggttcagtgaaaaacacacatgcacacatacatatacacatatacatatgttatatttatatcattttgatatcatgcttagagtatctgtatcctaaatttaatagaacattgaaaataagaatccaaaatagtacttaataatcaactatttcttcttaagatgaaaatattcatagtccctaaaagatgattaaattcctatatcaacagactattaatttgaattataaaccttgtaattttcatattaaatgataataagacaaatataatatgcctgtgatttccattataacagcaaaagaaatgtgacgattcaataatcaaatattttcatatatactggagtctataaagcatttcatataggtaaacttgaatgaaacctaatattatatactaaatactaaggaaatatcgtcataatgaaggttaaagtttagagataactaaaaacaacagtatagtatattctgtaggcaaatgtttaatgtatcaattatacatattacactcttggttataaatactaaatatctcttagtcaaccagactccatttgatgtgtaataattttgcctcatcaagaagaagacagggtaaaaaaagaacaggaaatacgtgttcttcgttcatttaatacatataattgacaatttcaggaatatgctgtaatgtactctacacaaatcttgcatttcctttggctcattcatgggagcaaatcaatatgaattcctaatacatcttaagagctacactagacagaaaatttttgcttattggcaaactaaatccactatatattcactattaaagtttcctgtccttaaaactgtcccctcaggatttaatttaaaagcatgggattcactgaatatgaagtatatttttccaaatttataattgaaaaacaaagtttgtgagtcatcttttttcagttttaaattctactaacttctttataaatgtcacagaaactctcagaagtagaaaatcaacaagataagcagtttcatggtagtgaaaaaaatatgctttgaatttgcaaaaaaaaaaaaaaaatgggtttgcctagaaaagatatcaacactttaattccacagattatttcacccattaagttagcattccctcttcacctatatggctaatattaaaggcctgtgtgtgaccctacaacttaagtcttgtaagagcatcgatttgagtctggttttttttttctctcttctatacacagcctccaggaaagtccccaaacttagaagtttttgataaataactgttaactgaataaatggcaaagtttgtcatttatatgtttatttaaatctgtagcctcaaaattggtaaaagaagttgaaggtggtttgggacattacagttcctttatctgagtgaacgaggcagaggaggagcattcttaggaaacaaataaaccaaaaatattactcaggtcagcttgaaagaaaaaccaagggaaaggaataagatgcctttgtcaatcacacacagcccctttaacctttcacagtttgcttgcattatatgaaacttcaaggttaaatgcaagacaaatgtgaactgatatttctgcaagggtcaggtaggtaccagttgcaagtcattatgattgcaaagtggttcttcatcatgagaatttccaaactgcaagaatatgcctgcaggctttagtatgggaaacactcattaaagtagtaataaaaatatcacctttgaaattgtttcccagtttctaattcccctaagatgtgttctgtctttataattgctcatagaaattaacattggtaccatggcagacaggagctggttgttgtctttgacattaggagggtgctgcacattctggagatcccaagagctttaatttgagaaacagtggtcaagtgaacgaggtgagataatatctttattcattcaacaaatataaaatgaacatttacaataagctaggcacggttttaggtgctggatatacagaagtgaaccagacagacataataagttcctcacttatacagtttgcattctaatgatactttaaatattgaatacattttatagaatgaaggaataaaagctatgtgactaaggatataagaaaagacaggaaagaaaaaattgggatgaatatattgtttgtaaaaacaatggcactatggattgtatgtgaacttcagcttgtgaatttctgctataattgattttcctatacaacataatagaatgataagactgtataatggatctggaagtttcgttagtccaggcagccctctgatgcttaatctttccacactctacacaaaggaacttgtaatactcatgacctcttgaggtagcccattccatttctaacccaccgaaatttttaggtatttctagtcaattaattatcatgcctcctcgagtcattagctagtggttcaaagaatcttgtttggactcctaaccaagaattctaatcacttttaatttctttgatgattttataatttaacttggtttcaacttttttcatcaacttcttgttcaactctgaaggtattccatttaaaaagtgtgacaagcagagcactccacaaaccccagcagagtcaccactgcagctaagaggaattcaccacatccatctttctaaatattaatgcatcctaaaattgattagttttacttggcaacttcgtaaaactattgacttacattaagtttatgctgattactaaattgtaacagtttatttagttgttgtttattttgtgctttacttaaatgtgtccctcagttttagagttgtcagtcttatgttcttggatttgatacttcattctagcttgggatactcatattagtcataactttgattttcagcttatctacatactgagtaacaatatcttcttttattttaattcaagatattggataattttcatcaggccagggcaaggataaagccctgtaggaagaactagcaatctcactctgtgatcacaattcctgaacatatccagtaattgtccctaaatgggaaagtctttagcatacgtctttctctttttcaagtagattgcataaaatatgtatcagcaaatctctaatgctaaatattttcggttccttctaatccaatcagcaactctatattccatactttcagcatttaatgagtaaattaccaaataatttgggtcatttttgtccaggtagagactgatgtcaacattagtatgactaatgtaagcaacagaaacaatattaattccagcaggcacagaaaaaaatctactgcctagttataaaacagaattttaagataattcaaatatagtctgtattctagctactttcaactcttaaatagagagcttgacttctgatttttctaaggagtttactgataatttctctctagatttcatgcagaagtcataacatatcctacattttattttttaagtgactataagataatgaaactgctttcttgtatgatttttggaaaccacatagctctgtattgcaccatgatgacttcaatgtttcaaagtacattcacatcctgtttcattcgatcttcagaataattctataaggtggataggaaagtattattatctcgactttataaactgatgcagggtaaaataaaatatgtagcatctctaggactcagctcactttaatatagctaggtccctgatttgcagccacattattacctgaattgtacatatcacagaaatgagacagatggcggcaaccctcacaaaattcattttagataatatgttatttatctaattaccttcctattcctctgagagttgaattattttatctgatacagacttcctttacgttttcttataatggcattaatgcccctttacattccacctccattctaatcctactcccattctcctgattaatgtgctcctgtctttcttgtattgcattaaaagaaaaaggttattataaggctctgaaggtaaagaatgttacatccttattacacccctggggcacattttaaaataaaggcctattataaataaatactatatgttatgtgtcagtgcgattcttaaagctcaacaaatgaatccaattcatattaacatgacctgctaccaagtataaatattacagcttcctgtgtctaacattgtctcaatcaaatattactgggtgaaaacatttaatttataaataaaaatacagtaaaaaagtaatgagattgaaatcagaaaacctaaactctgatcattgcttatccttttattagtcatgccatttatccacaggccttaattttcttattcatgaaatatgcacagtaaaaagaatttctgtaccttttgaagttgttttaaaaagattatgtgtataatgctattaactttaaaacaatatttaaaataagacatcatgatattaataataatattaaaaaatcaggacaatctaaattaaggaattattgttaaatagtcaaacttctgcagagcaggcaattatttttatccattcttcagctcaacaacatgtatctcatgctttgcccaaccatatagccttatgcaaagtgaattctccaaagaaaatttaagcaagtacataattggcatttttcagctgatttcacaactgaatgtggttaaacctcatattcagttggtgacattggttaaatatttcaaggaactaaatatgcttataagtagataaagaatggagggagtgaagcaaagaaaagatggtgtcagaaaagttatttttaaaatactttgggcctgatacagtggctcatgtctgtaatcctaacacttagggaggctgaggcaggaagaatgctggatgccaggagtttgaggctgcagtgagctatgatcccaccacggcaccccagcctgggtgacagagcagaactccatctcaaaaataaataattaaattaaattaaatacttcagtgtcaaatgagttaattatctcaaatgtttataaacatcttaatgtttataattttaagatacttgttattgttttttcaaacttaatgctctactttgaaagagcaacacagtatgagaagaagggttcaatttaagatatttgattttgaagttgaatgaggatactgtatttaaaggcattgagccatacctctgaagtatttaccaatcggattttgaaaacagaattattacttcctttgaaccacttttaattttcattacaccaaatgaagagattctacaagatctacatttttcaaataatggaagtgagcagagactgagacatgccaacagatagagttttttctttcttatttttctgttttcaagccattatttaaaaaaaaaatcagagtgctttattgagcttagaaagacacagccttagggaacaaaatgactacactaattttctgcatatgctagttgggtggaaagttcaacacaagttttaatgatcaatgatgccacgttagcacactttcaaaaagtggatttcagatttgggtgtgattccaaacatgcacctgccatcctcaaagcagagaattcaggtccagaataatcacaagttctaaattatacacagtgtgttgtgaaatatcattattatttttagaaagtgaaaaaatatctgtgatagaacctatttaatgttttgtcagcctccacagatgtggctaaaaacagcttcccagtaatactttcaagggtcaaaagcaatgaccttgtcatgtttctgtgatcgtggtaaaacacctgggtcaagacactagtgaagattaataaggtaattataaaggaatcagaaatgttattgtagcaaagcagatgtagcaaaaacagcacctcctaatactattggtattgtcctcaacttttttcccaatccttgattatgaggaccaaaataaatatgttttacataataaaatttgctattattaagaataacaaagactatttaaaaagcagtagacttattctcaatcacatctttaaaaatcacctttgaacaggatgttcaacatgcatatcagagctgtgggagaatataaagcatgaccccatataccattgttattgctgtatctgtgcccattgacagttgagaaactaagtgattagaaaagacaaagcttaaaaaaacgtaaacttattggaccttcttttatctggctggatctataattacatgctttaaaactctctaggtatgtagttttttttaaaccctataagtaggggttcaactttcaatttagatcatgtttcagaaatgcctaaagagatggacagaccgaattataacaggggacctaaagaaacagtcctaggaaagcgtgcattctgtgggtctgtggagcaagtctgtcaacagaacgcctggttgaaggtcatctttccaacccagagtcctatgcagaaagaaacttaacagcaaagctttagactcttacttgaagtctctctgcagtatgacatcacttgcatacttattaaaatatttttgccacttctcttttcatctaacttattgttattgaaaaactagataagatatttcccatttagccattcatccagaaaacatttactgatgcctagtaatggctatgttaaaaggcacataattagccagacacaccatgttgtatctcaatttagctcattatttctgatggcctcctttgttttcttctgtttggcacactcctctcccatacatacctgaactacctcctctgcaaaggtgctcctgaggcatcaaggcaaaattcactcttctttcttatatgctactattataaatttcagtgcttccattattgtctttacatcattttattaaaattatttcttcaaaagtcttaatggagagttttcactattcaagtttattgaagcatatgcaatatctcatccacatttctatcccaagaagctaacaaggttctgttcactttaaagccctcaagaagtgattcatgaatgaacgaaaaactttccaccttcagtgggaattgggtgacagttagctcccagacacgtttttgaagagatctaccagctcttagtatgaataccatcctttctgacaaatggtgatgattctctcaaaatggaagaatatctctcacattctactggagatttgaatgtgttctccttaaagttagcaccttctttttttttttttttttctttctcagaatctaaacgtctttggtaaacttcatatttagccacagtgattatagccccctccccaccacatacccacggttttggagaaaaataagtttgtttatcttggagtctaagacagaatctaaactttcagcaaggccatagcttatataacagcattactcatttacttttttaaattagagtatctttagtctttgattaggggttggaatacaagtgagcctctaagggaaataactgcctttccaggtcctgaaacttatctgagatagaaaaacttcaactttgtacccagtgacattttagttaaatataatttaagattctatggattcctgttatacatatgcaaaacaaagtaaaggtgtcctttccaaaaatattcacttttattccatattgtttaaatagttttcaagagagatattccaatagcctttatttttttttcttctctattgccaatggatttaaatgtttgcttcattgtggcattccaaacacacaaaactccagtggctatgggttttattcctttgagtgaatagttatcgtacttcaaagactgctttggattttaagttagggtgacctgttttcattatattcaaacaggctttgatccatttctcaattaggtattgcagatgacaaacaggtacgtctagctttcctgccatctaaattaccctagaattctatgaagatgataatttgttctgtgagtacactacttctatgtgttatccacacaaatttcattatttcaagtattgtctttttatgtatctcttttgtggggagactaatattccaatacaaaactgtgttctgttttggggaaaaaaaaaaaaagagctcttagacagtcagaacatgagaagtttaccaaaaataatttgtcctcaagtctagttgataaaaaggccctatgaggttagatttatacaattttattggcaatgacaaaatctagaataaaatatataattattgaggtacttacatttttagtataaactggaataacaaacacatcaactttacaaacctctcatactagtgtctcactttaaagatattcttaggtcaaatacagtggctcactcctgtagctgcaacattttgggaggccaaggcaggaggatcgcttgagcccaggagttagagaccaacctgggcaacatggtgagaccccatctctacaaaaaattcaaaaaattagttgggcatggtggcacatgcctgcagtcccagatacttgagaggctaaggcgagaagattgcttgagcctcgggagtgtcgaggcttcagtgagctataaccacactactgtactctaatgagaccttgtgactatatatacatatatatacacacacatatatatataaaatctctctctatattatatatattatatattatatatataatatatatattatatatatataatatatatattatatataatatatattatataatatattatatatatatataaagaaaatattcctaaataagtggctctcatatgagccacaatttaaggaatattttcttaaaggcagacttagagagaaatatgagtcacactaacacaaagcataatcagcctaactcctcagtcaaacaccctgaggttcacattaccaaagagagaggtttgaacatgagggaaacatattattttcactatactgtgatggaaggaaattaattctggttgtgcaaacctagagcatttctctgaattctctgaactagggtggattgttaagaccaagacagagtgtgcataataaccttgatgttgggaaaagactatgccgtgagtcttaaaacagatcctagttgatgattatgccaaccctgctgaagaaattctgaaaagatgcagaatgccttgaaatacaaatgctttttctggcccagataattgatattgcattagaacattccatgggatttgaaccagcctctttcacactttagatttcaggctagtataattccctcaccacacaaggcagaaccgaaatccctgaagttcaacaggacgtatccaatttcaacaactttacaattttcaatatctgtacaggatttttgcaaaaacccatttcaaatatcccattatcagttccacgtctttttgtgaataccaaaatatattagctagaccgtcatcttattttagctttagaatgtatatcagattttttttccagacacaagcaattaaaggattggaaaatagctcatggaaagctccaaagaattgatcctcagagagcaaatcttgtaacaccaaacaaccacaattcccctaagccactctgctgacaaaagttattgctagttatgcaaggtaactagaagatatgcacacaaatcattgcaattaaatatcctgcccaccatataactgatacttgccgagcagatggttggcagaattttcttgctaatctcgtgttatcaatgtccatattgcagagcatccttgaaggtgctcctctgtttgttttgtattggatacacctatttgtattgttgtatagttatctgtgctgtgtgtcttacccagtctcacccagttattttactttagaatctcatgggctgtgtatcgtgaagacaaacaacctgttggaaataaacaacaaagaactgaatccctcttatctgttcgctgcctaacaaatcaaaacacactgaaatctgggattattagagaagttttggggatatagaaataaaataaaaaccagcttgtcaaatggggctgcctgctgctcagtaccatgtgttaccacagcaagttgcatctgttcagctattaaacctgttagtgaatataatatagacagccacggcattaacaaatattcttaatgcctattaaactctacagctacacattttaatttttacattgtattagtaaaattcaagactatagcacctttaggacaatttaaaagtgcaatgaaaaaactataattttggttatatctcacatgcttaaattatatttagccatcattttaagaattggccatttaaaaaaaagttctttaatttttaaatgtggttctcactgctaactgtaatttagctcactatagatgcaataggactgaagtaattaatcacatgtagaatttgaaaaactcaactaggtacatcttttttccactactgaacatcttacttcctttcgatttaatattggctattagcaaatgccacagaacatatgagttactcccttgatataatccaccctctgagctcaggctcaggaacttcgtcatttaaattggctatcaacagctaggacatgtatgttttactaaacactttatagcagaatacatctgttgctactctgtttgttatattaagattaagcacaatgatgttgacagtattaatacatttaaaagcctgtcacgttccatggtgttcacgagtcctggggactgcaggattgaaataaaaagtgactagaggcaaaattaagaattatggaatgtgtagaaggtgaagaacacagaggtagactctgaaatgagtactgctacccaggaggatattaacctcttgcctgcctggcttttcccataatattgtgaagccacattttactgaaaagagccgcatgcttcatgaaatagttatccaacctccttggcctactgctgcttcatgaatgctgccagaataggggaaagtttgtgactgaagttaaaggggggttggtttcaccgctatactagtgtaattattaaaatgcgaacacactcaaattaaatacaccagaaagaaaatcattctatggagctcagtttcctaagaaataatgagaccaatttgcttttatatgaaaacactccagtttgtgatatcttcatacactgctggtgggagtgttcaacagtacaatgttcttagaggacaactcagcaatatatacattggttcggcttgtatgaatttgtacataaaaatatgcttttacacatgtgaaacgatatttttacaagattttaaaatgttatccatttgtaatacttaaaatgctgaaaaaattaaaatacccatcattagggtctgctaccctcataacatgtagcagatgcatgttatgaggtaaatatgagatcatatgctctaaaatgaaaagatgtacaaaatatattaaataaaaatactcaagttgcagaatagtatgcacatgataatatttcatctttttaaagaatgttcaggtatgttagcatatatacaaatccttgtacctatactatacacaaaaaagaaattgaatgtatatgcataagattaaagattagagttttagacaccacagtaaaaaagtgggtatattatatgctgtttttactttttactcccatcattgttgtattatttaaatttttcaatacaaatttttatgatttaaaaattaaattgatttaaaatatgggctttcctgaaaagtaaatactttcatccgtaggcaacaaataaaattcaattccttctgaacagcctgtcataaaatattattggccttcaagaccctacagtatgcctcactagtctattgaatctagtttatgtctggatgcttagaagaataccaaaaaattagtaagttaaaaaaaaagttaaataatataaatacagtctactgagaaggacaaagttaaggaaaaactagttaaatatggagttgatggttatagcatgttcctcacataacaattaacaatatctacatagcactctcaaattccagaaacatccccagccactgcatttatccaacacccttctcaataaccagttacaaataatcaaataaccatcggtcttgatttaggtatttggaggcggagctagaatttacaactttttcttcccaccttatgaaatatctttgcaatacctgttttttaaagatcaaatgaacacagttctggagcctagacgagtagctgtctaaccttactctgcgtaatagggctaaaatttcaactctatttctctgctgatgctctatgggatttggagcccccaaagcctgattttattcctaattaacagtaatgaacagatgacatacttttcctttgaacacctctgtcgggaaaatgtccaatcagcaagagctacaagcaatagacaaattccctttctctgacctcatttacatgcttaagtacacagagactccccctgcctttagtttggggtgcggggggaaagaagtaggtcaagacattgaggctttatgcattacctttagaatgtggtgaaggctgaaagtcatggctccaaccagagtttccagagcaatgtgggttactttcatattcatcacacataaggccaataccctcctagcagtattagtttagttctacatttaggcacaactcacaaagcagcaaagatacctataattgtacccattaagagacttataatagaaaatactatgtgctatgtcatcacactttgttgttatttagtgcattcaccttgagggtcacagaatctctggaattccatgtttaaggaatatcataaaataatacactacaaagactcactggtttcacatcagtagttgggattttataatcatttgcaaaataagctgggccagcctgaaattttcctttgtacaaagaaaaatgaagctttgaagtcatatacaactggttcaaagacaggcagttatttactatctgtatgattttggtcaatttatttataatgcagtctgctcattggtaaaactgagataaaattcatacctcaatgaattattgtgaatatttaataaaatctaattttatgcaaaatgtttagatcagtgtgtgttccacagtaagcaatcagtacactctaaagagtattgtttagttaccgttcttctgactaagccaaataatagggtaagcatgatttcagagggggaatttaaccctacttcagatgattcactgatagtacttccaaacatttaatatatattaattaaaataatttttacaactcaacaaatggagaaccaattttacctccctcagctaagccaagtgttagaggttggcacagcagaagattaaagagagagagagagggagaaagagagagagagagagagagagagagagagagagagagagaatggttaaattgccagggtagtggagattgatcatctctacattcctaatcaattagggaggattactacaggacagttttttgtttgttttcattctcctagtggattcttctcttctcatcaagtcaggatgcagggaaatatatcacataagtttttgtgtagatattagaaataaaaatgatacagagaacagacaagaagcatacctagactcagagaaatgatcacctgtgtgtagtatttgaatctgaaggtggagctagccattaacaaaagaaaagtcttcctttcataagaaaataacacaggaaaaatgaatccatttcatgacaggcctcagtcctcaggcctctgacttttgtttgcctcaggaggttgtaaatgggaagtcccaggagaacatcacgtgctttcacgattatcctttggtactgtacctcatactatgctccaaggagagcacttctggagtgagcgcctgcatgacaatggaaaactaccagcaggagggcaagagaggccacagtcaaaagtaaagcagcaagagttcacttatttctccattcactcaggtatgcattgcttcctctgtaaaccattactatgcatctactaagcaccatgctagagtatgaaaatacggacatgtaaagatacatagtattatacattgtcagtgaccctgaagagtttacaatttaatgggctacaaggacatataaagacatagttataactacagtaagtaacacaataggattaagaacaaagtattatgattgtaccaagaagggcataattagtcttgccctaggggacaaaggaaggtttcacaaatacataaaatatataatccaggcctcaaagatgaataaaaaagcaccagactaggaaaaagagaaggacaggtaggaataagaggaagtaggagtactttaaagaaaggaacagatatgaacagcggcactctggaggtctctttttgctgactctcattattggtacatttttttaaactgtgtttctcggtctttaaaattatttatgccccaaacttacaaatcaaactagttgcaaatgctagctagctaaccacaaaatctttggggtaactggccagtcagataacttcctatgtatttatttaactagagaaaatgctttatgtagcagatatctgaaatgctccataatttatgtgatatgtggtatactaaagggtagggttgtttgacttcataaaacttcattacacagaccaaaaggcagagttatctcgttcagcctgatgagggattgtctcctgaactctcacctgcatcacagaaggcacagtggttaagcacatggatttaggagtcagactgactgagttcaacactggttttgcagctcactagttgtgtgactttcatttcttcattaactacctgagtatatattttttccttttgaagttttaatgcatattagatggacttacatatgtaaacttagaacagttatgagactgttgattgcttttataaaagccacacttgtagactgcttcatagtttaaaaacttttaagtgtgcttttacagtgtgaggatttgaaatatcagcctattttctgtggctaatgtgccagtagaataatgattatgtagtaaattataaggtacttgaggtcagaagccatgccacatctgactgtatttctagtgctttggaaagtgcttagcacttagaagaaaaggaggtagaagagaaagaagaagaaggaggagaggagaagcacaaggaggagggggagaaaattttgttaagaacatgtattaaagagtgaatgtgtgtgaggtagaatgtggagtagctgaagatgaggctggaaaataagtctagattgtgcatacatcagaggtccagctaaggaagttggcctttgaagtatttgcagtagaccactggttctctatcagaactagaatcttgcttcaagataccaatctataaataggtaacacataaactggaaacatgctgatagttagctcagatttgtatctctaacccccccaaaacacatttaatataaactggcttctgatattgcctttaacctgagcagcaccgacctattgccattgaacattttcagaacacacatagtttaagttggtagaacttccagaatgcaaagattatttcaacaaatactgattgctcacttgctaaattctaggctcatgctgggctctaggaatactaaagtgcacgaaatagataaaattccctgctttcatgacacttgctgctcggcatcatgctgttcagtatggatgaagatttgccatcagagtttaaatactttaacctaattccaaattttgtctgcttcataaaattgccaacaaaaaatgcaagagtacacaaagacgggaaaaaaaaaaaaaaggaagtttgttgttgttattttgccaattttttccagacgtttgactttgctttgtcctggagaagtaaattactaagtgtccgtgtctataattttaataaataaaaattagtttctcttcatatgctattaaatacacattgggaaaaatacttaaagaatactatgagggggcttcaaattgacaactgaacagggagcccatgcccatctctgaccagccttgctaccaggtgagaggtggaaacacacccttgcagagcagtgggagaaaatgggtgaaaggactgatagagtaccaggatttgtgctttttttccactgatgagcagctcataagtgagcaaaattactgctgaaagtgggtgaacattatcagccaggtatgtcttgaactaaaagaggttgagacccactgtaactgaacatttgaagccagaggttgaaacaccacaattttattttataacaatcattctggtagcagtgcagaggatggattagaaagggaagatgctggaggcagagagattagttagaaggctattgcaacagttcaagaagaggtcattaaactaaggcaataatagtggaataaaaagcaagcagataccttctaaaaattgctgttcagtaggcaagccagtagccatatgttgagcatttgagatatggctaatgtgaccaaggagctgaattttaaaatgtatttaattttaattaagtttgttgtaagtttaaaagatactcaaacttttaagtatgtttagaataacttgagtatgtgaatctacttttacaactgtagatataacaaaatataaaatgcttctgatggaaaatttagattctgaaatgagaggtgttgttaagtgtacaagaagttccttgttttgacagcttggcataagaaacagggtttgctaaatgttaagtgtaaaacacacattggatttgaaaagcttattatgaaaagataatagaaaacattaataatttatatcatttatatattaaaatgataatattctgggcatattgagttaaaatatattctcaaagttaattgtatttagtaaaactaattccatctttttttccttttatatgagtagtagaaaattaaaacttacaaacatggctcatatatttctcttggatggtataggttgagagacatggtagcaattcggtgacaaactgattagattgtaaaggcaagcacggagtaaaagatgtcaaagatgtagcctgtgatcgtgtagatgagtgggtgattgggagatgatgagttcagttgttaatgtggtaagtttcagtcgcctgtgagacacccaggtagagatgctgagtaagcagttggaaatattagtatggtagtgacagaagtctgggatggagatgtgtctttgggagtgagcagccggcacttatttgatagctaaaattcagagtaaaattttaagtatatgaagataccctttttcataggccaaaagccttactaatcaattaaatttgatctttcaccaaacttttttgtctgtcaatcacgaatttccattctttattgggcaggaaggatttaagggctaaaattccaggaagagcccaccattaaagcatttacttagaagcctagttgcagtgtgatcttccagggcagttgagcgtcccccattcagggctgtgctctgttggcaaaaaggttagacagttttccagtttgttttgaggaggagagaggcctcctctgtgttgtcgatataagaatccctagttctggtctagcacaccatctcctaaagtaactcctagagacatcacaaattgttttcatcagaagaattttctcagaccccataaaaattatgtctagtcctccgattctaatttataatttggattatttatgtctactattaacttgagtaccccctatctatgcacctagattatttccttccattgtttaaataaacttgcccatgtctagagtgggccagcatcagcattaataggattctaatgctgtagaatcaccatcatcatcttgttttctggtctttggctgacatatttacaatgctgtttctattttgtaaccgctactgccatgcattttgcttatggctttcagcgcatttttttttgtgtgtgtgtgtgtaataaaagtaattttcctgatcattgtgcaaatgacccatattcagtatgtattccccaaactggttcttaaccctcaagcaatgtctttgtttctttttttcttccatcaatctatattgtgtttagagttctgcaaagcctccttaataacgtgcttgcatatagtttaaattattgctcatcatttcttcccgagacacacagactctgtctggatcataagggtaaacatattggatatgttctaaatacaggagttcttaaccattacttcttctaaaaattccagaataactaagatgctcctggattcctaagtcagtgtaagattataaatgtttgctcttttaagcttctaaattatggaaaaattggttacacaggaactaatcacacacattataaattgcattataggtgatcaaaaataatgtgtttattttgcctaaaatgtttcttaaaggtacgcttttgaaaaatagttagtagctatagaagaaattgtggtatagtcagtagtcagaaagaattcaacaagaagttccttgttttgacagcttggcataagaaacagggtttcctaaagccactcatcactggctaacttaagaatagatttgaagccattctataaaatagcttggggcccaccacaaagcagtgggtcaaaaggagtagtgatcacaggatggagcagaatcaatggacatgattttctccagctaggtaatgtcctaggaattgtttctgcaactcttccaaagagattccggagacctaacttctttctgctagcttaggaggtgaaaagatccaggaccaaccctgaaaacactcactatttgaaaaaactgttcaatgactgagtcaaatctatatagtgagagagaatgggaagaaatcttttgaacaggaattagaaatagagagatgacaagaagctcattttttaaaaaaagttaatatgtttcactggagttgaaagataagtagaaaaatgggaaaaatggacacgaaaagggaaagagatcaaaatgctgaagacattaaattttaggtacagaatttgcctttacccatatataattgcagcggcatcaatgtgttttaacaaaggaataatatgatcaaagaaccagattagcaaattaacctgccataagtatataaaatggatagaaaagtactcagaatggagacagaaggatagctgagaaagtgaggcagcagtacaagcctctaagtggtaagtatgtgaaccgagaagaagctagaaatagctgttttgttctcatttcttaaatttcacagcaatagaatttcagatgaggaaataactctagaattctagaaaccaaaaacatagagattaaatgacacactaaagatgatgaccagtaatttagaagttgagaaattgaattaacttccaagggaaaaggatgaaggtaggaatctgtattgattcatttacctctcctacctcccacataataaactatttagcacttaagccaatagaaatgtgaccatcatttctcacattttccccaaaaatgacttttacacctcagaagtttggacagtaattttacaatacatggtgaaaaggcattatttaacccatcttttgaaattgtagtaaaataggccacatgttctctaattcatataagaattaggaaagctacctcgtgatacggcaatagaaaaaataaataaatgaatgtaaaagaactaggaaagcaaaaccaagcaatatatatacaacatatgatttacaggactgaatctgaatactatatggcaaagttaaacctctataaaatcagtgcatctgttgattagaaagagtatttcaaatggaacataatttctattcaaggaaaaccctgaggggaaataactgggtttatcttgttgatataggtgtgcatctatgtataattactgactttaaaaaggtatttctgaatcaaatcttaatagaccagcaagataaataatgtataatggagagaagcagagaaagatgagaaagacttgacacgtcaccaatattggtgttattttgggacatgtaatatttactataaatacactgtttctagtctacactaaaaccaatgatcaaaaggcatatttctaaatcaaaatcaattaagagcttggtttcaaaataaggcttccggcccagcaaagtacaaagaagcaacacttaaggcaaaaatgtgcaacaattcactcatcaaatttgcaatgctcttttatgctcccaagatgaaaggatttcaaaacacactcttcactcatcccctcctccaccctcagtgacatttcctctggtcagaaccaatgcacatgttaatatttgtggtagtgaatgcatccagatttatagtgactttcttctgtcagagaggcattaagtaatttccaaatgacatcactaaactgctatatgagcgcttttctctagaagtgacaacattggtaaaatttctagatatatcttatataatataaaaacttgagctaaatttttcttattgcttctaagaaattatttaagtcattatcagttaaataatcctcaacacatcgtaacttaaacatgtcttgtgtaacacttcacagtttgcaagttatttctttatattctttatcttaaaaatctattatttgttaactgtccacacaaatactatacaagtaagaaagttaaaactgtaaggaagagagatgaagaaatatcaagacagaaaaataccaagaaataccagtcatttggggacaaaatgtttgctataaatcatataagttaactggatctcagctagcttgttcattcattcatccaacaaatatttattgaggtggttactaaacaaccagctcatttatttttgtatccacagagcctaacataggcctgggtcatattaggtgctaaataaatatttctggagaggcttctaggatgtactgaagtaaatgatgaaaagtcacattactgtattatttttctttcttttcttttcttttttttttttttttttgagacggagtgtcactctgttgccaggctggagtacagtggcacgatctcggctcactgcaacctccaccttctgggttcaaacgattctcctgccccagactcccaagtagctgggactacaggcatgtgtcaccacacccagctaatttttgtatttttagtagagatggggtttcaccttgttggctagcatagtctccatctcttgaccttgtgatctgccagccttggcctcccaaagtgctaggattacaggcgtgagccactgagcccggctatttttcttattaatcatcaccattattataaatcatgttctctgccatcagaaagtttatttctatttgtaaataatggacagatataaaataactagagaataattcatgataaaagtgaattacaataaataaggcaattattaacaaaaaataaacattcatccaactaaaatttcaccatagactttctttaaaccaccaatcaccataaccaattcttagttgaagatttctgaaaactacctttaagatttgaagcttctcaataatatggctgcttatatcaagttctatacttttctgtattgtaatcaggaacctggaggactttctcagagttatatagaaattaaaatgtctgtcactttacttgactgttaaataattgaagatctacactcatcctaagccacagtattttcaatgtataatttattaaatctattaaattctttcagaaaatatttattgagcactcatattctaggtactatactaattaattgctcttcacttcatgtcttaccttctcctcaccccttcataaaaccttaacaatttcaatagtaatattatatgactttgaggttaacagtggtagcatcaatattaatatgacaaaaaaatccatctatcaaaactgggccacctgactcaaaaaccattttattccaagttgttatgtttttaagagtacagttaatcaaaatttttaaaaatccaacatttttattctgaaaaattggatgacaaaccatgtcaaatattcaaatcttcattaaaattatatgccaatcagattttttaaattatctaatttaaatagcagtatatatttcagcaatgatggagcatctcttaatgcaatcaactttctaatttattggcttactctatcaaataaggatgaaaatattaaatctgatcagtacatagtatacttcactgactttgaaagcttacacaaattttccttgaagtttaatggataatgaataagtctaacttttacagataaaaatgtatcattgatagcatagcaccaattaggttaatttttaagtcagttatattcacaaacctaaatcataagcaataatctagaatttataaatcttatttttccttttaaatttcaataatgaaagaagtagaacaatttattgggcaaaccaaaatggactcaaagatacctaaataatttgataaaacagcctttcaatattctcaaatctaaatattaagaacagttctgcttctatcacccccaggcattatcttgtgttgctttgcactttctttgttcctttcttccctccctttctttctttcttctttccttccttcctttcttcttggcttcctgtctggttttcattttttcttttaatttctaattcctctttcttttattattccatgcacccaacattttgggaaagtgctggaggtaaacttaggtagtaaaaagaaaaccactggccttgtgttaatttttattatatgcttaaaacatggaaaaaggccgggcacggtggctcatgcctgtaatcccagtactttgggaggcagaagcagttggatcacctgaggtcagaagttcaagaccagcctggtcaacgtagtgaaaacccgtctctaccgcatatacaaaaattagctgggcgtggtggtgggcacctgtaatcctagatatttgggaggctgaggcaggagaatagcttgaacccaggaggcaaaggttgcagtgaactgagattgcatcattgcactccagcctgggcaacaagagcgaaactttgtctcaacaacgacaacaacaacaacaacatggaaagaaatgacttatctccacatcaaagacttgttgagtctgtaatgtctaatcacctcttctaggcaatgggagaaagaaaatttaatttgaccagatttgaactcagactgagtcccattagttgataaggagtgggtagggctgacaataaacagtatttgagaagcccaggaggacacggtttacgagcaagggagattttgaagatatcaagtccaagagaaagggtgtgtagagacatgcactgaatccaaagagaacgaccaggcaagaccaagatcggagattcagaaagaagaaggccttcacagtgcagctatcagaaatccatggctcgtaaaggagatatggagggtattacgctagaatggacgccgagaaagtcaattctttacttatgacaggaccctaagaccacatttgaccagaattggaaagaaatacctattcttgcagtctaaaactctttgaccataaaataaacaacagtggtttgagtaattcaataacacagccccttgtgatttgagagtgatcattgtagaaccttttctcagagtaaaagtgtaattggttatggatcaataagtaatttattttagaaggaaaaggcccttgttttcatttttatttatttattttttgaagtagcaaagctcttaaatcagaacggagcaaatacattttgaaagttgagcttactctaaacagcaagattccttactgtactagtaaaatttatcttaactgatcatttatttatgatgccataaaaatccagatgttcttaattttgattgttagaaatttgctaaaaggcacctgaaattacttttccagagttcccctcttgagaactacattttaaattgaaattttactatggttcaataatggctgtgctgaggggttttgttgtgtttttcaagcttatcaatgaattcagcccttgtggtcagtgtaaactcctacacagcttattggaaattccagaattctaaggcaaaattaagattaagaaaatagtttaataaaaacagagaattaaaaacttgtaaaagtttgtgctaatgtactttggtgtttcatgtttttcttaattattttagaactggtacccgatgaccactttctaacaggaaagaacatgatgacctaatcaaatgtcctttggagagtgagcactgatagaaggagaacttatagggaaagacaaaacaaaatagaacaaacttccatggtcgcttaatgcatgggaaataaacagaacctcaaggataaaaaagaggatggggagacttacctgtttcttctgaaatcttccaaaagatagactttagaccaagaactatgataataagaaccctttagaaaagtttttgaatatgtgacacactacgattttttggatatatcaataaaatattcatatctcttaataaaagacactgtgcttctttacaaataatgcaagaaaatgaagatttaaagagttgcaaacatactcattaataatttttaaaatgcagagaaataagtgcccctgaaccctaaagttaattatggcaactttcaaaggaaaatgaagtttttcattcatgactattctttgctatctattatatgctgagtaaattactgtgggaggcttacaactttagagaaaagagaatgggcccaggatgtaagtggtaattatgaattaaaatgtattttcctgacacgtatcaaaatgagtacaaaatggcacagaaacaatctttttgccatcttgtttcacatccccaagtatccttaaagtatactttcgttccttttatttcatgtagcttcagataagtactttctctagtgagcaaagaaataaagacagaatccagatctttggatgtcaccagtattacaacctcctgcttccagccagatggtgtggtatctactaggcaataacttattttattcatttggcaagtctgcctaaagacactaaaatcactccaaaatttttttaaaaattattttgaacacagaattaagaggaattcacactccaaaaaaaaaaaaaaaaagtttgcattgtaaagaacgcgattaactacagcaataggtatatggtcttatttcctctagattgtattcatatttcctataacaaagtactggtttctgggggaaggaagcatccaagaagcaaaattataaattctttacaaaaagttaacagtaaaaagtaaaagctgaatcttatgcaaaaagtacttactatatgcagttctaggtagtcacccaagcctgaagaactgtccactcgcaccaatacggcttctttctgaacagtgctaaaacctatggccagtctgtctgctcgtgtactgggtcggtcattaggaggccacttatacgtgatttgtccaccacctttgctaaagatatatgtcgtcccagctggaaaacaaaaaccaaaaccaattagtccaaatacatcaagtctgcacattagcaaggcatgttatattgatatatcagtaaagtatcaactctacacacaaaactatggcaaagtaaatcatagatttcaatcaaatgtgctcaagaaagtggaccaagttgttttaaaagaaatggagaggtagctcagtttttaatacactgattcaatttaccagtaggtgtttcagaacaaatagtaggttattgtgttttccattgagttggacaagaacggaatgtaatgaggcattatctcttcctgccagtttttaagaaatagtttagtagaaaacattgactggatgcttccaaaaagcaacagcagcacacatcaacttggtattgaaataggagctgcatgcagatgtgacagggtcatacagcacagtggagaaagtcgcaacaaatgtgctaggaatgtaacttttatggaaaaaggatctacttacatgtgacagataactaatggatgaatagccacaagccccagtagccatgtcaagaaaatacagataatagatgtcatccctagaagtcaggttttgtttaacaagcaacatctagtagctgtcaaactattcagaatcataaaaagacccacatcctctgccaccccaaggtgaatacaagccttatagcactgagaataatgtcacggactcattctgtgagtgttcaaattttaccttatggttgtctggtcagtaaattatccagcttaaatgaaaagagtctttttcaaacaaatttattcagcatttgatatggtttggctctgtgtccccactcaaatctcatctgaaatggtaaaccccataaaccccatatgttgagggcagggcctggtggaaggtgatgggatcatggagtggctttgcccatgctgttctcatgatagtgagttctaacaagatctgatggttttataagtgtttgacatttcctcctacacacacttctgtctctcctgctgccttgtgaagaaggtgcctgcttccccttctaccatgactgtaagtttcctgaggcctcctcagccacacagaactgtgagtcaattaaacctcttttctttatcaattacccagtctcagggaagttctttatagcagtgtgaaaatggactaatagagcatttggtgcactagtcttacctcaatgcatcattcattggccacccattttggttctattattttgaggtcctgaatagaaccaaaaaagaaagaaaaaagattggattttccctctgtcttcttctgactgcttaaaatgggacattgttgttttcctgcctttgcagcttcttgttctcatgccttcaaacctggactaaaatctacatcgttgtttctccagttgtcagtcccataatcgatacccctagcttttctggttctctaacttgcagacagcagatcatatatgatttgatcatatatacatgattatacataataagagaaaatatgaaaacttaggccacaaaacttcttgtatttatagaaaaatagcttgtaccaagagtaacatttatgtgtaaaagttgtgtgtacagcagtatgttttgaagaaaactatacattgaattgccatgattaccaagtttaccagttaaatggagttgacctactatcacatttgtgtacatttaattaaacagctgacaatattgattttgtggccatttttggaagcaactcttctttgttttctgttacagacatttccacaggcctttgagaaattccaaagacctctgcaatatgcctattgtacctgatgcttaaataggacttggtatatagacctcttccaagaaacatgttaggagaaaattgaatgcaaaagtgataaacatgaatactgttaaaatgcaaagctatagaggctgtacccttctctattaattttgcagataccaatgcatgaaaacagtttatctctttcaagagagaaaaggcaagccatatttcaaaagcaccagtcagtgcacaaagaaaattcagaatatacagagtgtagatcagaaatcccagggctttcctgagccacttatgttctacatcctcagaagcttgttcatcataatctttataggcaaacactatttgagaaatatttttctgcctggtaatttttgcaaatgattaagtattaacttttctagtgaagcccattgttgataaaaataggacaagaacataaaaaagtggagatggctttaaaaggaggatgtagtggttatctctgagtgctgatacttaataattaatttttttccttttttaaattggctttgttctctaatgactatatacattatgtgaaataagaaaaatattcaaaactagagatgctatttaatgatataaaacaacacatatctaagaattcagatggtttaagaattatataagtgtgaggtaagcattataaaacaacattgcatattaatttttaactttaaacatcactttcacaattaaaaaaaatcttatctacttattatggaacatagggcagacattacttccatgctatatctgaggaaatttagtcataaagattaacgtgctatctaaagttgcaaacttggttaattggcagagttggtataaaacccatatcctgatacctattccagtatatatatatatatatatatatatatatatatatatatatatatatatatatttatgacagaaatatttctgttatcataaccaggcagtcaagaaaaagttaattggatgtcagtctgaatttatcaaggccaactgttatcatattctaatgtcttatatccataaagtgacatttgctcttcattatcatatactttcttctcacctcacaatacttttaaaaagagaaaaataacatctaaatgtaaaatgacagaacatttaatatatgtagattaacatttagttggggtacacttcccaaacctatggaactatgaaagtttctagcacaattatagaacttgtgggtaataatttgaagttttacactttcagtaagataagtgtcacaatacaaataccattactcaagatttgatttcttctcagattttaacctttttcaatgaatctaaaacttgatgactagaatgagattagctaatctgtcttgtttagaatgactttacagttttttaggtttcaccaaaacaaagcaaaaaaatcgcaactactgtttgtcaaacattgccattatttctagtttccttttttcccaccagatatatcctgagagcagtctttcttagtttttcttctgtatgcacagtagtgcattgtattgtactcatcagcacaattttataataagcgagacaattagatatccagtccttcctcagctctcttctacatacttctataagcactctggattttttttaaaaaattaactttgcatcaaactttacaaaatctcctatattcttaaagccctcttttcactgagctagaaaattactctcataatcaaatatagtgggttagatggcttaaagtttcaaaatctacctcctttaacacacatctttctgaaccaaggacatgatgtacttactgaagcagaatagcttagagattaagaatgtaaactctagactcagagagatctgggttcaaattccaactgtgtcatttactagctatgtgaccttggtagccatttattctgtattgggattcctatttgaaaaaagatggggatagcaacactatcttatagagctctatcagaattacatgagatattacaaagtaacatttagtccatttcctagtatgtgataaatgcctaataaattttagagagaataggtgtcatgtgtgagggcagttgtgtgtgctgtaaaaatataaaataatgaacactgtaacattgttttattttaatatgaaagccttcagaaaagttggacatatttcaaagttatgtccaaatcaagtgactttcaaaaatgacattcctacctcgtaatttttattaatattttcaatattttgtagcacagattaggacttttatgtaaactcattatatcattatttatgttcagtaatagttgacaatggaaggaatattaaattgtatcacatgggagctttcatgagaaaaagaatattagctcatcaccataaaacatctagcatagtaagatttatagcataatgcaaaaaaaaaaatcacttgaccattaaataaagaccaaacttaccaaaaaaccctgccagctagctttttaaaaattttatctttacagaaacatgttttattttactatataagtgagttaaatatgcagtggcagtacatcttaatcacagttccaatatagagaggaacatagaggaatgtgtcacctttattatttatgcatgtttctatatggcaagcactaccacatcagtaccatgactactaatggatttactgcaaattaaccttgacatccatcagatcgctgaatgtatgaatgactgaaatttaaagtggttttcagcaatctccacatttaagctgtgcagcaagcctctattactcactctaaattcattaacaaagctggctctatcagacacaaatttagcaatgtcaacatactttacactccaataaatgtttgtaaaaaatatacatgggctcccgtatctcttgtttaaactgcctgtgatgttataatcagggaatatttttagatcttattgaacatgctatttacatatagggctctctcccttcttgttctttcttgccaactgtcccttgcctaagtgtgcccacttcagcctcacgtcaattctgcaaaggctaacatattcccttacatagattgaaactttctgaaaaagaaaaccaatcagcatgtacaggtctgctcaattattggttgctctggatccttgctacatgaacaataatataattaacttcggagtagattagcttctaactcataacataagtatatgaataaaaggttactttttgaaagcctataattcttcaaatgtcatcttgtagccaacacgaaacattcaggcaattatgtttctattaataaatgtaacaggaatataacacttccttcagtgaaagtttacagtgaaagccaggtacccagatgaatattaaaagtaaagcatttgtaagtaaggggaacctttattctttctacaaccttttccagatgctgttgttaatttgaaattttctggagaatttctacctatatggaggaattctttggcttaaggttcataaaaagcaaaagcacagagaagaccacattgtatgcaaaaagagttttagatcagggcaacatttctaaactgatgaaacagaatcttaacaatcactaaaacaataacaagtaaatacactttattttccttctgaattattgtaagttctttgtagaatcataaggaattatttcatgaagctgagcactataggttcctaattactaaaatttcatataggcatattaaaaattcagaaaaagtgaacatcttaggagaagttaatggaatcaagtaatgagtttctacctataatatgtaaccacttctagatttaaaaattaattacaataattactaatattgagaagtaaggcacagccctcaatgttacatatgcatgtaagggtgcaaagacaaagatgccaggaaaagaaaaagaaaatatggactatatatcataaattaagacttctggtgggaggggcagacaacagaattggcaaatgtgttataactagctaaagagattggagaattagacagatttttaatcacatctttgagaaagagaatgcatatgctctttataaatgaaagaaggcaagaaacatgacatgtcacagaaatggtttaggcacaggtcccatattctcaatcaggtcgaaacaaaaaatgtccagaagaatttagataattcccaaataatgaaagctttatggaaatagttaaggatgatattcaagacagcaacataggtcaacagatacaaagttacggttagataggaagaatgagttctggtgttctgttgcacagtagggtgactatggttaatattattatattgtaaatttcaaaatagctaggagagaggatctgaatgatctaacaacaaagaaatgataaatatatgagatgatgaatatgctaaacataccgatttgatttttacacaacatatatatgtattaaaacatcactataagtgtgtacaattataacatgtcaataaaaacaaaacacaataaataaatttgaaaaaagagaacaatgggaagtttgtcatatatagcaaattgtatgttctgtcaaaactctaggctaaagcattttttaattattaattttttattaaataaaattaagttattaaattttaaaaaatacgttgttgactacttattaagtcaaatgcaaactgagcaagacagggagactcaaacttgtgagcacactattttcttgcattggaatttcatgaaagtgatactgtctaggatcactgtccacacactattccaccaaacaccaatcataaatttggttcaagttaatccaaaagattcttgaactcttgcaaatcagacactgtcatacctccagtatccaggaggactcattaggtgttaacaattaaggttttccaaatttttaaggggatcagaggagggtgaaccagctagactccacggtagacattggaagtctgaaagcagaagagtattcctcttcaataagccagcccatctgagattaggctctagcccagccaagataccatttaaaaaaaaattgtgtgtgtttactcaacaagaaattttaatcaaaataaaacaattgagaaaatgaaataactaaaagttactgtgattccaatgaggtcaagaatcatttctctcaaatataatttcaatagtaattatgcgcttcaataaaaaatgaatttacctctacctattggcccaaaacttttctctaataaaaatgtttttctaataaatgttctacattttctatattctctaataaaattgctatatcttagaaagaattatatattcataaatacattttatcacattttgatgtttataaaaagagtatggtacatgaaaataaagtattcattcttctaaaaacaagtgtataccactctaataagtgaaataattatttaaaatgtaaatagatccatggctgacctatcttgtcaatatcctagacattcattcagaaacaccaccaatagcagcaaagactgcacactggacaatcaaatatgcaccattcatatagaatgagatgttaatgatgttcattggtgtcgtataaaactatgactctacataatcaatgatcaatgattgatagagattgtgctgatttgaataagttattctcttttttttctgacattataagggcattaactaacatagaaaacatttctaagccttcctatctcttgatttgctgataagtgccaactgtgtgaaaggagctaagaatataaattcagaaacagccttttctcttcagcagataggatctgttcattaaaggtaaatattagggcaaaatagtttgtgtgagatgtcagaaaaatggtggtgttctgttgcacagtagggttactatggttaatattattgtattgtaaatttcaaaatggctagaagagaggatttgaattttctaaccataaagaaatgacaaatgtatgaatatttgtcaaatatttgacaaatatatgttattcaaccatgttatcatctattttggatttttaaactgctttttaagaaggtgataatattaaaagcactgattaatgaaaacctaagattatcagaaaaaaatgataagaaaaatctatgtgtgtatatgtattttcttttaggtcaaagtcatgtaaatagttgagtagtttgaaataatgttcaacccaatgaacactacttttaaaaatgtatgcaataagtggtccacttagtggtatctttgcaatatattttcttttacaatctacttattattttcctggcaaatgtgtcatttagaagtatcccctccaggaacagttgagttcaatagtttgagctgcccagagagacaaacttgttttgagatcaaattcaaagtcctgggaactgcttaaaaggctcttggtccaggttacctggctgagtagaaaaacaggtaagtagtagaacttttgccaatcagatcagaaaaaattccataaagacagcaaagtgatctagaattaaaaataaaacaaagcaaagtaatcccacaaccaataatcctaagaacatcaaatgcttatgtcttcccttctgaaactaggctccctccagcagtaggtgaactttattaaaaagtctctggcaagtaactcagtaatcaatttgtattaaagctataggcagcagggataggaagaaaaagaatcacatcatcaggaactttaagaaaaatctattttgaagagcataacctaagtgtgcatgttcccagtaaactcttaaaattattagctggtcggtagaagttgtagttgcctagcaatgtcctttaacttacttatttcaaaggttaattgtgaaaatggctttcattaggattcaagagtcaagaattttctttactataattatggtctaaaaaatgtccagtttaaaaaaaaaaatgacataaacatagaacttactgccgaaatactcttggagaaaagtgagtaaattttccaatttacaaataacaaaactgaggcacagagaaaccaagtgtcttctcaatgtcaaacagatgggtgcaggcttgtacttaactctattcttagtgattttttttttctatacaacaaaaagctaagctcaaatgactaattcttatttagaaaaataaattataattcacaaatcaaggtctcatttcaatcattttagagtttttctaatgatgcttccctagtctgatttggggaaagtttctataatgacacttaacagaaatgattcactcacattctgacatttttagagtctatcctgaatctttaaaaggtgtgaggtatctgcaatgctttattgtaaacatcctctctaagcagccatccaagcctttggcttattctgaagcttctaaattgtggaccaaagctacagaagacaaattttccttatttttaccacagtcacttttactctataccagaaaggctttatgactttttggcagtgacacttctttttgtccttagcaatggaattaaatccttaatacaaaagaataggtatttattttgaattatttgcatcgcatagttaaatagaagggaccatgcaaacaataaaatttgtagtaattttaggctaaaaccagaaccttaacttttgtttatttcctaatgttagttctactcatttatcttcttcctgcctatctgctatacttaagtcattctttacctgactaggccctcgtcaaaaccatttactaattattttggactggaacagaagggaatattagtttttgactcagaaattatctcagactaagctctaactggatttacctaggcattcacaaatgcaatacacattctcctctcaaagtcacttttacttctgctggtttaggcttctctgctgcaccttgatttcttttgtcatgctttccacattcattccagccaaggttaattctcgcctttcaacatccactaacttatttttaatttttgaactattataatatatgagaattgtcttttattgaaatatccattttaaaaagtatgcatcctgaagaaagggatcttgctttaattctaggtatccttataaaaaattatgtgcttttattcacttactaattattaataatgactaatacactcctcaagctaagtcaggaccactgattcaatgatgaataccataagactcctgattctgaaacaagcataggaaagatttatttatgtgatccatcccatgcctacatccatcagcatgatggagtatctgcagctatataagaaattggaatgatttcacctaatacaacaatctcagataaggacacagattgcctaaattattctgataagaaaaaacatggtcgacttagttatacctgggtaagaaataagtattatgaagagacatgggactcctcaacctggtaatggtgatcacatgaaaaggagcaccagatctcacagttcacttgaatagcatagccaaaaattctgcatattttacagggaaaagctggatataccttgctagtcctcaggctttaatgatttattaatactcagagaaatctgacagatagcaccttaaccaggtgatcaaagctagcatcaccagtaatgagacatatcaaattcaggttctccaaatatggtacactgaggacactgcaacattctgtgctatttttggcaaaaattcacagtctcagttttagttttccaaaaatgcatagtctcaatctaatcataagaaaacatctaacaaacccaaattgaaggacattctagaaaataactggcagcactcatcaagagtcgagggcaggaaacagagaaagactaaggaactgtcctagattagagaaaactaagaagatatgacaacttgatgaaatgcaagatcctggctttgatagtggaccacagaagagggcattagtgggacaactggcaaggtttgattaaggtctgactcttacttaataatactacattaatgttaatttcctggttttaatcattgtactctggatatatgagatgttaacatttgtgggagctaagtgaagacacaagaaggctcttttaattttttataacttttttgtaaatctaaaatttcaaaataatttttaaagataaatatattagtcatgaagagcaatttagaatctctctcttttttattgagacagagtctcattctgtcacataggctggagttcagtggctcaaacatagctgatttgcagcctcaaacacctgggctcaagcaatcctcccatctcagcctcctgagtagctggggcttcaggcacatggccaccatacttggcgaattttttaatattttcttagagataaggtctcactatgtttcccaggttggtttcaaacttctggcctcaatagatctttctgccttggcctctgaagtgctgggattctgggtgtgagctatagtgtacaatttagaatcctgaataagattcttggccatgggaatttatgcaagagaggtagcttgagaaacacctacctcttgaaatgaagtagagtttgagattttgtttggctataaaaacaggagagcatttagaggtgggcagaagacatttaacttttgttctacctaataaatttgcttaacgcagagctctttgtaaataaatcattattaagtctttaaaatgaacatattctaaaaatgcaagttaaaatagaaattgcctaagtagagtagtcaactctgggatcagttcacccaaaaagacagacaacttattcattcatttaattcttttatcataatgtcattgtaaatatcattgaaattcttatgaaatgttttccagtcttaaaaccatgtagatacatagttttaagtcagaatacatttttcctgtcttgtaattagaacttcttcacattagtgtgagctaattccttccctaagtttggaatctaagagggaaactagtgtaaacaaatacttgtatgtgtagaaattggcatacgttttgggctgggtatggtgactcacacctgtaatcccagcactttgggaggccaaggcagaaggattccttgaggccaggagtttgagactagcctgggcaacatagcaagatcctgtctttacaaacttttttttttttttttttaattagctgggtgtggtggcacacatctgtagtcctagctacttgggaggctgaagttggaggatcacttgagcccaggagtttaaggctgcagtgagttgtgatcacatcactgcattccaccctggacaacaaagtgagaccctttcttaaaaaaaaaaaaagaatgaaatattgtggttatgatgaaaaagatgattcaaaaggcaggggatggtgataattatagaggaaggactcatatctcttctaataaaacaagacaaaaaaatcctatgagagatcacttttagatttcttgaaagtttaaaaaccagatggcttagagaggtggcagggaaaaactctaactcaaattaatgagtggggcattttgacacaaacaaacaaatcaacaaaaaacaatgcggagacaacagcagaaatatattgctggagacagaatacaaaggcaataaaatagtataatttaagaataaaaacatctgtatactcaataaatactaattaagcatttactatgtataaagcaccatgctagatcctgatgatgataaaaaggtgtgacatagctctgaaatccagctttttctcaactatcatgacccatccaaacacatgtcatttctttcctttctttttttttttttgagatggcgtcgcactctgttgtcaaggctggagtgcaatggtgtgatctcagctcactgcaaactctgcctcccgggttcaagctattctcctgcctcagcctcccaagtagctgggatcatagatacgcgccactatggctgtcaaatttttatatttttagtagagatggggtttcaccatgttggccaggcttgtctcaaactcctgacctcaggtgatccgcccgtcttggccacccaaagtgttgggattacaggcgtgagccaccgtgcctggcccagatttcatttttgaatttctctttcatatttccattcttaataccatccgcatcaagttaaaaataaataaataacttttctaataaatactttactgactgacttgctttactgacctgctaccttcttacctcttaatttaaatctcttttataaattaacatcagtttattttttgaaatagtattgctaattgcttctctattcaaagaccttcaatgattaagtgactgtctcccaaattaagaatttatggtaacttggactaccttatgtacaaaccaaccctgtacttcaagcaaactggagaatttgcttgtctcccaaatactcccaaattattttcatagaagataaaatttaatatggctctgaaaagataagagcaaattttattggcaggattttgatgaggaaaggcaaaaaggcacaaaatttggttttcaggagtaggttgtagatccacttatataaatggaaagtcactttttaatattttttttttttagcggaagctgatgcatttttaaataccactatgtcttatctctttgtctcttgaattaaatctccagataaatacagagcacaaatcacatagtagaaattaggactattcaaggtcagtgttaaaaagagattagataagttctagtatcttagtttattaaaaattctatgaaatgcaaatttcctttaacaaggagtcacataaattcacaaaagtagaaaaatgtaatattaatgtcataagaaagactgcacttagtaagtgtcttggtgatattttgctatttatcataaattgtgtcattctatctttatgagaaataaaatcatttctcattttttcaaaatttaaatttaagtaccgggatacatgtgcagtacgtgcaggtttattacataggtacatgtgtgccatttacctatgtaatagatattgtattacatatgtaattgtatatttattacacattgcatatgtaataaatttattacatatggcatatgtaataaatttattacacattgcatatgtaataaatttattacacattgcatatgtgtaatattacatattgtatatgtaataaatttattacatgttgtatatgtattacatatgtaattgtatattgtattacatatgtaatacaatatgtaatagatgcatctattagcccatcacctaggtattgagccccacatgtgttagcattcatcctgatgctctctctccccctggctccctgacaggcaccactgtggtgagctccccttcctgtgtccatgtgttctcattgttcagctcccacttataactgagaacgtgcactgtttggttttctgttcctgcattagtttgctgaggataatggcttccagctccatccatgtctctgcagaagacacgatctcagtcctttttatggctacatagtattccatagtgtaatgtatcacattttctttatccggtctatcattgatgggcatttggagtggttccatgtctttgctgttgtgaatagtgctgcaattaacgttaagtgtacgtgtatctttataatagaatgatttattgttctttgggtatatacccagtagtaggattgctgggtcaaatggtatttctggttctaggtctttgaggaattggcacactgtcttccacactggttgaactaatttacattcccaccaacagtgtaaaagcattcctctttctccagagcctggccagcatctgctgtttcttgactctttaataatcaccattctgactgctgtgcgatagtatacgattgtggttttggttcacatttctctaatgatcagtgatgttgaacgttttttcatatgattgttggcagcataaatgttttcttttgacaaatgtctgttaatgccctttgcccagtttttaatgtttttttgtttgtttgtttttgtaaatttgcccaggttccttgtagattctggatattagacctttgtcagatggatagattgcaaaagttttctcctattctgcaggttgtctgttcactctgatgatagtttcttttgctgtgcagaagctctttagtttaattagatcccatttgtcaatgtttgctattgttgccatttctttttatgtttttgtcatgaaatctttacctatgcctatgtcctgaatggtattgcttagattttcttctagggtttttacagttttgggttttacatttaagtcttttttttttttaacttttttaaaattttatattttaaatacattttgtccttttttttttttcttttttcttttctttttttttttttttttttgagacagagtatccctctatcacccaggctggaatgcagtgcgtgatcttggctcactgcaacctctgtctcttgggttcaagtgattctcctgcctcagcctcccaagaaactgggaatacaggcatgtgccaccacactcagctaatttttgtacttttagtagagacagggttttgccatgttagccaggctggtctcaaactcctgacctcaggtgatccacccacctctgcctcccaaagtgctgagattacaggtgtgagccactgcgtccagcacatttatatctttaatccatcttgagttaatttttgtataaggtgtaagtacggggtccagtttccattttctgtatatggctagccagttttcccaacaccatttattaattagggaatcctttccccattgcatctttttgtcaggtttgtcgaagatcaggtggttgtagatgtgcagtcttatttctgagatctctaaactgttccattagtctatgtgtctgtgtgtgccatgctgtttggttactgtagccttgtagtatagtttaaagtcaggtaacgtgatgcctccaggtttattctcttcatttaggattgtcttagctatacagattcttttttggttccatatgaattttaaaatggttttttctaattctgtaaagaatgtcaatggtagtttaatgggaatagtatttaaactataaattgctttgggcagtatggccattttcatgatattgattcttcctatccatgagcatggaatgctttttcatttgtttgtgtcctttcttgttttcttgagcaatggtttgtagttccccttgaagaggtccttcacttccctctttagctgtattcctaggtattttattgtttttgtagtaattgtgaatgggagttcattcacgatttgactctctccttgtctattggtggtgtataggaatgtttctgatttctgcacattgattttgtatcttgagactttgctgaagttgtttatcagcttaagaagattttgggctgagacatgggggttttctaaatataggatcatgtcgtctgcaaacagagacagtttaacttcctttcttcctatttgaataccccttatttctttctcttgctcgtttgcactgaccagaaattccaatacaatgttgattggaagttgtgagagagggcatctttgtcttgtgtcagttttcaagaagaattcttccagctttttcccattctgtataagatttgctgtgcatttatcataaatggctcttatgattttgagatatgttacattaacacctagtttattgagagtttttaacgtaaagggatgctgaattttatcaaaagctttttctgcgtctattgagataatcacatagtttttgtctttagttctttttatgtgatgaattacatttattgatttgtgtatgttgatttcaccttgcatcccagggataaagccgacttgatcctggtggataagctttttgatgtgctgctgcctttggtttgccagtattttattgaggatttttgcatcagtgttcatccaggatattgacctgaagttttctttttttttgttgtatctctggtaggttttgatgtcaggataatgctggccccataaaatgagttagggagaagtccctccttttcaattgtttggaatcatttcagaagaaatggtaccagctcccctctgtatctctaggagaattcagctgtaattccatctggtcctgggcttcttttggttggtaggctatttattactgccttactttcagaacctgtttttggtctatttgggaattcaacttcttcctggtttagtcttgggagggtgtatgtgtccaggaatttatccatattctctagattttctagtttgtttgcatagaggtgtttatagtatactctgatggttggttgtatttctgtggggtcagtgatgatatcccctttatcattttttattgtgtcaatttgattattttctctttttttttattagtctagctatcagtctatctgtcttattattttttttcaaaagaccagctcctggattcattgattttttgaagagtttttttgtgtctttagctccttcagttctgctttgatcttggttatttcttgtcttctgctaccttttgggtttgttggctcttggttctttagttcttctagttgtgatgttagggtgtcaatttgagctcttcctagcatttttatatgagtatttagtgctctaaatttccctcttaacaatgctttagctgcatcccaaagattctggtacattgtctctttgttcatttctcaattttttaagtggtggttttatgcttagtagaaacagtaacagcaaaagaaataaaaaaatataactttggtttgtttgtttactcattccttatctcaagcctactccaacagcctatgaagatggcagtaagagtaaagttcagccatttctgtgatttatctatccacatttattttttttgtagacactgtcatgctctgctgctctgtcacccatgcttgaaagcagtggtgttatcgtggttcactgcaggctcgacctcctgaactcaagagatcctcccacctcagcctcccagatagctgggtctacaggcgcacactaccacacttggctaatttttgtatttttttgttgagatgtggttttgccatgttacctaggctagtcttgaattcctgggctcaagcgatccacccaccttggcctacgaaagtgctggtattacaggtataagtcaccattcctggcttatccacatatgtttataataacggttataaaaaacaaacaaacaaaaaaaactggaaagttaggtcacttacattgacaagaaattgtgggtatctgtaagatttataactcaacgatataagattttttaacccatgaagttctttggccaattaaatttaacaaaggaaatggattttcaagtgaaaaagaaaagaaagaggttctctatggagaattttacattttaccacccatgtgaagattataactatgtatgagagtcatttttgaagttgaaataattgaaacacaagagcacggattaaagtaccaaatcagacatggggcaggtaagtgtcaaatcttttttcttttgtatttggttcaaaaaattctatctttctagactaaaattacaaggtggttccaatttgcacatcagatccttgaacactcaggtccccaatctcaaaataacctcacatttgaaacatacgtccttaagctctgaagtgaaaatggtggagaaaaacctataaaacagaaaggatagaacactcagaggtgaagcaggcttccaacttaaaaattcccagttctagggtcattttaaaaattttaattcattttaaatgggttattgtattcaaataaagtttgcatgccatctgttttcaaagtcatttaaattaagttttatgactcatgaggaagagaggccatttttaacacattatagtctgcttattactatcattaactaattaaaattaattattaagagtgattccttttgctctcaaatcttctagatcatttatcaaagaatgacatgactttctcttccttccttggaatactgaagtcacagtcatatgacttttgggtagatgctattgaaatgatgattttagtcagatgtttaacagtaacgctgtctaaaagctacatttaaccaagagagcagtatttttgaaacagcaggcagtataaaactgctttgtgaatattaacatattctagcaaattagtttgcactcattatcataagcaattgcttactgtttagatgcagcttgtattaaattggcaagcaatttgcaagaattaaaacataacatggagagctttctgaaaactcagcaatatcctgggagaaatgatgctactaggttcacagaccatgtaccaaacgtttttacccattaaacatatttagcattagaacaatagttggttggctacataggtttttaatgtaagatcattttctaaccgctgtttggacaccatcaacagaattttatatatcagacatttaaagactttgttttaaaaagcctgaggagaaagtaggaaggctttgttttctaaaaatgaactagctatcaatttgactaaattttgatacttcaataacctattgcattgtcttgagttactttatgctacccaatttgtccctttcacaaagtttctgttgtcttgatcattctttccatttattcctgagttggattctgctgatgtttacccctatccactttactttctttaataacagaacttttgagtgtcagctgagcagatagataactgcgtagagcctacatttcccattctcttttacagcttgaagggtctattgactaacttctggccaatgagagatgagcaaaaatgatgtgtgtttattctagttcagatcctgaaatgtgtctgcattctcctgcccatttccctctttcttgcctagtgatgacaaaattgaatcagctgcttcagacttcgagatggaagccaaaggttgagaactgtacaatcctatcctaggacgactgaaatgtgactattatgtgagaaaaaagaatcttatactgtgttgagagatgagtatttctgggtctcatattgacagcaaagggtgtttatccaggctttgaaaaaaatgacctaacatttccatgtatttttttaaccttatgaggcaagtaaatttgatagagaagctattattatctccattttatggatttaaaagagattaatattcaaagagctaaaattatttgtccatggtcacaaagtaatgtaaaactttttctgtcaaaaccttccacaggaggctaccgataatctattacctttttaatagtaaactgaggttacctaccctgaataattctatgggaggtcacatgtatttatggatttccccattctgcaattctttgctccttaagaaaacaaaatttgcaaaacacagtaaaggatattgcttgtaatatgaaacaaagttaaaataactgacccacacaagcccctcagcttgaatagacagcatttactttagaaaacttttaaatactttctccaccttttgagatttaaatcttctcccagctttttgccagatttacggcttgaaaatgtctttctcaagggcctaggagtcatctatttgaaatgtaatcatcaaggaagacagtgctctgtctaccagtatctgaaagggtaagagcctaacctctggaagtgccaacgagtaattttttctgtactatacatataataaaggactaattaatgggaagttggataataaagaaaagtgtaatgtattaaaatctgtacatcagcaaagaaagataatttaaagagtatcgttaaagtgctacggagtactgagaaaagagactatccaaaaacaaatctagtagctagttttatggtttttcaaatgataaaattaaaatataaaacaaaaaatttaaattttttattgataaagtatctgcacaattttttttttggtttcccagtgcatataaaggttgtttatactataatgtagtctatttaagtatgcaacagcattatgtctgaaacaaacaatgtatataacttaattaaaaaatactttattgctaaatcatctgagcctttagcaagctgtaatatttttgatggtggaggatcttgcttcattgttgatgggtgcttactgattagggtggtggctgctgaaggttgaggtggctgtggcaatttcttaaaacaagacaacagtgcagtttgctgcatcaaatgactctacacaaaagttttctccatagcatacaatgctgtttgatagcattttaaccacaatagacttctttcaaaatttgagtcaatcctctcaaaccctgctgctgctttttcaactaagtttatgtaatattctacatccattgttgtcatttcaacaatgttcacagcatcttcatcaggagtacatttcatctcatgaaaccacatttttcattcatccataagaagcaacttctcatttgttcaagttttatcatgagattgcagcaattcagtcacatgtccaggcttcactcctagttttagttctcttgctatttctaccacatctgtagttacctcctccactgaagtcttgagcctgtcaaagtcatctatgaaggttgaaatcaatttcttccaaattcctattagcactgatatttttaccgtcttccctgagtcacagatgttcttaatggcatctagaatggtaaatcctttccagaaggttttcaatgtactttgtctagatacatcataggaatcactatctatggcagttataactttataaaatgtatttcttaaataaggcttgaaagttgaaattactccttccttgggttataaaatagaagtgttatcaaggataaaattatattaatccccatgtatatctccatcattgggtgacaggtgcattgtcaatgagcagtaataatttgaaaagaatctctatttctaagcagtaggtctcaatattgggctcaaagtgttcagtaaatcatgctgtaaacagcatgtcattcactctttgctgtttcatttatagagcacaggcaaagcacatttagcataattattaaggaccctaggatttttagaatggttaataagcattggcttcaacttaaattcaccagctgcattagcccctaaaagagagtcagcctgtcttttgcacctctgaaaacaggcattgacttttctccttttcagctgtgaaagaagaagatacctacatggcatcttcttcaaaaactatataaagctgttttgtctacactgaaaatctattgagtatagtcaactttatcaaattttagctaaatttttttttataacttgctgcagcttctacatcaggactgttgcttcaactgacctggaaggggagtagaagatgtgccattcactcagataggaaacatcagagaagaaacatgatgcttaagtaatataaggggtttgttatgttagaatttagctaccttcctccaggtaagcataccacatcatctctacattcctacttagcatactgaagtgtacatggaagacttttttttagtatcctgctaattaatcaagtaaataattaagaagacatcttcaaatgaaaactctgccctcttttgtagatttttgccaaactcaaagttataaacacaattaactcctcatctcttttaaaatattctccaaatgtaatatttagctttcaataatacctttccatgaaacacacatgaattggctttatctgaatatttgcagtgttccccttttttccaaaaatgttaagaaatcattttatgaaacaggtttcactatactatattgtcccaggatgtcatttgcatgtttactatttggttttctaaatacatttatcggtacaagttattgtacttagttgatctgcttcctctactcatcaaggtggtttatcatttgtggtgcataggtgagcaataggatctagtgtaacgcgggcttaggttcaaacccctgcatgtacagatgaaattgggttatctgcacttcttgtacctttcaatagtgggaggagagaaggaaatccatcactactggaaaatatgctctgtactctatcaactctgttgaccctcagcataaaatattttaaagcatttccctaacaaacaactctagttagacaatctgtatcataaccactacttttatctatgagacccctctgtctcttagaacatagtggtcatgggtactggtagcccatatgatgcctttaggaaaatagaaaaaaagcaaatctccaaaaccctctacttctgcctattgaaaattttcatgatttttgtcagaacaagacatttgcttgatatttcctagaaaattgtcatattaaatatgcaactccattgtgaaaacagtataaatggtgccaccttaacaagtgtacaacttgcacaaacatccatggcatccttttagtaagatgtaggaaatgattaggttttgggttaagacggagactcaacacatttggaccctgttgttctattggaatacaaccacactcctcagagggagaaaatgcaagagacacacaaaagaaccataattcctattcaatcactttttttaatgcaaagcaaacaccgatgacaaaagaagttcaagctttttttttttccgttttttttttttttttttttgaaagaagccgtcttacagagttgaaataagattagtcacagacctaacctgtagaaatgaaatttctgaaaaggaagacagtatcagagcagtgttaatccaagatgtatgaagaactaaaccatagcagcttaagccatatatttgaagcacagatttcagcaagacaaaactgtgacttgaaaaacgagacactcaaaatcctcaggagatcagtctcttctcctgttcctctacggctcctccaaagtacagattcaattttgagtcaggttaaattgggggctgaagtgggaatatatggttaatgaattttgtacagtcttccttcttttcaattgaaaaagaacagagaaaaaaaatccctcaaaaagacttcatgggttttactaagtctttccaacatttccccccagattgatttcagatcatgtagagacaaccagactgctaattaaactattaactctttcttctaaattgcaaatctttgagcatttacactgtagaagccacctcactaactctgaagccccgaggaatatagactttccatagattgggagggaagtaacatacacattaccctaggccaaatttgaccctgaaaatgaagtcatatgcactaactctcaaaatatttaattatttttcccagactttgcttaacaagtgtatataacaaggaaagcctctaaggtacgctcagagagattcattttctcctggagttaaattgaaaggtgacacaatgaaagctctgttatgattcttttgaaagcagcaagattatgttctcagccaatgtaatgtatagctgacacagaataaagtgttggccaaaacagaggaaatgtgctgaagtccaaagcctccatagacttaagtcacaagacataaatatacttatggaactctaatgccctaggttattgtataaaagtgatatgtgtgttaaatttttaaataaaccaaccaaaacagtgtagcaaattcagctccaaaatagattcctttaattttgaaagatatgttaacaatatagaaatatgtaaaaatactatttcttttatataaagtgaattctttacctcttccatcagagcagtgtctacactctaaattcattaataaattctccttgtcctatgtgaaaatgagtaaaaaataagattgcaaatgtggaagttctcaaccttgaatcaggaaactatagatctagtcctaattccttgctttgtgactttgccaaagttattgaaactatacaataatcctcattttcttcttctgaaaataaaggagtttttccaggtaatttatatgggcatctccagctctattctgagtttaaaatgtcactccaccaaagccggcgttaaccttgaacttgattccagagtacactgagcatgaagtagaaagttaaatttatcagtgaggcaattcagcagacaacatgcaatgacttctttggtttatatttatttcattcttatttgactttcaacaaaattgcacagaatgttttctgtattttatggctgtgaaacaacacagtagaggacattttattttgcctagcaattctttctatgattaaaattaagacataaatacagaagaattgaatagtgtatgggataagcactgctagcagttaactttttaattttctaaaatcatataccctacatggctgttctagcaactccacccaaaatcaatataatacaaaatccatagaaatagtagtctaaaaccagttccaggtttattagaacctagttatgtaattactgaggtcttctctttttaaatctataattactactgttatactaaaaaggttgggttaaatgttattaggcaaaaccaccctggctgatttgttttgtgaatacatgttaagataattcctacttagaagaacagaatcattccaagctgaaattcttatgagccttagtaggttctattgtcataaatatgactcagatccagaaagggattcattaccctattctagcagtcaattttagttgtgaaaatataaggaaaagtcaaagcatattctctacagatgtagctgcagtggtgtcattttcctccatgcttctggttgagaaaaaccaggcatcgcctcaatggtccacagattattaattcccattgtaagataatcctgccaatgttcaccaaaattatagccatttcttcttttgcatgtgttcttatgtgttggagtttttggcaaagaatttaaagtccttcatagatacccagttaaataatcctattactcattccctggtagattaataccttttgaaatgcccttagacctttcacatcatggaatagaaactcatgttttcttctgagttacatgacagtactccacacactggctgaattttgtctatcatctcactttttctttaaagcactaattggagactacatggcaaggtgatgatcatttttaccaagaggaaaacacacatacacacacacacacacacacacacacacacacacacatacacaaacagcaaatgacctgttcagtgtcataaagttggtgagcaggaggaacacataggtgttccttctgttatttattcctcagatttgaaagttctgcccttcatataactgtcccatactgaagcagtagaaccaatgtacttatggtaaggtggcactgtgtgtactctcaacaaatgttaattaaatggacttagggcaatctcccctctcacctatttgagaggtccaaatgacacaaattattatttttatataggtagctattaggtcttcaaacacatatgaacaattctgattgggatcattcatatgttatatataacaaataggcttaattacagttggtcattaaataatatatctactgcagaaactgtggaaagtacaaaattaaaaacatagggacttaaaacaggtgagaaaatttttaagtgatttgaccactgaaggtgaaggaaaataaataaagagaagaataaaaacaataagaacaataacattggttcaagaaatcagagtatgcatccttttagaggtctccaagctgtctgtgccttccatcttaacacctagttcaataacacgcctgtttagagggtggcagctacattcaaaggagtcaacataactttgtatcactctattgattggctatttggcttgggaccagcatagaccagaattggtctagaggttgctctcttgctttggagatcatttagcaagtgacatcgtgtgaaatcaatggcctgttactgctttcatcattctcaagttcagtatcataagggtccttaagatttaatgaacctagtctgttgagtgaagctttcaacctgctatatttcttctaacataccaaaatggcttgtatgggaaatgattactatcttatgcagtaggactgtgcaatctaagacttatcaattaaggataatacggcagtaagataaacatttaaattagtttttcaataagatgtgtatttatatattttccttaaagaaaaacagtgaaacagctctctactggctaaaaaaaaagaaacaaagaaaatcagtcacaattgaacgcacacatacgcacatagaaacagaatagataacattgtagaacagtcgctaggtctctggagattcattaacatttcatatccaaggagactagccattcattccttctaaaacagaaagcattttcaaagcaatatccatgtacaggtaaacgacaaagcaatcattttgaaagaaggtaaattacggtcagatgggtagagaaacaaggaggaaatgtcagacattctcatcagcagaaagaggcaacaaacagcaaaatatatatcatatatatgttaaatatatgtattatatatctatgtataataaatcaatgcaagaggtgaatgagaagtaggctgtcatgttctccagcacaaggatgatctccctaagtggtacaatgaaatgaagaaactcccccagaatattataacacagttatatgtcaattttcttaacagatttttgagtgttctgtacacacggcaggaagaacattgtggaaacatttcagtaaagagttataatctaggcctctgtctcttggagacaagaagtgggaacaagaccatgagtctcatatcaagaccacacatctattttctttggaataatgtcatcactaggaccagcagaagcttgactaatcacatgtgaaattaagtcaggggtcctagattttttcaagaaaacaacaataacaaaataggagtttaaaataattgatgggtatagcgcccaaagcattaattacatgtagaaaggttttttaaagaaaacctttaaaatttccagatgccagaaaattctttttttccaaaaacatttgatatgggagtttaatagtatcatatgaagaagtatagaaacttctccatttctgggggacttttcatagagataggccaactcaccaattctaggtttcctcatggtgggaatatatttgcttactggtaaaaaagtcttgggcaaggacaacaaacaccgaaaaaaaatgtgtactctgatctgatcttgaattcccagaaacaagcaacttcctgttaattaatcctagcaaggccagagactcaggaaagggcagctcttttctacgtgagattaaaactctctctacatatattataggtgcaccatcagaagagactggtctaagggcttatcataaagaggggagagtaactgcactgctaatctctccaacaaaagtgctactgtgattacatcatgacactataaagacctggataagtgttactgtattaccacatgagttactagttcctggacagaatgcccaagactgtttctgattcatttttgtgaaactacttccaatagcaacgaacaaagaagaaaaatacagaaaccaaaagcaagacatagcacaattcttcaggtaccaatttactttatcaagttttcaccttataaaaacagaggtgatatttggacacaagaccagaaaaagtcatcttccgagcatatgtcctcctcaccacactcattcacacttaagcaaatacatttcacccagggttcttggaagccagcattccacatttagaaataatttctttggcttaaagattggctattcttacatcttcaaatgcaagagaggagcaagttaaagctagaaaaacggtcacacaaagatagaggtttgaggaccaattttttattttatttatttctttgttattattattattattattattattattattatttattttttttttttttgagatagagtctcactctgttgcccaggctggagtgcagtggcacgatcttggctcactgcaacttctgcctcctgggttcaaccgactcccctgcctcagcctcccgagtagctgggattacaggcatgcaccacaacgcccaggtaatttttgtagttttagtagagacagggtttcaccatgttggccgggttggtcttgaacgcctgacctaaggtgatccacctgccttggcctcccaaaatgctgggattacaggtgtgagccaccactcctggctgaggatcaattttgagatcacttgactccagtttttccaagaaccaccctgaaatggacagtgtgaattcaacataactaaatatatattatatactataaatgtatatataatgtttataaatttttatatatgcattatattttattataattatatattatgatataactctataatatatataatttttatatatttagttacatataaaatatatttatatatgtatataaatacacacacacacacacacacacacacacacacacacatattttctttctagaagaactaaggtaaagttgcgtttgaaaatggtaataagagtgtgtggccagaaagaaggaagcagcaagttagttgtcaataacactggccaaggcaaactctgaccctgtctactttccagcttttgtctttcctcgatactgctttgcctaacagactcttccctggcattaatgactccgctgtgaagaaggatggtttctagtttagtgacacaaaaagatacgtttggtatttaagaaagcataaagggagcataactccattcacctatgtcaaaattacttggataaacaagtatagaaaacattagttattcttctttattatagaaaatggataaaactaaaactcaacttcatctctgtgtacagatagcatagctacctagggaattaattatttaatttgtgcacaccttatgatcatgcctcagaaaagaactgccagagcaatcccttgtataggctactgtgattctgtttttctgaggctaatgtgctctgtgaggttgtcagaaaagaaataataatcagttatttctttgtttaactggagaggcagatgaataaagcatataagaaaggtacaaggaaaagcagcttaaatataaatacaagctagtcccatttctgactttgtgtctacctttgaccaatggtgaatgaatttccttgtcactgtttctgcattttgaagaaagtaagctgtattcatattttttctcagaaatactatgttaaatgtattagtgtatgtccttgataaacaaaatgtaaaactcagaagaagaataatgtttatggtacatatatttcttcaaagtaagaaagaactattcatttcaataatgccacaattgaaaattgagccataaacatcctgaagggccccaaagttgaaaacaaaaatgaataagactaccaactttttaactttttcagaaggatgaagctgcttgcattctttggggagcaaatgttaggcttttttcctatttaaattaccacaacattgtcacgatctgacattcgatttataacaactaatcaagaaatatttacctaatgcccatagcatatgaggtattatagggaacgaaaatcttacacactggatatttaagacccctattgagggtaagccaaattagaagtaaccgttgtataaataatgctcacattttaaaagcactttatgattttcaaaatatgtttcacattggtcacttcatttaacagacattatcttatttgaagtccaagaagagagagatccagaggtggaagtgattaaaaaaaaaaatctgtgaatttaaggccaggcacagcggctcacacctgtaatcctagcaatttgggaggcagaggcaggtggattgcctgagctcaggagtttgcgaccagcctgggtaacatggcgaaacctcgtctctaccaaaatacaaaaaatcagctgggtgtggtaacgtgcacttgtaaacccagctacttgggaggctgaggcacaagatttgcttgaacccggaaggcagaggttgcagtgagcagagattgtgccacttcacttcagcatgggtgacagtgagactctgactcaaaataataaaataaaaataaaataaaattctgtgaatttaaacctgagctggcatttgaaagaagagttgggcttgaataagaaagagaagaagccaattatgactgaaaattgctttgttctttaattttcataaacacataatttactagttccttaagtacacaaatatatgctttcttattatcctacttaggcttagtactacacccaacagtgacctggggagcacatactgaattaaccaatagggaggatttgtccttctgtatctattttgatcattaacaggacactttacaaagtagctggggagttcagagtatagctcatggctatggaatataattgagctcacagactcagggagtcaatcccttcacttaaggttcattagcctgggttccaaggatcccagggggcgattccttccttttctgaatccccatagcacacatcacccagacaatgtctgtaggacaactttagcacttcaaatgaaatattgtctgtgagatctttgcttttcaattgattcgtgttatctttgtcttacctcccaattaatctccagagctccttgtagataggaactatgtcatccagattctttatctaggccacatagcttctagccaattacttgacaaagcataggtgcataaccaatgtcttctttgtgcctctgagttgcaaacgcagttgtatatctacgttaatgaaacgatgcttcatgcctgtattttaaaaactgatgcctagacaggtgagtaatgccaagcagactatgcaagctcttgtggtttctgattatcagataagagtcgcttaatttggtaattgtgacattgtagatatggaaagtatagtaaaagccaactagtgcagaaccctcattttttacatggggaaacagacttagacagggaaagtgccttgcctaagatcacaactaatattgtgcaagaatctgttgtgggctcagcatatggtaggcaattatttcaatgaataaagaagtaccagatgtgggtcacatggtcccctggcactccagccgagaaggcaacttggtgttatttctatgagtccttgcaggtgtggaatactgtatactcttccctttgctgtattgtttctgccaaaataattgtattttgtagctgtattttcacttaaatataaaagcagctaaaagatagtatgcactgtatttcccaactttgtatttaagtccatgattacgtctacgtatttacacagattccttttcaaaatacttacaaggcatgcaccaaaataataacagattatatctggccaatggaattcttggtgactttaatctgactttttaaacatgtcaacatatctccaatattgtcatgaatatataaacaaacattaattttatagctagaagttaagtccagtaaaaatatgtttttaaaaagaaagacactacttctacacctgccaaaagcctgccgttttgcaaactagtcgagttttctcatgatatataaattagcgcaattttgaaaatgtaaatatcaattattgtgttacaaaaaaacaacttttaggatgtgggaagcagaggttctgctaacatagagtttaacattgagccttaaagaggcggaaaggtctaatttgggaaaagactcgttccttaaattttactctagtttttctttctatttccctccataaggaatttataaactcagactttaaattccattatttggacttacaaaaagcacattctgttaaaacaaaattaaattaaattaaattaaattattagattaaattaaaaagccctatctgcatgataactatcccctccgtttctgaccaaagtctcacagaacttcccccattatgtgttgaaggaaatttgtatttcaaggtacaaatgagaatgactcaaaaccatgtgggagaatcccagatgcattatatagattaagtgggtgtggtgataaaaaagattaggggttaaataaaatggttgctggtcaccatgagcctcttattttgtattactaaaattcaacctaccatcatttgtaacatgagcgtggggaaagtaaattgtgaattgcagactattttgtatacatatgaaactttaataattatagatccactagctagactgagaaacactaagtacttctagaaaatattgagcgttgtgagaatttgcttaccttaagtagtattactatttgtatttggagtcctctaaactatgcaaaaggatttaaaattggagatctttactaattaaattgtttattcatcctttctccagaaaaataaaaggtatgtctcagctcaatatatttcagaactatcagaattttgaattctaaaacagatttttcccattatacacacagtttatcgacaccgtgaaagtataacgtacaagcaaattatatatttatatgtaaaatgcatatagatatagtttttttttttttttgaaacagagtctcatttgttgcccaggctggagtgcagtggtgcgatctcagctcactgcaacctccacctcccgggttcaagcaattctcctgcctcagcttaccaagtagctgcggctacaccacacctggctaattgttgtatttttagtagagacgggttttcaccacgttggccaggctggtggcgaactcctaacctcaaatgattcacctgctttggcctcccaaagtgctgggattacaggcatgagccactatgcccggccatatacagatataggtttttgaataattgtctttcaaatactcatgccatttatgggtatgtatgcaattatatgcacaactgcatagttacaatgatataacataaatgaaaacaattcagaatactaaaaagtgttactcataagtaatatagtaaagtagtgtgaacactactggacaatattgatacaaaacacaaaaatgcagtatttcacattagcttttaggctacctgattgaaatgaccttttaaaactcttgtggagtctgataattgaacttagctaccaataatggaaagtatcatgatttaaagaggacagaatgttgtattttgtctacaagaaaaaatatattttctgtctacagaggagtataattaagatttagtagaggaaaaaccagtgataattgtcatattcctctctttcactctcagcatccaaatgatcactcaaaatggtcattttttaaattggtgcagtgcaactaagagctattttaggaatggttatttccataaaattctattctattttcttcagtcttactgaaaatggtgctttctgtctaaaccatcaaggtgttaaaacatattaggacaggttgaaacccaatgagagcaagtgacacattttaacaagattttataggtcactgtcttgcaaaaatgtaactcaaagtacatttatgggcacacaggaaaattttaacaactgagaaacctattcataaatcttgtacttattttaaattaatttattagattatatacatgactggcattgctaaaaaatgtaaacttgcctattttggtgaataacagtacaataatggtactttccttttccttcataaacaaaattttttaaaaagacaagagaaaaaaaatcaaataaaactaaagaacagccaatctatgaagaagtatttcctatggactgcactgaaacttggacctaggtaaaggacgaagcactaggtcaaaagccacccgagaggtaatggactatgcagtctgagttcctccaagggggggtcacacaatcccaaggatagacttaatatttatttacagaactcaaagtgcttggaattggggaaatgggtgtgaggacaaattgcaggagggtccctgaccttggggagcaggtctgactcagagaacacacaggctggctgttttgcatgaaatagatgatgatttagcaatgtggcggagaaaacgtagaaaacaagaagttctgtaactctccattttggtcaaccaaagagaagtacattctatcaccacaggtcagacctatgacaccagttcactatagacctaccatctgcaagtggagacagccacaggaaaaggtgttttggtaagggtggagaaagagacagtaggagaaacgtagctgactgcttctttagtttaccactactatattagcattcaataaaacttgatactgaaaacaacagctcccattgaacaactggaggtagaaaaaagtggcaaacagaaaataaataccaaaaatttttccaagatttagccagaaaatattgagaatctagtttcaatgaagtcaaaagaaaacacagattctctgaaacaagagtctgaagaagagatgaagaaagtaaaagtagactaaaagcaggaaaaaatggaagagtaaataaaactatggcataaataaaatccactccaacagttaattcttcctctttcaatagaggctcaatagatacagcataaagtgataatctccccaaaagggaacttaaatatacaaattacaagaaataaaaggaaggatcataaattttccagatttagaataaaactgcaaaaacacacagattgccacataaacacattctaaaaatgcatgctacttattaaaagagaaatttaaaaagaaacccttaatgaaaaaaaatgaatttgtaatacataaagaatttttacaaccaataagataaaacccaaaaattcaattaaaaactgggcaagtctgcataggaagttcatgaatttaagaaattgaagaaacatcttaaaaaacacataaaaattttaaaagaagtggctctaaacatacaaaaacatgtccaaccacctagtaaagaaagatcaatgaaaacgacattgaggtaccattggcaaatattgaaaagattgacagagagcgttgggcaactctcaacactgttcaaaggaagggaagtttggattcaaatacattggaggaaaatttggcaatctaccaaaatgaaaactgcacaacattttccccccaataattacatttttaggactttatcatacaaatgaactgaaacctgtttatataaatagccagtttaattaggccaagcctgcattaaagttagttctcaaatgagttaaacagtttccattttccactttcttttatttgtctatgtcttaacccaaaactcatgcaaaattttccagcatgatctctccccaaaatgtgagtagatgaaagatctggatggtttgtgttttcgagtgctattggtaaatcagaaattttttaactttaatgtgcaaatctcatttttacagtcccttattaaatttaaatttggtataaattgaaggagctcactatatttaaaataacaatagaattgaaaacctgacataggaagggcctgatacatcttaagaaaaatttagtcaagtataaccttaatatttatatacacaacccaaagtccatgttaattccacttggtattactatataaaagagattattatttatgcagccaaaaaacatatgaaaaaaagctcatcatcactgcttattagagaaatgcaaatcaaaaccacaatgacataccatctcatgtcagttagaatggcgatcattaaaaagtcaggaaacaacagatgctggagaggatgtgtagaaatgggaaggcttttatactgttggtgggagtgtaaattagttcagccattgtggaagacagtgtggctattcctcaaggatctagatctagaaataccatttgacccagcaatcccattactgggtatatacccaaaggattataaatcattctactatgaggacacatgcacatgtatgtttattgcgacactatttacaatagcaaagacttggcaccaaccgaaatgtccatcaatgacagactggataaagaagatgtggcacatatacaccatggaatactatgcagccataaaaaaagatgagttcatgcccttcacagggacatggatgaagctggaaaccatcattctcagctaactaacatcattctcagctaactaacacaggaacaggaaaccaaacactgcatgttctcactcttaagtgggattgaacaatgagaacacatggacacagggaggggaacatcatccaccagggcctgctgggggttggggggctacgggagggatagcattaggagaagtacctaatgcatgccgggcttaaaacctagatgatgggttgatgcgtgcagcaaatcaccatggcacgtgtatacctatgtaacaaatctgcacattctgcacatgtatcccagaacttagagtataatttaaaaaaagagactattgcggagactgaaaaagagatagaaggaagaaaaataaactaaaatctgtaaaaatagacatcacttttcaatataaaatgtatctcaaactttctgaagatattgcctccattttttaatctctaaaatgagcataggctggctgccaaagtccacaatgtaaatgttaacaaattatagtcaaaaatgcctttcaactacttaaaaaaaaacccataaaaatgtagttagtagtcgatgttgcctaaatagagtctcgaagcctacaatctgtaggctgtagaagtgaaccaagtcaaaatttaaaaacaggcttctgtacaacagattttctctgtatacttaactcacattagaagtgtggcatgtgttacaaaattgatgtcagatagcttagaagacttcatatgttttgaatgacaaggtattgaccatggtttctgcaaaagaaactaagcatcataaaaacagatactttaaacaccaagaatatcatcactccatttgttctgctcctttagaggtcctgtgtaattggaagtgaggctactggactacaatgttatcttttacaatgaactaccaaatttagatgtcagagtgacagttgaagaaaattgcttgaatgggaaataaatgaacagtcacagaataaaccaagtctacttgcccaggccttgtgttattaactagagggatgattactgcagcaagaagtgatagcttataaaaattctatgaaaatcaatatagatttgcagattgtaacttcaacaaagatttgatttgtcaaatattagtctaacttgctttattcagcacatgcatttctaaaattattaaagacaaatattcatgattgaaatctaaatgcaatattttttagaactcttgtttttaaatatttaaagtttcagacagaaaaaaaaaaatctattcatgggtagttgtcttcacttactatagtcccagaacataattgttgccccttgacttttattcgaagatttggcttccccacacaaaatttgtctttgtctaacacagtaacactttatgatgtcaattaataattattgattcattgagtcccttctaattcacttacattaccaatcagtagttcattttggtagaattcattccttatgtttaggtaaatgtggaaactttcttccaaatacagctccttcaaatttaaaagaaaagtgcctaatctttgtctcctggatttttggcacgtagttatcaatagaacatagtaaacatagcagtgaattgctgtataactatagtgtcaaaagccatgtttgtttaatgtgcctgcattctgccaaataaattaaattgttcaatcactgtttttgatgataataattatcatattattacccattcctaccttgcaaaaaaaaaaaaaaagcccagtctgcaattttgctggttaatttaaaccagaaactaaactgcaaaatggaaatatttaaaggaaagtagcctttgtattcaagcagggcttactcaaccatagaaacgtgagaaactcaagaacaaccacaacaaaaaaaggcttcttgatgcttcttttgattctaagggggaggtttctttagcttaattttttatattattgcagggaatccttcaccttatcaaaaccacacagctgttaaaaaataataaaaaataagaataaaaagcctaacactcattgtgcttgctgtctctttggaccaataaaaagcggaaagtatgagatgaacatgatacaagtatgtttatataacgggaagaacattaaaaggtagagtttctgcaaaaatgaaaatacctcaaacaattaagtttgttgctttaaagcaagattatagtgtagggcttgagataggaattcattagatatttaaaatgcagcaattattaagtctgtgctaggatcaagttttgcaatgggaatacttacccttggatctcagaggagaaagaaatacatccttctccattagagacctcagctacatgatagtaacttttatttaaaattttaaaaagaagagtgaccaaggtgttatacttattgtcaaaggcactttgcttccctagcgaaaacttgacaacattgtaatctttctctaacagacatgttgcaaagctgcttgccatcttgtagtcctatatgatttccttgcatttccagttctttaggaaatcccctgttttaatgatctttaagaggggaaaagacccttcaatagagaacttgctatttatgccaaatttgaaaaagtagccaaataaaaatgggctataaatgaggtctctttggccatttcaatccaatatagtcttacttctagcccccctgctttgactagggctctcatttcatgtaagcatcatggatttgatatttacctgtatgacaaacagttctacagaaggatagccttaccttttaattaacacagttagctacactatgaaagtagaaatattcgttcagaatgtaagaatgtttttaaaatattataactctctctgtataaataaatggagtttaaaacaacaacaacaaaaaaagcctaacatttgtatttagaagatacaaataactcaggagccacaaaacaacagtcgcctgttaagaatcctattaagaattctgactttttctttactttaaataagtaaataaataaatgttaaaaaatggagtataacactctactctgctgcttgctggctttcctaacaatgtgagcagttgacattgcttggccaagaggaactcaaaaaggtccgtccttccttccttccttcctccctccttcccttccttccttcctccctcccttcctccttccctctctccctcccttccttccttcccttctttttccttcctttcttcccttctttttccttccttccttcctttttccttccttcctttctcttcttctctctccctctttctctttctttctttcttagccaggagattttaaggagtcagtgtctagaccatctttgttttgatcaccaagctcagtagtcaatccatagatgaactattttagaaaaatattttcatgtcagtttgtagctggactgctttggtagcacacccattaaagcacaaactcctttaaattcacagtgctttgtgtctgtttatacaattcccaaagcataaaaatttcaggattggagctgaagggtgcacccatctttatttttctgcttttgatgcacccttcaaattgcttcacacccttctatacaatctaccttgatcagaaatatgtatttatcatactattaggggaaaaaagaaacatatgttctgagtggcaattaagttaccagcactgttaaggtcctggttattttatgtaatctaccatataactcaaaacatccaacaatattggccaaagacattgaccatagatagtgctttcttatcttttcctttctctctctctttttttttttttttttttgagatgaagtctcactctgttacccaggctggagggcagtggcaggatcttggctcaccacctgccaggtttaagtgatcttcccaagtcagcatcccaagtagctgggatcacagacaccacccaccaccacacctggcttttatatatatataatatatatatatattatatatattatatatgtattatatatataatacatatataatatatattttatatatatattatatatatatatatttagtagagatggggtttcaccatgttagccaggctggtgaacacctgacctcaagtgctccgccccccttggcctcccaaagtgctgggattacagatgtgagacactgtgcctggccattgatcatagatagtacctttaaaaacgtatctcaatctaccacttctaatctgagtgaaaccgtttgaattgggtccaaaggttaatcaagggcccctgtattttgttaatatgaactctctaaagggctttatatttacgatttgttttaagctgcttactaaagcatggtggaacatattttacctgctaaaaaatattctacaaaagcatcaaaactgaaagatgaaaattaggccttactgagaaaagaacccctttatgtccaaaacggtccaggataggctggaattcaattatagtatggcaaaatattgtgaacaggctgagataagcaacagctcgaagacttcttgggttgattctagtaaaaaattatttaaactacaaaataacttaatgatgtgtcactggcctgacaaaccattaaaataatctagaagtagagatttaattacaaataaagcacctcttaaaatattaattcctaaaataaaaatgacatgcttatccaattatatcacaatccactcatttcctcttcccaccaggctgaagtttctctttttatattttaaggcttaaaataacatgggtttaaacattttgatatctgtggcatcatttgtcagggactatcctattttgtgggaaccactcttcaaatcattggcctgtacaaaatacaaataatggtgttagtgttactacttgtaccttttccaccaaatgacccaccagttgcttatcagctgatacagttatctataaaacagccctaaggtactggtcatcatcaaatttataataatatcactgtcaacattttctgttaaagaggaaaatagatcaatctaaataataacagcttaaaagttacaaaatgcatcactataatgtgtatcttaataatgattagaatttcacataacatgctagcaaaatacttttgacatgaggaaaaaatgtttaaaactgaataagaatgtcctaaaatactgtatgcatttggcctcctttttcaccaaaatttaacttttttggttgtctgccccaggatcataatgaccatgatgattatcctagtttaggtaatttattaataaggtaatgactcattaattacaatgtttacataaataacatatcaaacaactctgatgaagctttataagtaaatcaaactgaaaatgtgctctgtgattttactaaagacagccacaaagctttaaatagtgcttgtttatagaccactttgaaagaaaaaaaattcacttcgtatctcttgttgacaaaatgccaagaatcattttcaaattagtagcgataaaatattaagtgattcataaatcataatggaaaacagaaaagttgaagtaaatataggcttgaaaatattatctcagaggggtacaaaataatttcaaatggcagtaacactaagccacttacttgaattttaaatgtgaatttgtcttgaaattgtagttcaggtttccctccaattaagaaaaagtattctattaaaaagctaagcagggcttgcataacagatatattaacgcctgtaatcccagcaatttgggaggtcgaggcgggtggatcacgaggtcaagaaatcgagaccaccctggctaacacggtgagccctcgtctctactaaaaatacaaaaaagtagcagggcgtggtggcgggcgcctgtagtcccagctacttgggaatctgaggcaggagaatggcgtgaacacgggaggcggagcttgcagtgagccgagatcacaccactgcactccagcctgggtcacagagcaagaatcagtctcaaaaaaaaaaaaaaaaacagatatattagaagtcaactattcactttaaaaatgcattattaatttatgaaatgattattaataagattgttttaaataaatgggatttcaagttgaaaatctcctgagattttctgaggttaccccatatcagaagcacacccccatatagccatgtggcatggatcctgatgaacctcagtctttggagtttaacaggctggggttggaatcccagctctgtcacttgttggccaaatattgtatttcatctattggaagctcagcctcctcatctgtaaagcgggagtaacaaaggcctaccttaaaaacgctttgaggatagcctgagacaactatggcacatcataggtagttaagtggtgattacattggttaacattaaatcagagaaaatactatgattcaggctctgacggcgctctaattgatagcttgggatctccctcccaatattctcccaagtccaaagtggacataggatgctcctattgagcctttcctgagggaagaatatgattaatgaaagggaggttttcctgtttttgtttggtttggttgttgttgttttgtttgtttgtttctgttttaaagtactggagatttgtaatttattttgaacaatgtttcaaaagggtgaaaaaatatacatttcagggaccatgttaaatggaggccaaggaaaactgtatttttattattttttattaaaaaatccataataggccgggcgcggtggctcatgcctgtaatcccagcactttgggaggccgaggcgggcagatcacgaggtcagaagatcgagaccatcctggctaacacggtgaaaccccgtctctactaaaaatacaaaaaaaaaaaaaaaaaaaattagctgggcatggtggcggcgcctgtggtcccagctactcgggaggctgaggcaggagaatggcatgaacccgggaggcggagcttgcagtgagccgagatcgcgccgctgcactccagcctcggtgacagagcaagactccgtctcaaaaacaataataataataataatccataatagtagaacaatggcaacatcacaactttgttctgtcctttttgtttgaaacatgaatgtgctatggagagccttagtgagtgaacaaaaccctctgcttggattcaaattctacctttccataactataataaagtcgcttaactttttttttgtgggattgttgaggctcaaatgagaaaacacattagaaaatatctggtgacttgacaaacatataaatatgagatactgttattattaatgataaagatgtgttcctggtccctgcactaaggaaggaagtgaggaggtccccttccacaaaccaagagctcaaagatgataaactgttcccaattaattcacaaattcagataagtaaggatcgcaaaaatgagacccagtcatctcagatttatttgttggtgcaaaatcttttagaatctgaatctgtactatgatcttgaagtttcagtgctcaagaacaaaagcaaaagtggtttctattagcagtagaaaacttgaactccttcccaaacatctttaaagactcatcatccttaaaataaacatatcaataagacagagttttaaactctatatatttggtcttgagaaaaaattttattaatattgagaaattaattccattgttaccataaaattagtcatttcccaaaagcaaagccctacttcatgcctgcagtatgaggcattgatacatttaatcaaaatgtcttacagttattgctttttagttttatggtctttgctgtgtgtgttatataacaacagttttggagcactacgtcagaagtaggaagcagaagatgtggctggaaagataggtagagcctgtatcataaagagctttatatgccatgctaaggattttgaaatttaccacttaagtgatgaggatctaccaaacagttttaagccaaggagagatgtagttctatttaattttaggcaggtcactcagtcagcaatgtagagtatttttaagacattaatcacagcctcaaactaagatattacagttgacccttgagcaatacaagttggaattgtgcaggtccacttaaatacaaatctttttcaaccaaattctgttggaaaatacaatattcacaggatataaaatctgagtgtatggagggaacacttctcgtatacctgggttccacgggaccaacagtgaaacttgaatatgcactgatttgggtatgatgatgaagaaagaggtcctagaactaatccccccaaaattctgagggactattataattaagtttgacataaatggtatagtttgggtcatactgttgacttcaagtatttctatttttatattatacttcctttcataatgggaaatcagatgaattctttgaaaatatgactcaattccaaagaaaatccaagttaaaatttttttccacaatttgttgactaattggagcagcaaaataattttgagtagtcgaggcaaacagatatccatgtgctttgagtgttggcaatatgtatcaattaacaatattatcaactctaatctcactttgaagtcaaagagtaatcaaattaaaatctttggcacaagttaagaacatagatctcttttaccatggatacttgcttaaactctttgagtcatgaataatttatctgtataatgggaacaataagatatttcacctatctccttttatttttgagacttgtaagctctgtgaaggaacactgtatgccttcttcattgttgattgtcaagctcccatgcctcctggcacacagtaggaatgaatcaagtgaatataaaaaagtattaccaaatgaaataagaatgtgaaattgttctgtaaaccttagaagtatcatacaagcattagtgctattgtttttgtttcacctattctgttattagcctccaactttttaagatgtactaaaaagacaataatctttcttcaacaaaatttaaaactaccatctctgaagatgcatttatgtgttaaaagtatttttatgcaaatgcttaagaaataatgaggagttctttaaaaattgaatctgctgcctttctaaatatctttcttgtttaaaacacaaaatacatatgccaaaatgaatcaataacttccttgtctggtacagaatgttaaggcttgaatttgaacaaagaagctgaacttagctttggatatctattataaaagatatccaaatgaagaacgcattgacacaatcgttaattagtattcattatactactcctcaaatagaacgatatcaggtctcctatatatcagtgattatttctcttagcttatccaagtttttccttttctactgcacataactgttacacatttgaatctgtaaccaggttttatgatttaatatatgctctgactgtaacacctatattttctgactaaatgcctcctgtatttcaatggacatctcctgtagcccctattaaaagtccctctccctatatccattcttctcagaaacaggctcatttcttctcaaggctagatttggagaactctaggtaaatgccaaaacaaaacaaaacaaaacgtaaaacatctttctctctctccttccctcattctctttccatgctatacttttcctaaccagagtaaagttccttgggagaagtgcttattttcttcaccttgccacatcagcaaaagcaaagtgatgcatcacaaatggtattacagattcctatgattctgagtcttcaatgcacattcatgattgagacactgctttctcttggaaattatggtgattctctgacataacactggtacagtgacctttgaggattctctgtcaacagtcattgatgaaagataacaataacatttcagttccttaaaagtggtatttctcttcatgtcttaatccaaggccgatactgtaccatctacttggaatctcttactcatcccttctcctccctttgcctaatgaacactgttcactcagcaaatgacagtccaaatgatgttcccctatggaggcctttgctggcctccctcactaggtcagggtttcccattatgtgacatcacagcatcctaattcttcttctatgacacttaggatggttttaaaattacaacaccttggggattcttttaataatggctgcctcccacaacgacatataatcttcatatggaaaaaggctatattttgctttccatcatccacgtaggggagtgtctaccacagaatatattgtagtcagtaaatgctttctcttctgtttatccttactcaccaaaccaattctagcctcctcccactcttatctacttaatgtagaaaaatcagtggggctaggcaagagattgttcttgatattttctgtttcttttcaaatttatttatttaaaaaattgtcatacaaaatttatatatttatcacatacaccacaatgttatgaagcatattcagtaacaccttgcttaacctcatggataaattactggaaactgcaactttcagcaaaaagatttataacaaaaccattttaccacaggctaattgattaaaaaaagagttaagttcctggtcacaaaaacatcaccaaacttctgtataaagactcaaaacacttctaatattaaacattgaattaaatgtgaaatatatatacatttaagaaagattaataaaaagataattatttatccaatttttggtgaatcaatgagtgatggcagttgtagttgtagtgggttaaatcaaggaataaatgtttgcaatgcaaaaattctaacgagcaccttctaaaacaaacaagaacaaacatggtgtgcccactgagtgctttcaaactgcattccttattgttgtgcatttgaaagattattgcaagctttatgaattttttattttacaataatttgtatttatttattcattcattcattttccaatccactcattctagttcagagtttgggatggttcaagcctatcccagcagctcagggtgcaaggtagaaaccaagcctggacaggaggccattccatagcagggcgcagtcacacacaaccccccacacacactcactcagactgggacagtttagacacaacaatgaacctaatgtgcacttgtttggaatgtgggaggagattggaatacccagagcaaacccctgcaaatatggggaaaacatgcaagctccacacagtggtcctgaccaagaatcattttttttccctcactaatgttataactaaaagactgagagaaacattattcaaggacctgttgtatagattgtaaaatggtcagatgagaagtatatattttttagatttttacttaaataaaaagacagcaggtagtaatttaaatgtttcagtatgcctacaatctttcagaaataacttcatgaaattcaactttacgaaatgatcttcaaaatacccatacagcacacctttcaataaacggagtttcatttgacagtgtataaaagagtttttttgaaaaacaaaaaaaaaacttgaaaaaatagcaatgcatgatggaataaggtattctcaactttcaactgttatagagaataatagaaaattttaacaaacagctacctaagaaaagatatatctctcaggtagatttttaaatatttttaaaattaacagataaaattgtatgtgtttaacacatacaacatattcttttgaagtatatatacattgcagaatgactaaatctagccaatttacatgttacctcacatagttatcatttttgtgatgaaaacacttcacatccactgtcttagcatttttcaagaacacaatgtattgttaactgcagtcaccatgtacaatagatctcttgaacttacttctcctatctaactgaaatttggtagtctttgaccaatatctcccaaactccaccaacaccacctcactcctaccccctagtaatcacaattctactctctacttctgagatcaacttttttcgaatcaacatatgagtgagatcatgtagtattcttctttttgtgcatagctatttcaattcacataatgtcccccagtttttccacattgttgcaattgacagaatttccatctttattatggctggatagtagtctgttgtgtatatatacctttttaaaaaatattcattcatccattgacaggtagaaaatttatgtaaagcagttaactagcaaaagcagttaacaataacatcttaatgtgccacagatattatgtgaagaggtagaatgataaaccaaaacaaacagccaattcatcaaatcaacaaaactagaaaaatctctgacatcctattattgatgtgagtacattaaaaaattgtgaggcaaagtgactgctacaaagttgaaaaaatacttcacataactcataaatatatagaaattcatattatcgcagaataagcattaagataaaattagaatttgcaattaagtgttcttttgataaatgggaaattatttttagctcctaagatacagcctggctttttgtaataataccattgctgctgcttcttcctcttcttcctgttatcattattttacaatatagacatgttgattttggcatttaagtgtaaattattgatgaatagaacttatattttgttgaaggtgctttgtaatttttaatattgtaaacatcatgatcatcaataagtacaggcttgcaaattacttccctacatgacttaactgagcttaatattttttcaacaagtatataaaaaataataatccagggaactatgtgctaaagctacttacgttcagtgctttacatgttttgtgtacctaggtctcacatttaatatcatttcctataatttcctggattgaaaattaatcagacagtgtcttctctttctacattcttcttctcaaaataataggacaaaaatgtttaatccttctttatggattttaacatgccattagtgctggaaagcatgaaaaatattacaggggaaggtaaccacaaatggataggagactaaaaattgacattgttgtcttccaaatgttcatataatttccattttaatgcttttgttttttagatatatttaaaggtatgttctcttctttacactgcccagagatcacattgtctgaatattagcaagtcttatttccctaagatggaaagtgcaacagagggaagatgactaaaaatagcacgtctctcaagatgtttgctttctatcacctgactctaggatgcagtcttcattagggtacaaatgtattataatggaatggtctgatttctgtttccatattttatgattctcatagtctaccacttgttaaatttaaaagtacattttaaacagatgaaaataagtgttagttgcttgctgataagaagatttaatttcccatatgttgcagcacgcttaattcatttaagaggtgatattcaaaaatattacttagtatgtattaaatttttatctttaataacctaggaagtttgctagcctattatttcctgatacatgaatttataaataatctggttatttgaatttggaatacaaagcaccctactgttgaggaaaggacctcgagggcatgtatagacacaacaaagagggaggtgaccaaaataaaagtatgtattattgatgcacaacctaaatacatctttgaggctttatccagtggaaaaaaaactcaaataaatttttctcttggatgttcaaacagcatgtaattatgttgtatcatatgaataactttccatcaaacatttactgaacaccaattttctaggagttttatttaacaatgaagctaaagcagtggttgtcaattggagaagattttacttccagggacatttgacgatgttgagagatagttttgattgccatgactaagaaagaagtgccactagcatctagtaggtaaaggccagggatgctgctaaccatcctacaatgcacaagacagcctacacagcaaagaattacccaccccaaaatgtcagtaatgccacagttgagaaactctcagataaagacataaggatgacttaaagggagataaaaatgaagaaagaataccttttgtattagtctattctcatgctgctaataaagacatacccaagatggggtaatttataaaggaaagaggtttaattgaatcacagttccacatggctggtgaggcctcacaatcatggcagaaggtgaatgaggagcaaaatcacatcttacatggtagcaggcaagagagaacatgcagggaactcccatttataaaaccatattatctcatgagacttattcactatcactaaaaatcacgggaaggacatgtccccatgattcaatcacctcccaccagtccttctcaggacacgtgggaattatgggatgtacacttcaagatgagatttgggtggggacaaagccaaaccatatctccttttaaagaggtgactgtactaaccctaactagaagagatagctccatgaattaaataatggttgaaatgagacgaaaagtcagatgcagagattgtagggaaagagcatagacaggatacaacaattgagcggctataagagaagctcgtaagaaaggtgaggaatctagggcaattcccgggtttctgcttttgatgacctagtagcaactcacagtatattgagatagggaacgtataaggagaaatagaactggatgggaagttagcttggtttgggaaatgacttagaggagaatgaataacatgtaaatggagccagttgcaaagaatataattatatatgggaatgtgtaaatctgtagagccccaaggttaatattaaaaagacaagaactagccatcaaataagttgaaattttacaccatagatattactattgactaaaagaggtagctgttaggtgcccttctcacaatgcaaatgaggagtgtggatctgggtagctgtgattacccccataatggtgaagttcccctctaagtcacttatgcaaattttagtagtaatgcttcccccatctaatattattctccacagaaatatccacttattcactgccttttcatatgaatgtgtggtataaagctggactgacagaaaaggtaccttaatagaaaccagaaactgatatatttgctaaagctctgtattatttggcttctttcctgctacatgaagtaaaggccatttcactgtattcctaaaggcaatttactattagctatgaattttcaggtaggcttaattaatcaaggtcttaaattaaattgaagtatttattacaagtatatgcatcacaaacatatttatataatttataaatagatttgtgtataatttacttgtctgcaaaacacacagtaccttactgctattgatttcaagtagaatcaagacacttggattcagtgcacaggaaggaaatatgatatctgtccattccataatcagctaacctttagcaaattcattaattttttaaaaggaaaaatataatatttagaattccaaacctcaagtggtaatcacatttcctgagacaacccagttattgttagcacttatatgctaagaaacaattagaaattaattttttagtgaaattagaatccaattaagcaagacagtaagttataatagtgagaaaatggctttcagatttgttcagaataaacgataccagacattttatctacttcagacacatgatgaaagtacaaactctgaaagttcacatttaaaaccaagaaaggagaaatcaacaggtgaagctcatttgcgcaaaataattaacgacaaatgagtagtatttctttcccataaaagaaaagattcatgtggcacttaattatttcatttacccaatacttcgcctgaaattgaagaagctctttttcaccagctgctaaacaaaagcaatttattcaattgggtttgctttgcatgagttgttctgtatataataagggaggaagaaaataaaaatgtgtaagtgccacacttccttccaaacatttttgaaagttatttgtggttccttgatacaagtcataggcataacaccaggcctgcactttattgtaatcattaaatttgtgtgatttgagtattctttcttattaataaactgagaaaataatgtctggaggaagagaaataagacagtgctagtttcctacgttctctagccagctaggcaacaagctctccatgaaggaggccaagccactggaaccacactcccactgtacagcagagaggactggagggggctgttctgtgggttcccaatcacctgttgctttggagttagaatgctggtttaggccaacatagaaatggaatttggttttaaagaaataaacaacagtggtaaaatgtccagatctcttctggacaaaacatggggccaagaaaggaatgtagctgttctagaaggcactctgctgcatgtggctgacagtctgactgaataatgagagctttcgtcaaatgcgactggcaaaggaaccctttccaaactgcattttttctcagggcctatttgcctgcagttgaggtgcaattacccgtcaaatgtggatgtaatgtagccacgtgacaccagcatatttctatttctagaaagatagcagagaaaaatcccctagtgtaatcatgttagtgtatgcttactgtcggaaggaaagggattttttattttgctcctggagttgaaccacagaagttgaaaaaaaaaaaaggctctgaattaaggggaaaaatctgatgttaggaaacattggctcacgtgcttcccactttcaggaactgaacagtttcaacaaataacctggtttatttttttcccagatgcatgcatctattaaagcatttctcttcctccaagtacataaatgaaatacgcataactattttaaaacgagttaagagtttaagcttaagattttatccttaactgcttaattgggcacccactctacactagatatcaaagggcatttgggccagatttgtaagaatatgttcaacaggcgatactttgccaggctgagaaatcaaggtggccagatgttcagcagtgcatttgcaacccatgaacccagctctagagaagcattcatccctggaactgagactccctgaaaaagccatcctcccatggatcacaagggaatttccccaataccagctagaaacaatttaacgaagcccgaagcctgccgaattttcaggagatgagtgtcctgctctctcagacatactgttctgctatttttccctaaggacaaagtccctaaataaatccaaactgacttttatttgaaaagagcaagtgtagattggtatgtccaggaacttaagtcacaggagcaataaattctagcaccctgtttcctctaaacaaaggggcctgcaaaggactattggtatttacgaggactgcagaggcttgagtaagcattttcacagcagccctgtaaggttctaatgcacagcagtactactctatagccagcttattaaaccttaatggcactcttttagtgttgtacaccaggacggtagataactcacccacagcgtggcttctggaagctgccacagcactgcaaccattctgcaggttaccacccttcaacttgaaattcctagatactggtttcttcattaaaatcaggagtcagcaaaccaaggtgcttggccaaatctgacccactgcctctttttgcattgctattagtaaaggaggttttttacattttaaaacagttgacaagaaatcaaaaaagaataatattttgtgacatatgacaactatataaaattgacatttcactgtccataattaagttatattggcaagccaccacacccattcatttaaatattgtctagggctgtttttgtagtataacaggtagttgaggggttatgacagagacttatcaccccaaatcctacttcctggctctttggagaaaaagtttgatccctgatttgaaagtactatcagtcattttcatcctttaacaggttctgaaatgcattactatcaacttaaaggaagactccatgtcagcctctttaaccactggtcaaaatgaatcatttcccaacagtcagatccattgtccccacttaagaaaagcatgcaagagctctgggtgggctaagcaaggatcaagactaaaatagtacctttagaaagctctggagttgctccagcaacatatagctgaaaagtagtatcactgatatttttttcaaactaacataatagaacttgttctcttcaaaggagtaactttgaaatttgttgcaaagaatctgccaatgttcaaaacatatttggagtgcacctttgatgctgcctttagaggctctttttaaattatcttttaaacaatctcaataatgccaaatcttgattcattatacttgagcttgattcatatttttaatcttaagtcattcagaactacaatcagtgaataaaagggagaagtacattgcctggaatagatggcgacctcaataaatattagtgaaacgaattgagctggttcgatataaagtgacactaatgcaacttaaaggaataaaaacctactgaagacatacatatccatccattatctgtgcccctaagcgtacataccccaagtctttctgattctacatttagttttcaaatattgctggctttctgggaatctgcatgattttatctgattctccactgccttcttccattcccaagcctgcctcattgtcctgcatagaactcgtctcagcccctgcttgacatctgactgctcgctctggacttcagttgtcacatctcttttccatctctcagaccacttctgatcaacatgcccatatagttatatacaccagtgatagttctcggcccaaagtgcctttcatattcacatacttctctgagggaagtagtcataggtttccacatgcatgatatggcaagccttacatcatgctaccctgtccatgatagactacacggatgcatatcgaaggtagccctgcatagggaagaagcgggggagacagggatctatgaagctatgtagcaaatgcctaaaagaacaaaattcaatactgcttcgtagatccctgtctcccctgttttcccacagcagggctacctttacatggaactcaagtagaacttttcttaggaagacatgatacactggtataagtaaaggagaaaggaaggagacataggaaatgagcggtctgtagaaatacacactgctattagaaagagcagtgcaccctcagaaatcagtcaagacagaaaggtgagccacagaatgatgccttcctggaggcagggggagatagtaaacttgcgagttcaatgaatttgctataatatcccaagtagtgtaaccatgttctagttctttaggatgcctggctgtgtgactgcaaggaaggtttcctgtgttttctcacattcctatttttcacagtaacctaaatgggtctcttcattgtaacctgaataaatctgtattcacagaaatgaaagtggttttctgttcacttactaacttggctatgacttcaggagcagagaattctaaaactgctttgagtaacatcagtgtctgtgcactaagtgtatataatcccagatgacttactaaaagaaccaaattccaatgaaacctttggtaaacttttccaaatagagcttcatgactttaaagctgcttctactggatgtgtcaatttatggagtaaaataaagtaagagcaaaaaattaatttacaatactttagggaatgataagacagcctaaattgccaggtagttatctgtatagcagtgtacattgtgtctaagtcttattttttaggaattgctcaatgtttctgctatgcttaaacaaaaataacaaattatttatttacagtatctgaaaacagtaacaacagagacatttatagatttatgatactttgtattctgttataaaaataaaataaatcagaaatagcaaatagtaatttattcatttatgtgtttattaaaaaagcatttactatatgctaagaactgaagacaggttgtataaaatgacttctctgttctggtgaagttcattgtgaaggagaatgacacctaaatcagcgatacaacaaagcatcaaggagggacacctgatccagcctggggtggagaggaggtagagtttaggaaagattttctggagaaggaatggtatttgatccaaccctgaaggatgaggtacatcctgccttgttgggacaggctgatccatgttgtttgatgagtaaaatatcagaacttgctggccaaaggtgcatcatcactcatcactgaagacacaggaataatggatctgttttatttccagagttactttattaaaatactaaactctcctgggaaagtttaaattacaagtctgtccaggtaaaaccttatccctatcagtcgatggaggaacagacgagacagaataaagagggaagaggaatggtttcttaggaattactgtttggtccagccctggctatggacatgtaagaatttgatttgggcaaactatattaactattggaaacactctgtttgcatgttaaatgcctagaaaggatgaatcatacatatttcctatgttccattttctgactctgttctttttcctgtttctgctttctatgccctggccttcctccctaccctccattgagggtacaatagcatgtggtatcaattaatgttaagttttgaaacttaagtttcagtaaactttgggtcagcactacaaagaacatctttatatctacatcttttaaattcaacctttgattataaggaaccaagagagtttggataggtcaatgaaaatctatcccaagtcctacaaatgtgacacaaggtaaattttttatgaaagatcattagacaatattgttcatgttttctatttttcttctactcaatattaaatgggaatatcacaaaatattgaggaagagtaaataattgtttaatattaccatctttagcaaaaaaaatcatttactactgtaatctctgaatagaaggaatatgagcaataaaataaatctgaatttacactccaatattgttgaattcaatcttgttcaatcttgttctataaaacatctttcacaaatgtgggctctgaattttattttatcctgtcattgcttaatttaccagattctgaaccagtcttttgggacatttgcagactgatttctaaggcaatctgacaaaaataacttgaaatttcaatgaggatgaagaattgctctttaaagaatgaggaagtcagtaggcataagggaatttctcacaaaaccgcaatgcagaccacttcacaaataactgggaaaattctaaatttttactgcactgaaagacaattgggagagaggacaaaccactacttacctgtaaaagcttcaccagtttattacagtaatttccctagaattcaccctaaagttttttgaatagagcagcacctttaaatctgtcttaattatcagcatatgcaaaatatagaatgattgctttacaaaagccattactccagatgtgcagactaggtgaatttcctctgtgggcacggcatttctaggcagacaatgttaatattcactatgactatataaagatgaatggaatgcttaggtttcacgcctacttgataagtaatcattttagataaattatagattgattacatttaattacagaactacaatgctcatacagtattctaagcctttgtcacttatccatctgactctctacacaaaggaatccctgaaaggataagtgagagaagcaaatgcttcaaaagctacagatttcatgcaattgccacaagagttgtgaacaacatcttttttgttctttcttttttaaaatacagatcatggggatacgagtgcagatttgttaaatggatatattgtataatggttgggcttctagcgtgcccatcacctgaatagttcccagtgtctgtcacttccctctgcatatccatgtgtacccattgcttagcttctattattattattattatcattattattattacttgaactcctgggttcacacaattttcccacctcagcttcttgagtagttggaacaacaggcatgcactactggctggctatttttaaaatacatttgtagagacagaatctcactatgttgcccaggctggtcttgaactcctggcttcaaatgattctcccacctcagactctgaaagtgctgggattacaggtattagccacgctgctcagccagctgccacttataagtgagaacatgcagtatgaattttctgtttctgagttacttagaatattggcctccacctccatctatgttgctgtaaaagacacagtttctttctttctttttttttttttttttttgagatggagtctcgctctttcatccaggctggagtgcagtggcacaaccctggctcactgcaacctccgtctcccgggttcaagcaattctactgcctcaggctcccaagtagctgggactacagatgagtgccaccacacccagctaattattttgtatttttattttttagtagagatgggtttcaccataatggtcaggctggtctcaaactcccgaccttgtgatgcacccgcctcagcctcccaaagtgctgggattacaggcgtgagccaccgcacccggctggtttgattctttttaatggctgtatagtattctgtggtgtacatgtaccatatatttttattcagtcacctattgatggacacttaggttgattatgtggttaacatcttcgatgatgaagaaccatggagttggcaatttggctatgaatacaaataagaagtagtgctcatcaggtaactatagcttgcttttttaattcacagaactacctttaaatatattttattgcctgtaccttacaagcatcagaactaaagctcataaagattataggtaacttgtacaaagctaacaggttgagaatccaagttcaaaaaaagctttactactttgtcataggaaattactatggacttcaccctaaagttaattcagctctgccctatttcaacgtttgcattctcttttcactctgccataatatttcacaacagaagtctcaagtgtaaagactcaagagaaacaccgggtggtaatttaatcaagacaaagttcctgggataactgtttatattaaaataattaaaactctaaaactctaaagtgtaatgaccatacaggtgatataaaatgtgcagctgagtagagaagagagatgtaacttttttcttagtgttgaggaagtctttccaaagagataattttaaaatgggttttaaaggatgcataggagttcaaccatgtataagggcaacatgggtgacctgagcaaaggattagataaaacaaaatccgggcacttgacatgctcagggatcaaatagtccaatgtggctcagggtttgtatcctccttaccttcctctttttgtgatcagcacatctcaatattttagctttccctaatcggcttaattttaatattaaaatattcaatattaatattaagattaataaaaagacaaaattttgaaatgacagcaaattcaatgatgaaattgccgtaagtgctaaagcaccaaagaactaaactaaaaacagttgcacctcttcttggctccctttcttcagggtcccaatatctttaccactgaaaattatttttttaaggcacagatttttcaggaaggaaaggaataaaattaacacaaattgaatagaaatatgaatagttcaaaattagacttttactctcttttagactttctaattccaagcaacactatccgacaggttatgatgcctcagtttgatgacagcttttttcttgaacacttgccaggatgaggaaacccagggaaattttcatgaaagacctcctaaaaattatgtgaaaattcaggcaagtatttgaggcccctgctagacttttttagtacatctgtaaatttacagattttttttttttatagaacaagcaaaatcaccaacttaaaacatccatgaacctgaacaagatattttatccaccacttctttccttcccaagagggagattctctctaatctcaggaaacaaatattttcctattgtgtggttcctcagacctggcttttgaaatttctgctaagtacacagttgtaatcatttattacataatctatttctaatgtcttattctacacataatgtttgtgaaatgcatgtagcttagttgtctgtggatatattccttgcctcttgcaagattcttaaaacagatttttatgattaataggtgtctctgttgctaacctcaagtcactcaaactctccttttgaaatgaacatttatttcagatagtacatgctctctgcggatagcctgtccacttttcaaatgtaatgtcctgtcttccatagatacgaaattttcaaaagatattggcataatgcaggagaaaatgccatccttttattatgttcaaaattgatctgacccctgaggtagcactttggggaattgggctacataatcatgtagaccctttcaggaaatggcttatttatggatttattttttatatacagaagatttcacacttctggctttatacaattgcatcctctcttcctttccaatatgtttccaaagtaggaaagctatatatggcaggagaactgaatttctatatcagctagaaatctgtcatctgctatatattggctctaatgataatgctttaagaatacatttatcccatatatgcatccagtcctctccagcagaacttttgcagttctcatttactgaataaagtaatgctaaagatagtgctatatcctggtcattgtccaatttttttttttttttaaaactgacttctaaatttattttttaaatgtctttttccccctgaagaattgatgtattttacactcttagataataaaagtttagtaagtctgcatgtgttttttctcactgcttagtttacatttagtaggtcatctttattgtattaaaatttaaggaaataaatcatattaagtacatattaaaaacatagtataaatatcaagcccttgttttgtctgaactttttattattcaaattgttctttatttttaaaagttaaaggaagaaatgtagttaatctgtatatccacataaagcaacacaagtagtccaactaaacccgctgatcttggttccagtcctttcgaaatggctatgttttaaataaaacctatttccttaggctaacaaacagtctataatccattaagtctttatgaacaaatccaaggcttttgaaattagtgcttggggaagaaagagtcaagtaatgaatttcaaagaattatgaaggtgattaaagaggaacaaaggatcaaactcccatcaccatgatttctagaacagagcctatcaaatgggcatttgggaattttatttatcatctaatcctgaatatgaaatagaaggtagagggaagaaggcaagaaacagtgttaatttagaaaggaggtgggatagagaaatagaaaaaagaatatgagagcaatttttctttaatggacatttgtaagctaaagagcaaccaggaaaaggtaataatactgacaaaaagagccgttgtttctgaagtttcaaaatgtcattttaactttttaagctggactgagtaaattgggtaagaccaccctgatcctagtgatgccagagatatcttagttacaaacaatggtttgagttatacttgttgtcacagaactgaaaattgcaaaactaattttctcttatgtactcaagtgtactatggaaaaacagagatactacaaagccaccaactccagtgggaaagtcatctctgtgctggctccaggagggtttatctgtggcagagacttaaaattgtcccattaataagctttctcattggcttccctgtctaggcagaattctgagctggccacaaggccatacaatataaagaaggaatttttcagtctcccttgcagctaagtgtgaccatgtgactaactctggccaataggatgtgagcagacgtgatgaggtccacttctaagccatgctcttaaaggggaatgtggtctttccctatgagaatggccatcttgtttttgtttttgttttgagacagagtcttgctctgtcacccaggctggagtgcaatggcactatcttggctcactgcaatctccgcctcccaggttctagcgattatcctgcctcagcctcctgagtagccgggattacaggcgcctggcaccacgcctggctaatttttgtctttgtattagagagggggtttcaccatgttggccaggctggtctcgaactcctgacctcaggtgatccacccttcttggcttcccaaagtgttgggattacaagcatgagccaccacgatcagctgagtagccatctttgaccaagcagataaggatgcctcatagggttagtgaacaaaaatacaaaaagagctggaactcctaaaaattctccagaaaagagccatctcacttgttcagatctggttattcagactctacatgagaagttagatgtaaacttctattttgcttaaatcatttaaatttcagcctcttttcctgcatcagaacttttacaataatagcaaacacactatagcccttaccatgtgccaggcagtgtcctgagtgcttttactatattaactcattacataagactataatttaaaacataacattattatttgtgtctacagacacagaattcaagcactgagaggttatatggttgatccagggtctgaatccagaaaatctgactccagagtccatatacttggtcataccatttagcacaacatcatacatttaacatatattaagggaacatttgtttaataagttaacaggtaatctgtctgtttaaaattgcataactgtgtttagaagtctcaacatcaacagattttttatgtgatctctgattttcttcttcaacaagggaaaagtcatcaatttagatggtaagcaatgtcctgtagggtactctgtaccctgcaaccttttatgtagccagtttctagcatctctgagaataccctggcatgtcagctactgctgagcaaagatgtgctctgacaatacaggaacacaagagaattgaaaaggagcacagatgaacagcatgaagaatcaagatgaggcccattgcctatttgttttccattctattagcatggtgcctactaagtgccagggaccaaatgtttggtgacagtggaagaggtatacaaatgaatgagacattctttccctcaaagaattaaaatccagcctcctttgagtacaaagtctttccaaagatctcttttgtgttcttcccttaactaataggcctctcgaggataagtcccagcaaatcatttttcagtggaatggaaaaaggggaatactgacaaacatgaagaaatatttttttaaaaaatttcttttaagaaccagaagttgttggggcaatgaagatatgtaggaaaaaaaatgagaaaaaaatataatgaagttagttttgaaactaagttttgtggcaattttatgacaaagattagggccatctctttgagatttttttcttctttccccaagtatcaaggaatgaatccttgaagtttcttttttgcagagatttaagttttcaacttttcaataatgaatagccactttgctttagataactttaattaaagtttcataaatgcaccaagagccatagggctttttgtattcttgaaataatgaataatttaatcaattaatacataatgggagcaaatgactaattgcagattcaagatacattttgtcaatcatctttattgacagttatagattacaaagtccaccataccaaaagtcaagaatgccttgattgacaattaattgctaagaccaattccattatcatgacttctgccctctattttccaatttggaaagcgtgttgcagtttcgatttatacactgggaagttgtattagtatcaactttagctcttatataaatgtggcattttaaaataaacattctcccaaattaatactttgtttctgcaaacatgagcaccaagcacatggctgaaaacatctttcattacgctagtttcaagaaaaaacactccttttcactgaaatttaatttgtaagacatttagggtatccctacactatatttttaattgaattttaaaggaaggatggagaaataacagttccgaatttgttggatatttattattttgaaaaataaatctgcattcatttatttgccatagtctaccaggccatccatccatccatccatccatccacccatccatctattcatttgttcatccatcaacgcatacatagatactttatcttttaagagtcaaaaaaaagtttttgaactaaagtccaaaaggaccttccgaactcagtctgcctagaacaccacgcttgagtcaaaaattctggaaatgtgttgctgtaaactcatcttctcatctggatctcattggagtaacataatccacattttcttcttttaagcatatacaaccccagaacacatccaatttgttcacagctatctgcataattaatcagtagtctttaggttcactccacacttaaattttcacatatctatgcatgcattggatacatacctcacaggatataatttctggacaaaagaatgttacttagaatgatgagcgtctgataaaactatggctatgctctcaatatcaagacagtttggctggtatggaacagacaaattaattgaaactcatgtaagttttattaatcacatttcagagtggccacatttctcttctttggctttatagtctttacagccaacttaagtcattatcatgcattactcatgacttgtgtatcatgtctatatacttccacacttggttatccctctgattgagagcactttgaaatcagtccctaaacactctgtgttataaatattctctgtaaacctttcatgtgtatttgcatgtaaataatgaaatatttgataagcagaatacaccacaaaaaattacatcaagacaaaatttattgaaaagcatcctgatttttgtcgttaaaactcataaaactagagcttaatcacctctagattctttttacaaaagttaggtaaaaacaatttccatttacattttttctacttactatcctatgacctacatagttcagcataattaataactggaaatttttgacctcctctgtgtatttgcaaaatgtaatattcccaagtataccttagcagagtcttctgtggcaaaaaaatattcactaagaattataatctagaaagcctttgtctatctatatagcttcagacaaaatagcattttatagatcataatggtaatgtaaacattcataacttaccccaattagctgaaagtcttgacatataagattacagccatagatcgatgaagatgcagcagaaaaggtatggcatatttagaaggctagttacactcatcataacaacagaaactaaaatatgtattcttttggttatctattctgggcacaccgaaataaattgtgaaccaaaccctataaagacaaacccaaaatgtacccagaactgtgcacattaggtaaatttttattagaatacaataggaattgaggacaatgcggtcttattaaataaactattaataaaaaggctgaaagggttgaagattttctgggctctctggagatttgaactatctttgattaaatgtgagctaaaaatactccagatatcaaaaacaaaaacttgtagtggtagcaacgaactataggtatatgtagtacttattcattccataccacaataattcaaaaattcctaggagccagctaatcccttttcagcatttgtgctcagggacttcttcactttttatagctgggtaatatataaacacaaatgtccctcctttttacttgaaccccagaggaaagcagttttacagagctatggaagcagatcttattaattaaagtctattttttgttcctctaaatttatcttttactatcagtgtgttgtgtgctaaggaatggattctaagacttatgaaatgggaagcatctatcacagtgttcaatgcatgctaaataaatgttcatcctccattaatataaaggtactcactgagaccgagtgtggtggctcacgctataatcccagcactttgagaggccaaggtgggcggatcagaaggtcaggagttcgagaccagcctggccaacatgttgaaaccccgtgtctactaaaaatacaaaaatcagccgggtgtggtggcgggtgcctgtaatcccagctactcgggaggctcaggcaggggaattgcttgaacgtgggaggcagagggtgtagtgagccaagattgctccactgcactccagcctgggtgacagagccagactgtcttgtagggggtgggatggggcggaaaaggtactcactagtttattaacttggtaaaattaaattgtatccacattaccagcaggcaaaacaagtgaagacttttaaaaaatgattttacagactcaagggctgattccttttcagaaacagaaacgagttacagagctttcaacttttatttatataatattatccccgtaaggtttaaccaagaagataaagtagatgtgattggcaaatcttttaaaacttgatgtacaaatgtttgttaaatatccagggtcctaaaaatcaaatagccatttaattttgtaaacatgtttttaatatagtcttgtaattccaatgatgatccaataactagatttaaaatttaaaaattcagtaaacacataccagaaacaagaaaaattttatttgttaaatttaagatttaagtcacaatttcaggccaatggattcaaaatactttaaatcttaacttgagtcattaacaattaatactaaatatccaatgccccaaatctcctttggtcctagattagctgatgacaaatgacaagttgattgctaataagcatagatcacaattttatgagaaagtctatttgtggcttgatattctcattaatattatcaaagtccacacttccaaaaattcaaattgcttttctgtaagaaacacaagacagagtctgctctaaattggtattcccaatgttcctgcccttgggagttataaagaaggtaaaaagctatcccttcttttccctgccaattctccgtccttccatgtgagaacagactttcagaaaataacattttccttctttcatgatcaatttagccctaccttattttttcttggctgaattggcccccacctgttgcctcctggttttgttaattaaaatgagacaagtgaaaagcactgacaacctagaccttgtgtgattattaaagaatgacaggtgctttggaaatcaaacctaacaccaaacataaagaagcctttagacctctatcttacaagataattacattaatcagtgaaaaactagattaatctattggggagttaagtaactgaaaatgggacaccctaaaaaattacttggtacaaaataagaaacaaatgtcagtgaattcattgagtagtctgggacttctttttaagtcactatggtattggtcttttactaataaaatagatgacttattaaagcaatatttacactgattaattcacaacggcagtacctgagacccctaagaaaacaactattcctttaaaatccagcctgaaagtagtgctcaggtgtacacactgagccttttgtctttaacttagcaaacactcagttcaaaaataattttgtcattcagaggagaagctattttatagataaaagattatgaatttcacagctgacttgagctctactcaggtcaacaacattggtttctactttgcaagtaggatttgttctgtcaatgcagatttctcagtaagtactttcccctttcaaagaaacatttacatttttttatataaatcaagtcactgattatattagctcagattcacatttgatgcacccttgtgcccctcctcctacacttcagctaaaatggaaacagactttgtttctaacttttaatactgacatttttgagtgtaatcaaaattccagagtgttggcttagatggagttctaaactgaagaaaggagtaagggctaaggtggctttttgtttttgttgtatgtattttcctattttataaatagttcttcagtttcctgtatgatactaacaatatgcatgtcatatattaaacaatatatgcattaaaaatgaggaactgtctgccctaatatgagcatttttttgtgagttttgttttgtttttttctgagatggagtcttgctctgttgcccaggctggagtgcagtggcgtgatcttggcttactgcaacctctgcctcccgggttcaagcaattctcctgcctcagcctcctgagcatctgggactacaggtgtgcaccaccacgcccagctaatttttgtatttttagtagagacggagttttacattttggccaggctggtctcgaactcctgacctcgtgattcacccacctcagcctcccaaagtgctgggatcacaggtgtgagccactgcacccggcctcttccttttatttagtttatgatttatccttattatatattttgaaagcttagagacatgtcaaattaggaaggatcaagaaggagcttaactttttgtagggggaggctctgattctgaatatctctaaagcctgaaaagcaatttaattagtcactaagtgggaaggctccatttgatgacaggctgtaaatggcattactcttggtcatctgagtagaatgcagaaaggttgcaaatgaaatggtaatggatttaattgcttattctgatattcataaaaatctgagatgtttctcaagccctgtttagactctaaacaattttatttttccttatattaataattagtgatcaggtcgaatacactgaagccttgtctatgtaaaaacaccatcaagtgactattttcatgactcctgacttactctcaactgcctccataatgactttatttaaaccatgatccattgaaatgactcatgaatttcagaggttccctttatcttttccgtggatttatacccaaagctctggaatagttgtatgaacactagaaaaaaagaaacagaaatgacaggttccaggtaatcaatgataaaactactttgaaaaccaagaagaaataatttcatttatggagttttatgagcactgtatttaagctgacattcaacttttaaaaattgtacgtatttaatgtgtacaacatgatgttttgacatatgtaatgaaatatttactgcagtcaagcaaattaacataaccatctagtcacagtcacagttaccagttacggttacctttttttgttgttgttgttggtagggagagaacttgtctcctgactactgtcttagcagttttcagtgtacaatataatatcattaactttaataatcaagctgtacattagatcactagacttatcctgaaaaacgtcaattgtgtatacttttactaatatctctccatctccccccacctccctgaccctgctaactacctttctactgtttctatatattcaattttttaaattattttttattttttacgtttttagagtcagagtgttactcttttgcccaggctggagtgcagtggtgctccttgcttactgctgccttgaatttctgggctcaggcagtcttcctgcctcagcctcccaagcaactaggactacaggcacatgccgcaacttccacgtaagtttttatttttttttaattttttatttttttccagttttttgagatgggagtcttgctatgttgcccaggcagctgtctaacgcctggcatcaagggatccttccacctcagcctcccaagtcttcaggagtacaggcttgagctactactacaatcagtgtattaaacatttttagattccacatgtaagtgagaccatgcaatatttttctttctgcgtccggcttatttcacttagtgttacgctttccagacattcattttcattgacaggcatcatacatgatgctaaagagcatggtagacagggagtcagacagatttgggttaatgatctgagcccaccactcatccaacgatgtgacctttaaatgggttaatttatcctagtcttgtgttcctcagctaaaaaatggggataggttgataatcgttaaggttttgtaagggttaaacgagacatgtttgtaaagcacttaatgaggtcagacacgcaggagctgcccagtaaatattagctacaaatttaggacctaacataaagggatctctcaagaaaatcactgaatgcaaagacaagtattttcttaatactttacagctgagtatttgatccaaggttctttcccatttatagatttgttatttgatgcatttcattttactttttatgcagatgggttggttagcccggcctcagttatcatttgaaactcaaaagggcagaatgtaaaacaagatattcttatgattccaaattgaaaaatacacaaacatcaatgtcttcaaaactatagagtttttactaggacacagtttttcctctaacttgatgaaaaatcaggagttctggcttccattggtatctctgacactaattaattgtgaaggccttggtctcctttatttgggatatgagagttttgacaaaatgacctcttaggtcccttcagtatgtctgaaaactaattcagaatgtaaccctaatgccgtttgtgaggaaaataaaagagacttttcccctgtatgtcataaatcccaacctgtgacaagttcttcacatgtgtaaaattctgtcctggttttctatggcagtccccatgatggaaactcttttagttatgcataaaatcaggccagtttatcacccagaaaaggaagagaggcgacatgcttccagcctatatcgtctagactaattttcttgttctctctgatgccactatgggacccttgccagctgcctcctaggaaataattattaattgcacttactcaaattagcctcctcctaagtccccttcaagatcacactacagagatgtcctgagagcctagcggaagcagagaaactaaaaaaaatgttcacaatctttcttcttccaaagaggttcctgcaaatagactcatgattaaaatggacctcataacatgtcagcttcttggaatggaccctccttccaaggctagaggcctgaggattgcttctaaataaaagaaagcttgctatgttttcagttccagatggtatatgtgcactaatagacagcaaattctaaaacgacatgcctctggcttcatcctggagtctcagaagcagagaagaaatgcattagaaaaggaaagagagagtatcttgctcttgtttgtgttgggatataccaaggcaacatttcaggcagcttacactgctcatagattattttgatcaaaattgttattgctcacttctttcatttcttggataagttaactgaccacttggaaccattccccttaaaatgggtaacaggaaatcctaggtcctctaactctcagcacatattcatagaaaaccaaagttgcaatactgtaaaaggagcagaaataactaactacaattcaatatatttcattcagaacgaggctttgaaaaaagcaatgatcctttgtgcccagggctgctcaatttgattactgcatcccctactttgtgaagtgatattttgtttctattttgattccaaactgctcaaatagagtcctcctcaggcaagtgtataagaatatagcatattttggcctcaaatgactcttattaaagaataataaatcaatttaaacattattattacttcaaaaatcaaatctgtaacaaatattaatcaatctgatacttctactgttattggagaacatttagtctataaactacattatggatgtcatggtcccatttcttaaaatatgtctaggtatatgcttatactgatgcataattagatatgtttatatcatatatatactgattcaacagaggagaaaatattcgtgaagacgagattaacacagcagacagaaagcatcacatcttaccttataagactgcatttataattaccatgtggtagaataatggatgatctttttcattattatgtttcttaataattttcaaattaaaatatttgaagaaaacaaatgcaatatcctataatttgtataacataaattccattttttccctagataatggcaaaggccgcatgactattaaaactttagataagtatgtacatatacacacaaagtagccttttttattttaatgtgggagaaataagctaagaagagtaatgctatctattcttctattagatagggttttatataatacatgcttacaaaaggatcatgttgtcaagggtacctcgtcttctctttaaaacaaaactaatttcaaaggttgcttaatcaaatcacaatgaagtttcatacttttcaatttaacaaaatatcacagaaaagcatgcatcatagaaaatcatatcttcctagataatgaatttccaacaggtaattttggagagtctctatttataagctaagaatgatgatttgaatatttaaagatatgcactgctgacaaataggagtgtatttatggagtacaagttttagttatctaaggtttctaaatccccaggagctcaagaatgaagaaaccatgcactgataatccgaacctggatagatgaattctagacagcaacttgtgtactcccctcacagccacagaggtaggtggaatgtataatacattgtcttgtggaaatcataagctcaaaaggaccctagaattatcttcattgctatctcatgatgaccttttcataatatgcagccactgatcttcacgtctcaaattataatagtcaataaagaatcactttatataaaaagtatttgacttatttcacttatttgaattccagggtagggagactgtttgcagggatatttagcttagctttcaaactatctgtggttcctaactgtcacaacattcaggagtatcctaaatatataatgaaatgtctgtaaacctaaataaatgttagtataaataataaatacctacacaattggaggaatagtgtcatattgaggaattaagtcaaaatggtttaatcatgaaaagctatggtagacactggggaatgaatggcaaaaataacagaatatagttagtgtccctcctggctttgagtaatatatgctgatgtaaaaatttttgattgttagtgttaaccactgtatttattcactaatctgtaaatttgacacaatggatttattaatgtaatttaatttacttggcatttcttctcctgagaaagactcctaatagatttaccctttaccagtccaaccaaattatgagatttctcccctatttctacctcacaggaggaacctggatatgcatagattcaggatcttagttttttacttttaatgaagaattatgctattggaagttgaacaaagatatgcagagttggaggacagtcatagtatgcaggggttaaaaaaagaaaacaattttgcaggcacttgatgtgggcatgacggtggtgtgtctatgagatggctgttctttgtgggtttttttttttcttttaatcttgggaaactttgcagtttttacacatgttcatagaaccatgatctaaatttcaatatagctagttttgacagtgcttttacattttcaacgcatttttattttcccctctgacaattcagcttattctattaagtgtacttccaacctctctctctccaggctctcatcctacacacatgttaaacctgaggtatgttttggaagtaggggatctcagacagtccatctgattttttgtcacatcctctcatctagtcactagaaaatgcttctatcagatttgtgtcataggtaagccaaatacatatgttgcaatttcagctacttcatttatcaccagctaaaaataaacaaaaacaaacaatggtaaaattaaaccaccctccatttcctgatcatataattttaagttttgatagaggcaggcagtgcttgagcactacataagcaacttgttagggcatgccacagaattctgatggagttcttggggctttcttgggagtcacttccttagaaagagagaatggaacatagatggctgtagacactaataatatatatcaagaaataagttaaagtatataacaacattatatatgggtaaatgctacaaaaaataaatcaagaagagagtgatatttctatgggaagatttaggtcaggaatttttttctgatgaagtcgactttgaatagagctccaaaactatagtacatattctaatatgtctagaattatctcatcagtatctattaatcaaggatggtgaataactacagtctcattctttttgccttatattctgctcactcttacttccctagttcccaccctaagctctcacgattatactattatgatttgattcttcactgacactaatattgctcctctgagtgcctaggatgagtgtttatttagtttatttatgcatttatgatgctcttgagtattttgacaatcaggaaccacagaaatgtgaggaaagccaagccaaatgcacttcaagcagtctccctgccatgaaagctgtgagccctgaagtcatttacctgataatctgttctatgggtgctagcaagcattagaccccgtagacatgtggtgctggggaggctgtaagccaaggaatctgggcaggtataacaggaaccgaagacttaagcagaaagctgacaagaacaccataccgctacttctctgaggtcaccaacagcatctcagtccaagagtagccagacccattaaacaaaagcataaatgatgggaatcagatccttttttggaagacatcaggattgctaggatatttagtgtctttagggaagaaaaagtatgaagaaaggcagctaaggacactggagacaaatgtctcgtgttttcatgattttacttgttaactttccactcggcagacagaatctgggcacagggactttgcctgcagctgtcatggggagctctgctgtaaatatattagcatataagcacagtatacaaggaatttgttagtctgacagcacataatgtagtttaatcaatataattattgaaaaaaataatttacacacaattgctcattcactcgagtatctgggaacctcaaagagaaaaagaaatggtttttctatgctgaagatgagagcttcagaataggtagattctggttgtaaggcagtcttaatcttaataatggaagatcttaatctttgatggtagacgctagtcctcctctcacataaatactgaggaatgctaagaaatgctagtttctgcagacatctttcctgcttcaaaaagacaagcttcactttgatctgtttcccatgtggactctgtatgatttctttcagagggggaaaaatgaagagagtcctgccactttaaaaaacaaaaacaacatgaaacaaacaaaacacctctctctaaaatctctagaaaacactccatccggcctttccctttcctcctcagctcaaatcagaagcaactcaccacaattaaaacaaagagtttccttctcatctttcatcactcaaaaggccagaagagctctaatccctcagagaaaaaaaaatcattccatataattatgggtgcattgacatcaatgattttctgagtttattttttaaatgccattgtttggtaaatgccatttctaaaatgtcattatttttttaatgccactaaaccacattaagagtggtttagtagcattgaagtgcaaatgaaaaaaaagaatatattttttgtaaatttaagagagtaagaataaaaggttcttaggactgtatactctccataagaatcatgaagagtaatgccgaagatcagagaaaactaaccagtatttataatgatgttcacttctattgtggcctgagccttggggtgtttggagcaatttttcaacccttctgagccttatttttctcacttttaaaatgagggtgttaaaggcaggtgatctcaacatcttttcccaacttacccagctttggatttttttttctggttataaaattattctgattattttttcttagaaaaaatatagataggaaaatgtatatttctgttaattctaccactcacagataaccagttcggtgtatattcttctaggtaatgcttgggttctttttttaaaagccataacgaccacaataaacacagtagaatctcttttctgctttatctctctgaagaatatgtgagcttttttttccccctgttttagtatttaagtgcttaacaattgaggttctggcaactaaaactgcacaggcagcagctccgtttttctcagaatcaagcgaaactgaacaggcaattaaaagttactgaactgcaaggtaaaattacttccctgctatgcttctgggtgactaaagaagggagacaatggaaaccatatttagaattaagatagaaggatggaacatagcagtctgctctactaaaatggaatctataagcattacacataatcagcagcacttcaatcatgctctttgctcacagttacatggaagattacacaaaacaaatgtgcaatattcaaatctgtggcattgctggttaacagaaggcacttctctcccagcccacacggtgatccaaattgtctcctgtacagtcagtgcccatctcacaaatgggctatgctccaagcatctacttgtaagctcattgttccattctctgtattaagtttctcatagaattaatgttataaattgtcctcagattcctaggctagcctatatgggccagcttattaaaaggcacattatcaaaaaataacatcaagaagactatgcaaattaaccaccatagtaatgcttcttttgaagttgtattcagaggtcaattgtggaagcacaagaatagctctcctcttctgaaaattactggtgacagtttccatccttagagacaaatggtaagacagaagaataaagtttaaagaatttcgggaattcaatcaggaggattcagggccagagatcaaggaaaaggattcacattgaactgggaaagcagtaaacggcatgagatgaaggagttggtagtatgcctgataatgcttaagaaaggagaaaatgattacagtatggagaaacagagccttcttctagggtatcttcccatgactttgagctcttatcttagttagaagcttggaggctataatatctggatgtcatctgttttccacactcagtagaaatgttgggggaagaggatttggtgaactggggtaaagataaaaatgagcagtggaagtctggggaagtattaagacatttccattccaactgaaaccttatgtctatcacctctccctccactgaggactctacctggtgacttgtattgggaatagttaagatgcctggaaaatgcagtggatcttgaaatgataatttcaaacatttaatagggtagctcaaacatcaaacaacaatgaaaataaataggaatgtggaagtcaagcaacggaagatcttgccacatgcaaccagtatagccatttgcacaataagaatcacattaaattggattaagcaatctgtgagaatctccttaggataatatttttacataacaagggaatcaacaaagcagattttataactgatgtcatgtaataaaatatgaaacccactcttaaaggttatgattctattggtacagttaagtataaatctgctggagatagtaaggtagtaagattaataagtaacaaacacatgttctgctataaaggtcacttttgatttaatgagaaatacaaatttgccgaaaatatgtcttccttctttaggaggggatggtggtactaaaatttaataaaatagggtaaaaaaatgtcaaaatatcaatcagaaaacctaaggtgaactgaaagcagttactgtggagtacagtatctactatgagatttcttttaggtaacttttttatgtcgtccaacctcaattatcaattttcctcaaaattacaattcgaaaataccaaaagaaaaaataataactgtttttgggatccacgaggacattattaaagagtattttggagttatatttgctgccaatatcatgtactgaatgttcagagaaatattttctgctctgcgtttaaaaatgacaaataactatgaaagacatgttactagacatggaggagataatcaaaagaccaaaatacatgtaatcactgttccagaaggagaggggaaagagaatggacaaaagactcacaattctacataattgattaattagacaaatcctaatatcaggaagcccagtgaatccaaagcaagaataataaaaagaaacccttaccaagacagacagacacatgagcaagaaataattgaaaatgcaaggaaagagatctttaaaacagtcaggaagaatgaaacagtagttagaaataaatgataactagatttacaactaacttttcaacacttacaatggaagctagagggcaatgggataatatctccaaaatataagagacaacagctgttctattacaattgctatacccagtggaaaaaaaaattcaaaatgaggttaaaataaagctatttcaaacaattaaaaaatgaaagaatgtactaacaaaagaccttcacgaatgaaacatctaaataatgtatataaaacaaaggaaaataatcacagaaaaaaacgtctaagatgaaagaagaaaagtaaaaccatggcaaacatctcagtaaatctaaagaaagccttactttgtaaaaatattaacagtgtttaatttatagagttcatacaacaaaagtcaaagccaccaacaacatgtcattccaaaaagatcatgaaaggaattgaaacattcaaaggtccttttattgtctgagaggaaaatattagttaacattagatgttgtaacctcagctattcatgttttatatttaatgatttcaaggtagaggtagaaaagtatatcttaaacaggatattaaaatacaaactataaagggaaatactgataatttaactatatcaaattttagaactccattcaccaaaatataccataaaaagactgaaaattccagtcacatactagaagaataaacataacaaaatataatgaattctaagcatcaataaagaaatgataaataatctaataggaaaaaaatggactaaaaatgtgaacagatatttcacagaaggggaaacacaaataacccagaaacatatgaagacatgtacaacatcattagtaatcaggagaattcaaattaaatcacaatgaaataccattgtacaatcaccgcactggcaaaaaatttaaaagtttagatgagaacacagagcaataggaagtcatcatcccccagtggacagcaggtgaatggtaagtaattttactaggaacgttacatgtgcatcctgtatgcattatatgtactgcaacaatactgctcctgagtctatgccctagagaaattcttgtgcatgatccagagtcacatgaaacagggttcaaggagcactgtttgtaagagcaaacactcaaaaccacccaaatatccatgagcatagagtgggttacaatattgtgattttttttcactcagtagaatgatacacagtggtaagaatgattaaattaaatgctataataaaccccaaacaagtttgacagacaaaaatgaaggaataaaactactattattccatttatataaaattcaaaaacaggcaaaagtaaacagtatatcatttactgatacatgcatatatgataaaactattttaaaaagtaagaagattataaacacaaaattcagaaggtagctagctatctcaggataaataagaggggcatacacagtgcttcagataggtactgctgtatttatgtcatgtgctggccacaaagtttttcaatttttaattacattttagtagacacacatgaattatataagttttaaaggtaaattattatcacaataaagaaatatttaatattgttaattgcagtttaataaacataataagtttaaattaagaagaaaagcttttcttttaaactaaatgtttaaaatttgggatttttattaaaaaatcacatttaaagaaacatggcaaaactggagtttaaatgggggttcttttctgagtcatatatttgcatagtgtcagtggaataataatgactctagttattctgactgaaagttgaaaatgtttgtttgtttaattattttagtttgtacttcatttttatagcattccctcacattaattatatattgtagttgcattatgcaaaatgaaaacaaataaagttagaaatactatgcttcataaaacgtagcataaagttacactggctgatactcacagtcatttgtatagccattgccttgaaatatactgatcacaagctcctttatctccaaaatgtctgaatgctgttaacatgagaaaaagacacctgactaacttgactgacctgcagcaaaattatttgttttcatcgaaaaggaaggtgccctcctctctgttactcacttttttcctttctgaactaatttctgagaaaattactcaattaatagcactaatttataaaattaattgtgtaatttgcctagattccaggcattcattagctctcatggaagcacctgtgtggagaaaactatcaggactctttggaaagaagacagtggcagacagtggcagacagtggcagacagtggcaccgtagcacctcaaataatgcaacaaagacccctacgcgagcttgcatcctgtcaaagaagctgttttctgctctattgaaatctttggcttcaagcactaacctcctctcatattcctttgtcccttaagctccaacttcactatgcaatcgtcctctctattcttgcctcctccagttctaactcaagtttcagtcttattagaaataggacatgctcactttggcaagacatggctccttttttacccagagggtaaagcactatagcaacaagaggtacacaggtaaaggacagtgttatcgaaacctaacatttccctaactatgcccaccctcactcctcatcagtgagcttctcctgtaacctggaccattccaaacactaacaatgactgagaagcaaaaagtttccacagccttctaacatcatcaattcaagtgcctaacaattctaatgagaagggtcttgaatgataatatttaaagctattttttcttattttatcagataaataatcaattttttaaaaaggtattcatttattcttatacctcaatcatatatatatatatatatatatatatatatatatatatatatatagtatatgattagcatcaggttagtctgggagtaggaatgggtttgtttgattaagaaataaaaaataagcatagtatcttactataaaaatgttatacttagaagagaatgtatacatttaaagagaattaaaatgaaaatgttttcatttctatatgttaatataatacagtgccaaacgatttggcaatggcattaagtgacacagaagttcaaagcacagacaaataccaatgtgagcaggagtcataaaggcttccaagaggaactagaaagagagctaggatttagggaattgatgaatggacaggagctaaaaacacagaggggaaggaggagggtatttctggcattggaaatcgaatatgaaattcagctcaagcatgtgaagataagtaggggctatgaccgtgaggtatggagggggctgatgccagtagctgctctgatgagaatatgaagagaagtaccacaaacactttgaagtctggctgtttcattcattgaactattggaatgtgcattgaatgccatctgattcaacagcaatggtttgtactcttctatcctctgataatttgctggcagcacacaccttctgtcatgccaaattactgcagcctgaaagttgtgtaggaaaatctgtggtggcaaattaagtccttgccatcctgaaagaatccaggcattcaggattgattattaacaactggaaagctgaggaagcaaagagaaaatcatcaccgtctacagccaaagtcccaaagccagtaaccatatagatattaacattaggtagcctcactggaacaaaagcattctttggtctctaaccacatataattcagagagatagcacagtatgcagaaaaaccagactaagtatcctggaatgcatgactctacaccaaagcgatatataaagtatccagagatacctagtatgacactgtcactggtccaacacattgtctgtattcctaaatctaagaaatcatagaactaacagggattatgttgttgaatgcagtatgtcccattagaacaaggagtgaagtgatattcactcactgggagaaataaactgcagttcgtgtctaagatatagaaagattcaccttttccatcctatggaccagtaacataatgtatacctttgaactttaaagagtttaaacagtgcatagctttataaatttgtagtgagaatcagggagacataaagttacaaaatgaacatttttttttcctaagtagcagtacttttcgagaaacggaaggtattgaatattcactaccttttaaaagatagcaaatgagagaggcaaggtgctttttgtttggttttgttttaaattggggaaaatgacaaaaattagcagttattaacttcacttttcattagatttaatactatcttccattctacaatattgtataatatcccattctacattgcactccattctaataataataaaataataaaacaattaaccagaagtagctaactagtatctatgaaaatacttacatgccagatatgacattaaatgatctagaaacattatctcatttaatttttatatttactgtaatatgtattatctgcccattttgtagatgagaattagctgagttatcattgatgcttagattagcaaagtggtctacctgtgatcacagacgtaaaaaattacaacatcaaaaaaaaaaaaaaaaaacagtctgtcatgtgcacttcaagcctgaaatggattaaatctagggactaaacacctactacctggtcagatgttacaatcaaagaaggttcctggagacaagggctaactagaaggttaacacaaggaccacgaaggccaattcctttttatcaccttagctatgtaaccgtaggagttgcctcaaaacaatcatttataaaggtgagaacaaacaacaacaacaaaaacccagaaacctccaaatacttcgtgattggaagagtgctgttgtggggtatgagcaagctggttgcatttaataatctgaccatcaagaaccattctgttcacttctgtattaattacagtaaaatgtgtgtaatatatctgatccctagaagatacctttttaaaagtatgcaaacacattttaaacaaggaattgacaacaatgatttcttagacaaggaatttttcaggtgataactgttttagaatgatgctactctgtaagtatgaaagttctctaatctatcactagattggctaactaatgaggatgagtagagacagaatatgaatttaaatacgcattcattccttgccttcaccaagatttatttgtaaatcaatgttattttattttcccattagttatatttgaagtaattcattccaaatatagaaaataattaattcttgaaaaattaaattcaaaagctacaatttaaaaattaagtttcatggagttaagtattaaaagacattagtcctaaacacagtctattccttgacaccagtgttttctctgtaagccattctgtataataagccgactaacattctaacacctactctaaaatgatgatctctctcctaactgtaaaataattctagtattatttttcattattaactatgattttgaaaagttgaaatgatttagttgtatgacagtatatattagaatttagtggaatgtaagcataaaaaactatttaacaacgttcttctaagagtcagctcataggtcatatccttcataaaacttatcggaagctttcttccacccaattaacaaatccctgaggggtcaactgtaccctatatggttgttcagagtctgtcattccttgagtaatacattataatagtagctctaaaactttaacatacagcagaatcttctggagtgctggttaaactacaaattgcagagcctcacagtcagagttcctgatttatgaggtctgggtggaacaaaataatttgcatttctgtacaatcctaaggtgaagctgatgctgtcagtctggggaccacattttgagaaccactgctttcagagtgtttcattttcaaaaagtctgcctcccactatgagactagaaccactaaagagcagatatggtgcctagcatgttctaggcactcaatacatatttctgaatgaaagaatgcagaggcccctgcaatgtttggaggagaaccaaatgaaaaatgagaagactgacaacgcaagtttcgggaaataaactatatatatatatatatatataacttagcagattcaaattttatttaaaccactgtgaagtcaatactctgaccttacaaatggttcagtgaaaatcttttgatgtaaagaaaaatgcgaagagtttgaaattaatacttggtctaggttcctctaagtccttttccaaaatatgcctatgtgtatctgttcattaagcaaacatttactgaatatataccataagcaatcaagctagaaaacataggaaacgacaagttgaccaaagtattacttcattttaacaaaagtggatcaaacaagtattcatcatacaattctaggaaaggggggtaccaaccgccagaaacaagagatgttctagaaactcaaagtagttcactagtgaggattttgaggtaggtagcagatagggaatcacagaaagagctggaaaactacgtaaacatataaagctggcccgaggacgggaaggctttgaatgtaagactaaggaatttgaacttacttttgtaggggtgagaagaaagcaatacttagcaaaactaaacttcaggcagggtatatgcttgagtagaaggagactagaggcagaaggactagtgagaaagctactgaaatgttctccacagaggtcagagcgacctaaaccaggtggtagcattaggagtgaaacacacagaaggcaaaatcagcagttaggcaaccgattaaatgcatggcaagagagagaaaaatgaattaaatggaaaggttttgagccttaatgacccaataaatgaagatgccacttaaaagctaaagaagccaagatgatagagtcaatatacttaaagacaattaatcataaacttcagaagcactcacttgcaggaacttctatcagagccctgggttgggggaatcctagcagtgtgttcactttgccatatacatgtgtaaagtgtgtaagtcttttattttattttattttatttgtttatttatttgagacggagtctcgctctgtcgccaggttgaagtgcagtggcgcaatctcggctcattgcaagctccgcctcccgggttcacgccattctcctgcctcagcctcccgagtagctgggactgcaggcgcccgccatcgcgcccggctaagtgtgtaagtcatttctatcttgcctgcttaagcttctccttccactcctccaacatttccttagtcacactcacctcccaccagatggccctggagaggctgtggtcatttttatttaacttttggcattctttccttaattggaactccttgaattatattagctttaagccctgaaaaatctgaatctgaccctgcaagaatagtttctggttgtgaggaagctgtgctcagttgtattcttggactttgatgcactacccagaatttcaggtggaaaaagcccaccatgggtttaaaaatctagcagaacatttgggactggggaaatacatgaggatagttgatgaaattactcaagaagagaaaacagacagaggggagaagacctaacattaaatttctgtaccctgacatcaagaacaggaagaagaaactgagaaagaagaagaggatggaacaatcagaatggatgaaaacaacaataaaacaatgtagtccagtgacataaatgccaagggaagaatgaatcttaactaagtaaagatgtagactgttccctgtgctgaaaagaccagaaaagatgagtgctgatataaagccattcctatggattggtggtcactggaagggaagatatgaatagagggagaagtttgtcatgccccccaccaggtcccatggcggagctacaggacagtttttctaacctcccttagggggatggggactaaaatttgctgctgctctagtgacaagcagtttacatatccactggaatatcgtaagatggtaagctagtatgattgacattttacaaatgagaaaacgtgtccaaagtgacaccaccaaccagagctggaactcaaattccagattttcctaactccaagtctactgtcttattctcatggccaattttaatagcaatgtacctatctatcttcactattattaacagtattattcaaataattacctggaatttagaaacagaatagccttgtctaattttaggactgttttctgaggttccacttcaattagaaatgcacacattagaaaatgcacgctattgcttcagtaatattttatatgtttgtaaccctttatttaaaaattaatctgataacatttgtgaacatgttaaaaagctaaaatgtcagcactttacttttccttcttcacagtttctaatctgtagagcctaacaaaaaaatgattaacatttcaaaagaaaacaaggaaaaacctggtagaaatatatttagcagagaaagtttctaagtatgatctgttgtttgaatatattttttaaaaagaagttcaaagtaagcattttacttcttgcattcataaagtgtttatcagttttcatcaaaacaaagaaaataagacacgattttgtttttttcatttcatgggctgatttttcatattttaaaaatattttacgtttgtagtccaatattaatatttaacacatggattaatgtacatgtgctgaaagatgaattgaataaatgccaggaattattaacaagcaatttcaactaaaactataaaacaatttcagcaacaattaccttaagtgataaattttccttcaatttaagaaataattttatccctcagctgtttattgaaattattattttgtacttgctgtatctgaagacagcaaaagacttagcccatgtaaaagtagaaagtactttttcataagtattttaatttcttacgataacacttagctattaaataaaattgcgggctggcagctgtaggctcaggcatataatggaagagaaagatggaaataccaaaggggcaggtagtcatgagcaaggacctgaaactttgatatatttgaagttttcacctgcaaccttatcttcagtttggtagtaacactactatttagtgttacttgcttatagttgtttctatccattaacttgctttgttaccttttgctatgtatataattatattctatgtacataattatatagagttgatgctatcctaaacaatgctttaaagggtatattttgtaattcctaggctgttctttgctaagggacttcagctagagcacacctatggtgcaatttactgtgttgaaactaggcagaacatcaacaataaaatttggaacacaccttaggtatggctaaaattttttaaactgacaatactaagtgtaaacaaaaaaacagaaacactgtaattctcatatattatcagtggaagtttaaaatcatgcacccaccttgagaaactgtgggacaaagtctaacaaagttaaacaaaatcctgtttcctagcctttccacttttaatatatgctcaatagaaatgactattgtgtcccaactcatttaaaaatgcttataggtataatagccccaaactggaaacaaaccaaatgttcttccacatgagaataaataatcaaatcgtggtatatgcatacaatggaatatgactcagaaataaaaaataaccaaccaatgatacatacaacatggataaatttcaaaaatatgatgatccaaagaaaccagacacaaaacagaacattctttacaatcccatttatatcaacttcaggacagggaaaatcacttatgatgatagttatcagaatagcagctgggcagaggagaactgtgactaagacgtagcttgagagtcacttcctagaattacagaaatgccctgtgtatggatgtgggtagtaaacacatgtgggtatatataggttaaaattattccactgacttatacacttaaaaacttgcacaattgtattgtatttaaattatatttcattgttaaatagaagtcaaaaccaaagaaaaccttcatcatgcttctttttcttttttcttctccctccctccctccttccctcccttccttcctttcctcctttctttctttttttttgttttgacagagtctcgctctttcacccgggctgaagtgcagtggaaaaatctcagctcactgcaacctctgcctcccacgttcaagggattctcctgcttcagcctcctgagtagctgggattacaggcatgagccaccttgcctggctaatttttgtatttttagtagagacagggtttcaccaggttggccaggctggtcgcgaactcctgacctcaagtaatctcccgccttggcctcccaaaatgctgggattacaggtgtgagccactgtgcccggccacttctttttcttacatggccacttatttttcttctttttcttatattttttatatgtgtattctgattttcctcgtaggattttttgcttgttgaaatgaagcagttaagatgtgactaatacaacagagagcatcttgaaaagaatgacatcatatagcaagcctgtccaatctgcagcctgcatatgacctagggtggctttgaatgtggcccaacacacattcgtaaacttccttaaaacatgagatatttttgtaattttttttgttttttttttagttcatcagttattgttagtgctagtgtattttatgtgtggcccaagacaattcttcttccaatgtggcccagggaagccaaaagcatggacacccctgtatagcatgagtaaacacctcagcaccaaggctagtaacagaagagatgaatgacttaataacatttaattccctcactctcccttctccaggctgcagcattctcaagaatgaattggaaacttcggttgggtgtggtggctcacacctataatcccagcactttgggaggccgaagtgggtgaatcacgaggtcaggagttcgagaccagcctggccaacagggtgaaacccatctttacgaaaaatacaaaaaaaaatagctggcatagtggtgggcacctgtaatcccagctactcaggaggccgaggcaggaaaatcgtttgaaaccaggaggcagaggttgcagtgagccgagatcgtgtcactgaactccagcccaggcaacagagtgagactccatctcaaaaacaaaaacaaaaaaagaattggaaacttttcatttcctactaattccgtcaccgctataaacttctgtcacctctcctaaattccaaaacctcactatgctagtaagagcctcatgcacttgactcctgacccagaactgcttggtcaaccttctaacacatcttgtctcttgttatttcaagcacagttatctgagtagatgctagctcaataccccctgcctgtggaaatatattaaatgcctccacatacagaatcatctccaaggggtagaagataagaaggctagaaaagaagttaacaatagagaaaaataccaatagattgattacaggaaaatattacattcctaaacattaatagcaccataaacaaaattaaaaggtatgtaattaactgagaaaaaaatgttagcaatatatataaaaatactaaaaagggctaacaacatcaataaagaattcttgcaaatcaatgtgaataaaaggaacacatcactaggtaatgcaaggtaatgaacagataatttggtgaaatacaattggcaaatccacatgtgaagatgttcaaacgcagtagaagttaaaacagtgtaaaacagttaaaacgatgagggtttttttttcttataaaatgataaggactgaaaataataattgcaatctgggaggcccattgtgctggatagtacaggaggtagtataaagaaacatacagaggaggagaactcagtttggcagtgagtattaaaaatctaaaaataactataccttctaactcatttccacacttcgtacacaatacaaatatttagattaaactatcatatataacagtagtgtgtgtgtgtgtgtgtgtgtgtgtgtgtgtgtgtgtgtatatatatatatatatatatatatatatatatatatatatatatatatatatatatttttttttttcccccccgagacggagtctcactctgtcacccaggctacagtgcggtggagcaacctcggctcactgcaacctccacctcccaggttcgaatgattctccagcctcagtctcccgagtagctaggaatataggcatgtgccaccatgcccggctaatttttttaattttaatagagacagggtttcactatgttggccaggctggtcttgaaatcctgacctcgtgacccacccgcctcggcctccaaaagtgctgggattacaggcgtgagccactgcacccggccagtgtttataaaatttttaatggaaaaaaatctatctgtccaatatcaaaaagattggtaaaataagtgcagtctagatgatatgccacgtatctctaaatatttatattatagaaggaaattaatatcaacaaaagatgtgtatgatgccatattagtttttttaaaaaggttgcaatacagtctgcacagtaggcttctatttttttttaaatgattaaatacataaaggcaaactactaaaaggaatataccaaaattttaatagtgattttctttagatacgattctggatattctattttcgttctcaaacttctgttttccaaatcttctatagcgataattataatcactaataaccaatgttatcgaaaatttccatgatctctaaatgccttaaagagttcgacagaaagaatttaaaaacataggctctcctttttcttctttcattagtgatgatgggctattaaaacaaggccacgtccttttgctttaacctcccatccccagggatttcacattagaatgtccttcctcccaatacctactcctaaccttccccaacccagaagttagtttctctccattaaaaaaatccccacagtagtataaattaagcaaggaaccattttaaactgtcagcttaatggtgcacacaggaaatatggctgctctcagtgcaagaaaattttaatgaataaagtagcttaagaaaaagatattttccaactataagtggaaaacttgttcagtttctcagaggttgtttactgccataggaattacctatttaaacttcttcacaacgttatcacttggatatggttaggttattctgcgtgtgggcgactcattaataaagctgaaggaaaagcaggacagtgctaggaaagaaatctagagctggacatttaatattcttgtgtgtcagagactacatttgtaatattaggggtgggaagtagttacttgctaaaatcccactttatactccgtttctgattctaggggtgtttttgtcatccatacaaagtcaaaaagaatgcaaaattataacccaataataatgtcattttttaaagaaaagtatagatgattcaagaccaagaaagaggcagttcataaaagatttaatgttgaaaaaccacaaacataaaaggaggctaaaattggaaaagacattataaaatctaaaactttaaaaatttgatatgataaaatatatgctggaaataatatgcaagaaagctgcatcaaagctttcttggtcaaaggaaaaagtgttaactattaagagattttttaccttaaaaaatacaaagaaacaacttagtttgcattatagactaaaataatcttttcaaaggatattgagaatagaggaccaaagagtgtttttatggaaggacaaaaggagaatgcagagtgagatttaaaagttgtgtgtgtgcatgcatataaccctcaaaagtataactccacaccaaaaacaaagaagtagctgtatctagggatgttctattccatcaaaactatgtctgtgaagctttaaagggaatcttcttgcagtctacttcctatatgaatactctctatgtataacagttcattctaagagaagagcaatagatttaaccacttgttagtatccttgttagcagtatatcaacagcaattgatcactaatgtgaaggtatcaggttttaggtaacttccaacaccattctccttgtgttcaagtgattttcctgcatcctctgaatagaaaccatcactgctaagaattgctccttagacagtacctgctggaggcttgcaaagatcttaggtaaaaagtcgtaagttgaagatattagttgataatggcataaggtcttgttcctcaagcaattgtgctaggaccgtctacattataatctcttaaagtggatatttagaaatgcaaattcttgagccctacccccagattactcaatagaatctttaaaggtacaacctaggcatgtgcagtttcagtaaactccttaggtgattctgatacagtttaaattttaagaattaaaatttaattatatctgtttgtattacatctcttcaacatacagcaaattttaataaaagctatcgaggtactaagaaatgaattgtaaatggtgaaatcacaggcaatggaaggaatatttaggtgttgcaggcaatttattatagcttgaaaatcataccatgctaactgtagctagctttaaagtaagttctgactaacagactgaacatattattgcttctgtgtgagtagaagaggttatttagaaatctttctacaaacatttgagtatctatgaaaatttacttttgcacactgagatataacaaaaaccacactttctgtcctcaggaaatttaatccaggaaaattagagctctgttttgaaagcagaggaagttaatttaaaaaacacagactggatgtatcttaacatcacctcctaagctcactaatgatacctgaaagcattcaccttcacctagttggagagatctctgctgcaaggaaaatgttaaccatcttgccagctaggcatcattcttcatactataataagcaaaaggcatttccaaagtgagactctctttgtaaatttgtttgtcattcttgtgaagaatcagatgctgtaattattaagctttttacagaacatttcaattttccaattgctctttaataattcccagcaagtaattggacattttaattatatgtagcttcttgtcactgttcatctaaaaaacatcacaacattaaactaagatgctcagcctgagtgttttcttgggttgtatgcatattttttgagttatttcaacaatgatcaaaagccagtgagttcatccttcaaactggaatcctcatttcttttccaaaagacaaaaactaataagcaacaaaaaaattaaaccatcacactaacaaaatgtattaaaagtcaatcgataatactggccatcacaccaacaacctctacctttattttattttcccataaagagccactaatccattttgtttttttctactagcttagcaagtccatatggactggaccctttcagtgtttctttcccagaatccctgcagaatcattgatctccttgatctactcatctctttgatcttttgaggatagtctacaaatagcctgtgctcccctacgtgggtggcaatagcagccctggagccttcaaaccagcttatggggttatagtcccagctctgccagttacaaacatgcgactaagtcaggccaattaaagtgaccgggctgcaacgttgccctacctgcaaaatggggcaaaaatcttccatatttaatttacaggcttgtgcagatttcatatgaaataaaaagagaagccactgtgtaaaccttgaaatctctacaaatgtgaaaatgaaaatgaaccaaacatctccccaatattagcatgacatctatcaggctcctatagaaatcagtaatgaaggaggatgtgtgcccacccagccatgccatggtacaaatggggcctctggtgtgtcagaaaagcaactggaaaatggaaaagagatggttcccatctttcctgtgtctgttctaggacactgcgagtcctcccgaaggtgtctgaaagaacacaaggcaggcatgttaagtgtgaaagacagcagaatggatttgacggcctctattaggcctgaggtcttttggcagagagtgagagaatgtcctattccaagcagaaggcacctgataagcacttgattgattggtctctgcattcttggcactcagtgaaacactgatttgccagcagagtgtgtaaacacccacattttggtaataacctaaatatctgcatattgtgaatgaggaggctgactgaatgaaattgtgtaaaaacagaaagtcaactccctgcaagtcttgccttcaccattctctttgcagatgcaggacttttaacagtgaggatattaggacatccacaagtgaaggatggagccctgccctgctctttgggagctttttgcctgtgtgtgtgtgtctggccctcattcaaggatatgctcctctctggcaactcccagccaatgtctagagagcacagcactgtgttttccaacttaactaagaattaggtctctttgctactgcctttccttaagaccaggaccaaatatatatatatatatatatgtatgtagatattgtttaacgggcctcacgtctaggcaaaatacacacacatacatacacacacgtacatacaaagtcattcattcaatagtaagctgcatttgtctggaattactaacaaaaattgaattagcaattattgcactgttgttttcttttaaaagcacaagttaaagtagtgttttctgctcatgcttaataagattgcctttctctctatttaccacatacccatctttcagagcttctctaaaagcctatgtctttcttgaagcttttactgattcccttgctggaaaatgtatctctgatttctaaatacctacactgccctagcacagattgctaagtcatgttctttggaggtcctatttcccaaatggcaggcactccatcacaagggtctccaaaattctccaaaacactagggaatgtatgaatatgtgaggtgggaccgatattcatattggctccagaggagccaggcaatgctttctccagggatacttttcactattatctgttatctagaaaatcgccttcattttaagatatttagaagaaaatccaagttatgtggtttcatagattaaacttattgctggcacttacataccactaaaagttaaccttggaggaggggcgatacagactataactttaatcatatcagcttcttgtcttaaccacatcttgctttgactgaactactctgatcctaaggactcctgactgttgatatcacagcttaaaggctttcttcagactccgggagagaaagtggtgggacactctgtaaagtgattcagttccaaagtatatatatcatcccaggtgatcatagagcttaaataaagttgcttcaaactagcatgaaattttgtctaatacacagtccccaaaagaacctctttagaaagaggatgaaaacatttaaacatggatgttaagttcctattaaaacactcatttattttaagaaattcgctagttatgttttaaaaattgataattaaattacagttgctgagcattttcctttgacttggtattttgaaatgcttgtgttctgtctaaatgctagattcttagcatttggctaaggtatacgcatcaaaatggccacagtaaaggaagtgacattagtaattctgggctaggaagcactgtttctcttaccgaaatctctcgcaactgtaatccagccaggtaaagatagctttgtgtttgctgacattttcagagttgattgggcaaaaaaggtgcaatcattttcctaagtttttcctcgtcatctttaccctctccccaccaccccctgccgttattttcaaaaggcttaatctaaattctaaaggaatgttctaagagagcgaggaaaaaaatattcaacactaaactgcagcaatagccttgacagttcagttctgctgcaggtgtcctggtttaactcccacatggacaaaggggatacaaattgttgggttactacacaatatcctcttgttaacatcgtgttgtcctcttttggaagaatcagacaccaggaaaggatctcaatttcaaccctttgtcttttacttaaagaatctaccaaatcagtctagaatgataagaatgaaatgtgttttaaaaagctcagaggagtctaccttatatctaacctcagtcctttctgttttttttttttttccagagcagaaaagacccactgttggagaggggttcatctgtcacttgaggggcagcagcaatttatcagttcctgtgccagatgtttacataatatcaagtcttcacaacagtcctacagaggccctatttcactccaggcaaaaccaaggctcagaggcttaggaactgcccaaggtcagatagttagtagacgcaatgagaattataagagtaatcctttatgtcacaagggaattccagaattcctgtaatgttattttaagtggaatgtgtgaaatgccagtaaataaacaacaacaattctggtgttaaattgaagaaacaaaagaatctttaagaacaatgtagttaagagactcaaactagaaagaatttaccatcctttctgaatgttgctccaacttatagtctaatataaaaactcataagaaatgagtagtagagatgcttaaattctctatctagtctacaataccatgcatctagaaacgacacaatttgatttttaaaatcttcaaggcttcataattaagagaccataattaaaattagaatactcaaataagtttattaattgtcagtcttttctctatatcctgccttcagaattatacgattttatttaaccatttgcaggattcctttcatctcaggagagtataatcatataatcagactcatcaccactgttcccttttaattgtaaatcatgactgcgcttgcaaattagtctattatcacagcagattatcaatttggtagggaaagtatttgccatctagaatgaaagtagttaataaacattaataaacatcttaaatcaatcactcctttactcttggtgtgccgacagatgtcatttgagattaataaatcagtcagaacaaataaagtgatgaggaagcgaagcacaaggaagcctctcgatgccctgtgtacttaagaatcacaatgcctaaaaactaattggaagataaagataaggcattaaaccttcagagaaatgacttgttggaaattagacaaagtaaatccagatagccattctctgtgggtctgttatgaaccactggcaataaaagctagaggagaaacaaaatgctcagtcagaataaattatgtttattgacagcataatgtagaggttaaaagcatggactttcttttttctttttctttttttttttttttttgagacggagtttagctcttgttgcccaggctggagtgtgcaatggcttgatctcggctcactgcaacctctgcctcccaggttcaagcgattcttctgcctgaccctcctgagtagctgggattacaggcaaaggccaccatgcccagctaattttgtatttttagtacggatggggtttctctatgttggtcaggctggtctcgaactcccgacctcaaatgatctgctcgcctcagcctcccaaagtgctgggactacaggcgtgagccaccgcacctggccaaaagcatggactttctaattggcctgcttgggtttgaatccagggcccacaacttccgtttcagtgacttaactatttcttaattttgctgtgcctcaatatccttatgggtaaaatgggagagtaaagtacctatctcataaagttgttgtaaggattaaatgaatcaatattttgttaagagtttaaaacagcacctggcatataacaagcactgagtgattgttcaataactaaatgatataattggccatttactaccattttatgtgctctagttctttctctgcacaggcttttatgagggagaattggggttgtgaagtaatcccacaatattttaatcacttcctcactataagccaagagttgaattaattcattttgtaaaaataattaaaatttaattaattctattaaaaagaaaaaaacacaaatttttcatttaaaaataagattactgaggcaaaatgttaacagtacaaatagactgttgttgtatagtccagtcattaattaaaggcatccagatatcaataccttgtgtattaacacaagacttttgtataaagatgtttaccagaagcccatcaggagtgttccacttttagttatggcacaaaacgttatccactagcatcatcaacaactcctctatatctcacctaggactagtcccaagaaaaagaatgagtagggaaaccaaatacattatttgcatatttaacagcatgtccaattagccactttgctgacagagactaatttattattcatcttattccagcatatgttactactttgacatccacgtgacaaatgactgatacagcacattgtgattttgaaaatgttaactgtggacttcaagaaaatgtagcttagactattgaggaaagtttctctgcttcaccttcagaaatatggaatctagaaaatgatcaatttttctactatgtaggcacaaatggtccaatatgacataattttcagaaatgagtatgaaataaaaggaaataagctatcaaatggtgccctgaaaaccaaatagaaggttcaatctctacgtacatcctctaggcaaaaattctcagaggtatttaaattagacatgttccagtattatttctctatactagattgtaatatattttataattgaaaaggataactatacataaaatgatatagatgcatagataggaactaaatcattcattcaattaacaaagacagaatcttgaaaaatttgaaagccaagttcctcagaaaaaccacatacttctttcaaatgtgcttggatagttttatattagaaagagaaaaaaaaaaaaaagataaaacaatgtgttgctgcatgccccttcaaaatgtgctcatcggttactgtgagagtactgtgtcacggggctaccacacttttcctgaatgtattttttagaacagcatcacagtcaactcctagtgaagtactttatgctctgtaactatccacactttagatttttcagtcttaacataaaattaaaaatttcagaatctaaaattatctgttttaagtagcattaaaaataccacttctctttaagcagctctgaaacctgaagtcatctagaaaaatatgccatgatgaccaaatggtaactaattgccaagacagactaaaccacataaataattacatgtaccatcgttagtccaatggcaacccagataatcaaaaaaaccatgattatcatggcatcatggcagaagtgttgtccaaataagtaaatttcactgccttgtattttaccacatattaaaaagcactcttttacaatctgttaattttttttctttctttatagttgctgattttcagagatatatcataatgcttttaccaattttaattatttgacaaacaagtcaccaaatatatacaggaacatttaaaagttcacaaccttggtttaaaaaatgtaggtcacattatgcaatacatttaaactggggatctcagagcccaaagggttctatattctgaatttcacaacaaaaatgactacaagattcaaagaaagttcatagaaaacaacatatacataaccacataccttgaaaatacactggagaaacacctttctatactgcctcagttaaaattcacaaatctcaccgatattaagttcccacaattaatgcagcaggttcttcttatctacttgtatatttagtgattaaaaggaagtctgtacaggaatcatcatcttctagtgttaaagctttttagtatagtggttactatttaataaataacattccttatcactacctgagcataacccttcaagtcaaatttgagaacagtcctcatttattaatccatctccatcttcctacttactgactaagtaccacaaggtaatattagataaaattccttccactgaaatgcagacataaatttcacatctatattgacttgaaattcttaataactatgagttagctactcttttgtggctaattttattgttaatgaagaacattttttgagacatgaattggaaagtaccaatgctgggacaaatttcaggtcttctaatttaaatccagtgggttttgtttgttagtcttttccaaaaccctgccttttatattgtcatggaaaagcaaatgtacagtggctatatattaattaggtgaacctgacataatcatcacctctttaaatttgtttccttgtcagcaaaatgatgatcataagccctgccgtggttgtgatgatgattaaatgagacactttatatgaaggcactgtggaaatatatacttaaaagatagctgttttcactcagttctgtcaaaagcttgagggaatgcattgttatgtgatcaacactgaacaatcttgtattttgtgagagaatggaatattttaaaaggccattacaagcttctatgtggagagatattctacaccctacatagaccagaaagggctgggcaaaaagaccaaatgaaagaagcgggtgcttttctaagaggaaatccttgagacctcagttgcgagacaagtactaggccaaatgcaccttgagcctgaccaccacgccatggctcctgtgcacctaagtaagccactcccagaataatcatgaggacaattagatggcttaagggacctgaatataatctttgcaaaaatatctccagttacaatatgtttagaatcaatacgtccctgggaaaagacaacaagaccatgaggattttaagaaatccttatgatcaaaggaaacttagaattggaaatgatcttagaggtctgctagtccaatttaaaaaaaagagagagagaaacagagaaaaacgaaacaagaatatgaatgacaaaacagtataaaaagtcatgctcattattattgagattgttaacatctcaaaacataaattgtgtttttttctttaaaagaggcacacactgtagcataaatgagtcatcgagggctgactgtggtgatggtcaacagtaaaggaaagctggttttctctgtatgaaccaagtttggttgctctattctcttctcaaagaccaagcctctaatcccagttaattgtctaaaaaggactgcttttggtcatacagtatacaggtgagagtgtagatgaattagtgcaggctttcccttctattggagtacaggctttatggaagagtattccataggaggaggaagatgagttagaagatatgggtcctgcctccatctctgctgctgatttgctgtgaccctatgagtgtagttcacttaaattatttagatctctgttgtcacatctgtaaaatgaaaggaatatactcctcaaactttagaactgaaagaaatgatgttcaaagtggtaactgaattccataagtcactgagttaataactggctgaactgggacaggaactcaggtcttctgattttaaggtctagatttcccctacatgtgctctaaagtctcttttaagtatttcttaaaaaaaaaaaaaaatcattgggaacctactatagtctgggcacttttcaaattcatggtctcatttattcttcacttattgtattttcattttataaatggagaaaacattcttagtaaagataagcagcttcgtacatttacacagtgctagtaaatggcaatggccaaatttttacacagatatgtttctgagaagtatttagtcagaccagtctgcattaattattcattattagtgtaaatttaaatcactgaattcctatcttaactacatttacaaaacaagacttatatctgttcgaaaagtagaaattgttatgttttgttagaaaaaatatatgcagcaacttggtggaaaacaactgtataaagagctctttctagaacattaataatgaagggcaatagaaagtggtgtagataaaatttactattttgatgtttttatcagatcatttcatggtgagtcccagatgattgctacatatacataaactttatgttttttgcatttatgcttggaaactatgtatttttaaggaaaaaattgaatttgcctctttaaggattaactctttccaacaatagcttggatttttagaactaagttgtaaacttcttgatggttctgcctccgatatcttgcctcctccaacctcaactctactctcatccttattattctctggtcctccatggtacctggtacacaaatacaaacacatgctcatagtaggaatttatgatatatttagtgaataaatgaatgcatgaatgaacaatctaagaaataaatctattaaagttttgggcaaccaaaaaattattctaaagtgccagggttacttggatcatcattgattcaaagattcttccaaaaatagtagctggccatcttgttgaaaacagcatttaagtgatataacattttgtccaagaatccaaagtaaggaaaaggtgtggaacaccagtgtctgtttcagcagaacagtcatagccaaaaacattctgggtcacacatatgaattcattaccagctaattaatattaaacattaaagctaaatatttccccaatgtagagaatattgtcaaaggttttgctagctctcttggttgccacacaaaagagtaaagggattactctatgaaacattaacctcctgcctcctggaaaaacagagaaacaaaaacctcctcagcagaatcaatgaagtaatctgcaggactccagtgaggtaccaacagctttctaacagtgtgcattattgttaaaacatgcttgaagcaaaacgctggaccatgtatcttgtaattatttcttaagagatcaaccattaaacggcatagaggaccctcttagtttaagtttaagtttaaaaacctctgagctcatagaattgctctgggctatgggccataggccttgattctaattcctctttgactctgatcagacatctggctccgtcttttggcccatttatggtatgcctcagtatccctacaggaaaatcacattcaaactcactctgaaacctacctatcctcttagaagtttggtatgtgtactgaaagtgtctcagaaacagaaacattataaattcaagatataattattatccttatataacaccattaagcaacttcaattacaaaccacacttttaaaatctgttaacacttccttctgggaaagcccttttgccctttaatagtgtaagctaatcatggcaatataatttccagagctcatatttgtgggaggagaaaggatggcactggtggctttctccttcctttatctcctgaaattattgagagactctaagctaattttctaaagtatgcagaggcacttaggaaagccgggagctgagatgggaacctaagcatttcactgacatcattccatgctccccacatatggcacatcacataagcagtactggctgagcacactggtctattctggactcttgttggcgttaagtagcattcttaattacaagcaggcttgctttttgtcatttacagtcacacagttctccctctatttaactagaaaaaaaaaacacaatttttctatggaggtagtttcaccatttatgtttttgagccaatgcaaaatataaaaggaccctgcagtgttctcaaaacctgcttctcacaggcccttaaaaaaaatcctcatcataatctctgcaactgggtcagcttgcacaaagatactcgggtagccatgagcgctctctgcgccctgcaaaccttgtaagtgacacctcataatagtgcaaatgaagcatggcaagatgagaaaatgaagaagaatgaacctggatagtcagcccagcagctttcaaaacataggggactcaattttattccttaaactataccataaatgaatttttattttacacattcaagcatatacatgcattctctattatgaaagaaaatgtcttacgattcacagaaattctaatacaaccaaacagcctagttcatttgttcatctagccaaataaatttgcaatagtctcagattttgaactaaacctcattttcacttgtcttgactttcagctatgaatttatcatattgtcattaacgtttgtgctttcctttcaccctcatctattaggctcaagggttctttacttgtgggtcctttgtcccaacaactagcgaaatattcagagagctattgacccaacaaattcaacatcacctctttcttattaggtttctctttaagccatcaccctgcctgccgtgttctcagtccctctgcactcacacctcaccccatttctccatcccccaccctgagaggcttattttttatcctaatgttccttgattgttctctataaagttaatattattttcaaaagagagaaaggatgaagtatgagaaattcacacctggcttttatttggcaggggttggttactgacatgtaagtttgcgcctctgattgaaaaaaacaaagaatcagaagaggagcagcctcttccaaaagagtaagcatgaaggagagtgggcagaaatccaaaaatacacaaacacgaccatacaacagaaccttcgaaggaaacagaaagttctttgacccaaaagaataataccaaccactatacacacaacaattttctctactatcctattctttctctttttcgatgacagacacctctgatttttcattcacatgcagagacaatcactgtattctggagggaaagaaatgtttgtaaaggccagcagacggcgcctgactggggcagaagcttgcagcggagaggaaaaaggagtgccccactctgcggcagggccccttggtcttctcctctcccacgtccccagcagccttatccctctggagagaggccgagacacagaaaaggagaagttgcatatgagattattagccaagtgcttcccactggcacaattaggtgttccacctgctccatacacccatctgcctcaccacacccacctacccacactctgcccttcctgcaccctggcttgcctccgtccctcaggactcacacaattctgcacaaaggcagggcagtggttgagaactgcacccaggtaaagggaacaacaagctcctagaatactgtgggcttgtggtgagatcaccagaaactccttattctttcagagagatctaatctctgttacttataaaaataatccctagcttgggacatcactctcgtctccatactagacactcttaactggagagaatttctgggagagaactaggagaaggagaaaggaacaaattcctagaacccacagggatgtgttttttctagtatgctcccaaagagggcttgctaggggacttggtctctcttcagttagattatgctatagtttttcatatctaaccagaattgtccccaggtgggaaacccccaccccaccctgcatccatggaataaagggccatcctggtagcaccagcagctgctcagggcagagcaaactcataaggagtggggcaaaggattctgagctgaaacaagtctgaaaggtgacgggtcctgcaagaaagaggtggaaaatggatataaaaaaagtgcccacaactttcactctgctttctaaacaagtgcattttacaccggggtagaataaaaattgggagtggggaacgactcacaaaaacagattgatgttttaatttttggcaattcggggaatctggaatagatatttatctgaaaattagaggaatctggcctcacagtgctggtcactctggaggagaaagctgccaaccaaggcttttctctacactctgctgttttcaaagggacagggcattaggagaatagtttcccttagctctaacttcttctccaggcagacctccgggcttagcccagccagcattgactgacttgcccttcctggaaagcattaatcactgaaggaggaagtaagacctccctggttccaatagccttcacacgtgatcctccgggagatgggtatgtgtagtcaagcctctctctgttccatttagaaaagaactcagcctaattaccaagaaaaagacatatatttatgtgcagagtggatggaaggggaatggtgtccagaggtcccctccatgcctgcgaagggctggcccgcattaaaggggatgactcggttgccctcctagcttttctaattaagggaaggcgtgggggcaaaagtaattggcctcctgttgagtgagtcccaggactgcttcgctgtcactgcagtctgggcgcactttggaggaatgtgcgggctggaatctctccctccccgccccccggggccagggaagatgggcaggaggtggggcagcatatacagcacagacaaaaggttctgcagagccctcttctctctggtgctcaggtcccttagctgagcgcggcgccccatccggccactgagtgaccttctggcaactgacgcccccttcccgcggggcccagccgcgcgaccagggctggtcctttagtaggtgtccacatctctctcccagtacctcgacaaggaacgcccctcccacccctcaccaccaacacccgcgacgccttcccccatcccctttctattgtcttcaaagagataagtggctcgcaccaagcacacccaaatgcacctcccttttgtcgagctcccatttctctgagccttaggagcccaggagcgagtgcagggtagaaagaggggagcgaggggataacccgcgagaacttggcatcgcagacccaccgtgtccgcctcgcaaggatgccggtgacctgtagattgcaataggcactgaatgatgcttgctgctgccatggaaatggtggatgtggtgcgctcccaaactggatgccccccacgccactcctaggaggccgctgagggtgagcgggactatccaaagcagggccaggcgcccccctgcgccgccgccgccgccgccgccgccgccgcccccgggcgagcccagctcggcgccgcaccggagcatcctctggtacatggcggggcgcccgccgaggggcagccgccgcgggaggcaaagtttggggcgcggggagaggagagggcgcaggggagcgggcggcgcggagtgggctgaggggccggccgcctcaccgcgccagggcacccatcctctccctccttcggacagtcttctcggggtcctggagtccgccgtgcctagcaccccaaacaatccgaaacatagccgaggcgaatgcagctggagaggggcttgtccggaaaggcagccccgggaacagcaagcgcggagcgggtggctgctcccagatttccagggctccaggttctcgagagatactcccaaagagtttcgggcgagagtgcgtgccggcgggtggggggccgagaaattgtttaaagctcctcctggaaggtcctcacttctacatgacagacatccaccgcgaatccactaggtaaatccatttagctttgtgtgcggggactagggaggccacttcgccggcccaacctcctttcaagacagaagcagaccccatggaatccaggcgccccttccctccattcagccccggccggctcgcccgctagcgccagcctcccccgggcagcgcgcggagcagcggcgcgcatcgcctgctcccgaggcaatctccgcgtccgccgcctcctgacacttacgcccggcgaggggttcagagggaagagtgcgcccttctgaaggaagtgggaatcgaacggcggaaaggcagctgagaagaagatgcagacgaaggagtaagggagagaaacagaaaaagaaaaagaaaaagaaaaaaag

SEQ ID NO: 2411 - DNA, 819134 bp, Homo sapiens
cgccattctcccgcctcagcctcccgagtagctgggactacaggcgccgccaccacgcctggctaatttttgtatttttagtagagacggggtttcaccgtgttagccaggatggtctcgatctcctgacctcgtgatccgcccgcctcggcctcccaaagtgctgggatgacaggcgtgagccaccgtgcccggcctggctctgtttttattagaaaaattctcaatcgtcgtcttttaagtgagtcaacctaataccttttaattttgtgcaaagttctctgttttaataacttttaatttagtgcatatatcatatactggagaattatcaatttatttgattcttttagcaatttatattttggtaattctgtgttaataatgtgatttgtatttggttacgcagttgccgataatcctgtggcattacagagtttgatttatgcggacgatccttggacttaaaaaggattactgaccatttaagaaagattaattaatgagtataacattgagtcctaactctgctaatgcttgtctaagctacacacagatacatgcacagacacacataccctcaaatctcataccaaaaatgaccaaattacaacaaaggggatagtatcctatcctgctaggccatcacattatggatcagcagtgtagagcaagtcttgtggggcctgatcttgctcttacaagctttgggatcttgggcaattcagtttccctaagctcagttccttatttatagtcagtgagatgaatcctatggtctcttaggttccttttatttcgtaattcaaaaagttgaagttagaggttaataattttgtattggtaagactgcaatagcagtcttcttcttataattaataaattaagaagttacagggaccaagggagaaaggtaaattcatttatagggataagacaataaaagggtacaattaatttatttggtcaccagtgttcttgttttcttgctgaattttatgggatgggaacagatctaggaaggaaggctcgtctgtacccttttgccctacctgacgtaaaactcaggactgacccatcctaaaatcattcatttagaaagaatccctcataaccatgttagctcaaggttatcttgtatctgatttctctcttcctgcataggttgcagactgaagagcattaaaatatctgttttcttagtggttttcctttctggatttgaataattcacttgattcttccaggctacttaaatgaaagagtgttatctaagaatgctaatcttagttccttttgtttgagattagagaaatcaatgcattatatttttagtctagatagtaagtcctgaatgccctttactctggccatttaaaaaactaaattattttcagttggctttcatattgtggggttagatattcatttgagatatgttttcttttttccttttccgttcctttagttaaaacgaaatcttaccctaaagtgggataataaggggaaagatccattgaatttgagtattgggcttagtttgcattaaatgctccttttgttcctgtttatgtattattttaagctcgtttttccaaatataccaacagcagatatcaaatgaccattacttcatactagaaggaatttttataaaccaggccaaagacttcactagatttctcaaactttgtttctaactctgaaatcctatgattttatgatttttaatatattagagtaaacctacaaaattgtaattttgtaggtgaacaatagttagacagtgtcggtttcatatgattcaacctacatatggaagcttagtcattgcattgtttaggaaaactatgtaactcatgtatgaaaatggtaatgtcaagcaacgaagcttattaagacactaacatcatttttaaaatttagttttgaatactagatattaaaaattatattttaaacgtttgtaaatccagtgagaataaaatgttctttgcatatcttatttcttttcacagggagttttttcctgtgttttatgagaaaaatcacaggcattacagtttgaaatcaatttcattgttttcattgcaattgctacatagctgttgaatatttgtagtaaggtttaatgactaatgaagtgcatgcttgattatatgccattagtaaaaatatatttttatggcaaagggcggtttgcagcatggcattgacaaaagcaatatgtaaatgtgttactccccttcaaaagaatgcaaatcagtataaacaaattttaaggaaaatatttaaaaataaacaattaaaataatggatatttattgtttgttacttattgagatgatatgaatatgtaaatagagcacttaggtctacttattttcagaggccagtgtactactaattagaaaagttgtagatatcataattactgtagtaaattaatttgtctttattgcttacattttattgcttggtattccaggcattggatagatagttacaatgctgacatcaagagtgttcccacgattatttctccgcttttctaatcatcaactcattatatgtcccttatcctcctgctacttattatcacttgccatttcactcattatttgctcctatctctctgtctttgctcattcaattctcttttctagggataccccttccttccagttcttacctgccaaagctgtgtttggcttctaatgtttagcttaatgtctgcatcttctgcaatgtctttcagatgtctgcagtcagaactctttactcaaggtcactaccgtcagcttgtctttccactggagctcatccagaacacattgctttgtgaccaaacacattctctctgtatctgcctcccaattagactgtgtacttctcttccccatgttccctcctttgacacaagtcatgctcttctaagcaatccaggcttgttcagttgaattattttctaaaattaaaacggtatgccagacaaggtaatacaagtctaggcttgatttttcctgagtgttgtgtttgcggtgggtgggccaattatttctgttccttttcaaaggatctcacttatcttcttgttttctgccccattggataaatcatctcatgtcatcatttatttaacttcaaacacaatttctaaatgttgaggaatacgagaacaaaaagagcatgtctgcatctgcatacatggtcttaggtattgggtgaaagaccatcaaaaacttatattagtactaggaagaacacaattattttaaaatacattaaatgcataataacttttaaaattaagggtcaggaagaaatctctaatagaaatcacaaaacgatagacattttctttgaccattcttgctttgcttctctaatgtatatttaatattaatataaataacagcagtaatgacaaccataatggccactaccatgtcatagaatgtactatatgcattcacgtgtttcatctgatttggtccacatatcataacatgaagttggtgaggctgaggctatatatgttattcagactcaagatagaaaggattcattaggaaagggttcatgagaaaaataagcttaaagcacaatgttttcttccaactttccatttcaggggtacatatgcaggatgtgcaggtttgttacataggtaaatgtgaagcagagacacttttttaacatcagttctccagtgagttcatagcagattacagggtcaaaatatatatgcatacaccatagtaagcaccatttaaacttgtagaagtaagaaaattgtccttgaatagtcagttcaatcttcctgtgctctattgagtgtatctatctgtggatacaaaatgaataaagatggatctggacatttcacccttccgcatatgggagtaaaacctataaggagactaataatatcatgcatcacaaattacttgctgcagttaaagaagttttattcagatcctcatgatctcacagggatccagtatcttgagagttgacgaactttccataaaaacactaatcacgtataacagttcagtcaaaatctactgatatagatattccaaagtatggcaggaatttagaacaaaagatggaaaatttgaaggctctgatctgtaacatttcttcttaaaatatttcagctgacttgcttagcctggtatgcagaatctggtgcaagctgagcacggtctaagttgcctcatcatctcagctctccatgcttctgtatttgtatacttccatacttagcaagtaactgttctccctccatggaatgtattattatcctctgccactgtcctcttaaacctggcaaatgcataactttcttttgagacctacctttgttaagacctagctctttgaagacttccctgattgtccaaggtaatgttgactttactttgtaactgtatgtatttttcttatgtcagcaaccactgctctgggttattactatatttttctctcccaaataagacaagaggttctgttagaagtggaaccttaatatccatttttatgtgatgaatttctaggcccatgtgtgggctgtattaaaggattaaagcaagcttgttcaacctgtggcccaggacagcttttattgtggcctgagacaaattcgtaaactttcttaaaacattatgagattgttttgtgatttttttttagctcaccagctatcattagtgtattttatgtatggcccaagacaactcttcttcccatgtggcccagggaagccaaaagactggacacccttgggtgaaagcttattagtaatgagtaaataaacaaaatggagtggatgaatagtgtagttcactatggacaagttaaataatgcttttctcaatgataagggcaaaatgaaaattctgagatttctacatgcattatccttgaaacctttagtattttacatgtagagaggtcattgttcagactcgcatttgatagagtaatcagtgttgaagacattcccaatggtgtaagttgccatacttctgcagtataggctggttgcccacaggaaaatattggagacaaagctgaaagcaatgtaaaaaccttgtgaaaaagcagaatgtatctttgaagaactgcacttaatatgttattcagcctaatttgtgcattttaagtaacatgttgatgagttgtacggtagttttcctttatccatagcccataccacaactccaagtagatgcctgcagatggtactgaacccttatatatactatgtttttcctgtgcatacatacctatgataaagtttaatttataaattaggcacagtaagaaattaataactattgataaaatagaacagttataacatcatactgtaataaaaaaaatctatgtaaatgtggtttctctctctgtgtgtctctctgtcatctcaaaatatcttattatactgtactcacctatttttggactgtgggtgaccacaggtaactgaagctgtggaaagcaaaaccatgaataagtggggactgctgtatgtgttgtagagctgtgctgtccagtctgtcagccactacttacatgtggctactgggaaatggaaatgtgtgcccaaagtgatatgtgctgtaagtgaaaaatgaacattaggtttcagaagataagtacaaaaaaaggaatatgaactatttcactattgtttctctgttgaaatgatattttgagtatattaggttacataaaatatattattaaacttaattttatccctatctctttactttttaactgttactgctagaaaatttcaaactgcatatgtgtcttgcattatatttccattggacagtcctggaaaggaaattatgattatccagagaataaagtcattaaataaaaggaaaggttaaataaagtatgacccgtcaggagagagacaaacaaggagagggaacagggtaagtcagccaagcatggaaacatgtggcgattgctcaagggcttgtgctctgaatctgaaaatgctgtaatggtctatgaaaatacttttagagctagtaaatgaaaataagtgcttatataacatataaacttaaaaaattcatgatatttaatgttcaataactatgagaaggcttaatcaacctactgtaatattttaattaaaaatcattctaacgtcaaataaacggagaaatactgtccgtcttccataatagatacaatggatggtttaatgttaaataccctgagaagtcttacagctaaaaatttatcactgtttcaaacagaattgttcccatatctggatgatagaactcactcctcctatgtatttaataatcagtattctatgagatatattttgggagatacttagtagaagataaagtcactgtattttattagggatgaaactgaggctagggagatccctaattcatttgagatctaatatgtgggcaaaatagacagattggtgcaatatccagcacagtttaacaaacactttccgagtagctactttgtgccagttattcattctggcaataagacgaataatacagccaggttggtgaatatcacaattcatagattctcaggtgattgttctcatgttttcagaaaaaggcaatgacagtgtgtacactgacccagagggtgattgtcctgctatacttaattttccaataactcctattgcattgaaactgttgcaactattcttcagaagtatagacattgaaataagtaaaataaaatagtaacgtacattgagttttagaaatgtaccatgtacatgtttttagaactcttagcattttgatttaaaataataaaaattggtgtacgtattttcttttgtagacaaaagattgtagggtgaaaatttgtaaatttaacctaatattttattctcattggtcacatgttatgaaaaattatatacctttcagctacctgtaactatgtcttctatgagtaatcatgaactgtctagctctgctgaagtttttatatttttcatgaattcgtacttaaatcctagcactagagttccttttttgagaattattccttttctctcagctcttctttcaactttaccagcaacaggcacacagagagatacatctgtgtgcacacatgcgtgctctaccttacactctcacattctcacactgtcagatgctcttagataaatacctttctggatgttagtttttcagaatgtcagtggtcccaattattttcctcaggtacagattaaaattttaaccctacattctctgataggtttctgtttaatagcactgatgtgtttttttaaaaaaaatatcatacaatgcaattgcatattttggacattctcatcctgcaactactttccctccccaaaatgtttagattctgtggctgagatacagtaaagtgcacaaaatcatgcaatcatttacttattcattcagcaaattgtcatcaaggcaatgggctagcaattgtggggataataaggaaagcatttttaataccccttatcctgaaaggaaacctttaatgggaagatatttttgctatcatattacatttttttgagtaataaaattgctgtgtttaacatttgccttaagtaacttccatagatagttactttcatgctggcccatagctgtgctggggatagtggtaggcacatctttaactcgggaattagtttgaagttgcagaattgttagtaaatgtagtatttgttgatttattacacatattggcagcaatgcaatgtgtatatactattataggaaataccaagaaaaataaaaattaaaagacaaacagcttataataattacccacaaagggctttttaccatgaaaaggagagaggggatggtgggttcaaacaaattgttctaatagaagatgagttcctaaaagaggcatagatgaagtttgatggggcattcagaggtggggaaaagtcctctcagggggattcagggaatgttcgtggaatgagttggcagtggatttgttcagtgtaatgtggctgcgatttggacatacagacttggtggagatgttcactgcaagttgagtaagtagtgcaaacatacacatagagacaagaaaagtcttagggcgtggatgtgaacagcaactggaggaggttggttaagtacaagcatagaatgggaaatgaatgtgaatgccatgcacaaagcacatatgcattgtgttctactatatatttacacaggtgccttttctttctctggaagggagatttgcatggatgcctttctaggtggatgtcatacccagcgaattctgttgataagctattgccgttgcagtgactgcaataattcttgagcatgccatctttaccagctctgctagagtgttgaatgttcaaaagaaaaacccaagtacctattaaatcatcagatgccatagtgtgtttataaaatcagatgaaagccaatttctgtattagagcagatctacttttctgtgcttggttggtgttgtaaggagagattattctgcttccctaagaaggttaagctgtcatctagttaaatatggacttaaaataatgctgccaaagcagttgcctcttgtgattgatgatgatgatgacagatgatgatagttttgaaatcagttttacagggaaaattgctatttttctactttggctgatgttgtagttctagatttgcgaatttcttgtcatattcgggaacatttttgattaaaaggaaaattgctaaggactgtattcttgatgataaaatggctctaaaactgagctatggggcaaatgattataagttgacttatacatattatttgagcgacagcagttattcttggctttacagtgtcattatgagttatattttggggaacaaatagcaacccatgtctagtcagcaaaagtggcagaaagtgtggtacttagaagttatgataataatagtgtcttactaaagtcatcaaagaactttcgtatgtattactattaaattttctctacaattctctcaggacttcatgcatgtgtttcctctccttgaattgtttttcccctcagatacctacatggcttgttttctttctctagaagaatagccgcaccctctctgcagtctctcattcctccatggcatttatcaccacctgacatgtgatatatgtatttgtttactatctcctcatgctaggttgtaagccgtgtgaatgctgagactggtttcttcagtgcaataaagtaagaacctataaaagttcctggctcataataggtactcagttagtaattcttgaatcattagctctatgaataaatctttattttatacatagacgactgaatattgtggtcatgatataaaaagaagctaatgtttggtgccagaatcaaattcaagcttttcagtttatttaaccaaattgctttggtttgtgtctatgtaagtaacatagacaacaaatagccctgaaaaaaaggagtaatagtgaagacttactcttaggtgtgaaccatttctgtacctcatcacattctagaatcaatcaatcaattttgtttatacagaattgctggtaatggctactctataccactgcattgtgtgagcctgtgcagacactggtctgaaaaagccattttcaggaaggaaaagaaaacagaacataaaccccccaaatattttttaaaggccaataacatttgtatccattgggtaaacacgatcaatcaaagctctacaagccttctatgggttgcttccttaacaaatatgttttttgccttggccattcatcatatctggaagtttgggtgatgagcttgagcactctcttccgttaatactgaaaatagccacttagtggctttgtgaaaagaaaagcctgttaaagcgacagaacaaacatgcattctcctgacgatataaaacaggatattgtagattgtttatattcgtgtgggcttggtgtaatgaaattcagctgaattttaagaagaggatttgttttaatgggaaattaggttgtgaatggaaaaggctacaatgcagatacgaaaggtattccctcgtaccctccaaacgcataaggagttttctaatgagactgagagtagtagctgctaaaagcaaagtcatcttatctgttgtctgagatgaattaccttaaaaaattgtaccctgacctcattactatacattacatatattgaaacatcactatgtatctcctgatatgcataattattatttgtcaattaaagaaaataaaataaattataaaaaaacattgtagatgggcttaaaaagtgaagaaataggtagcttctgtcaccagcactatttagagggattgatgaactattttgagaaggttggggctgggagaggagtactatgaaaaatgaaaagtcacatctctggaagcaggcatgtagtatcacatccaaaggacactgtacatacaaggtctactgcagtcagagagattaaaataatcttccgacctctgaaataggataatacaccaattataagtgatctcatgactagaaagtgtactttttttccaggacagttagtgtgtctgaaagtgagcagctagaaagttcaaggaggcagactcacttatttttggttatagaatgggtagggtttgggccaaataatctagcttgtagagtcaagtttagtcatttgttgaggtttacaggaagcacaaagagagaagagtagttgaaacagcataggttgggcaaagaattaaatggtgggataaaatgggtcttggtaaaacatgtaaatgagattaaatgagctggaaagaaatcaaccaaacaaatttcaaatgctgaaggtaatagagtgggtaatggttgtcccattatgtggtggctttagttttcagtcctagtaccacaatgccccttgccatagaccttttctttaaaacaaacaaggaatattcttatgccttattttctacataatgagtgtttttattgattttagatttttttcaagatccctatagagggattttgaatacttttcatttcctgctttaaccaggatgtctgccagaaatggatgtaaagcagtgcatggattttaaaataagaaagctcttagaatttccttatccatttccagtgctttgtgcattgctccaaaatattgctgttttcagtatgggttttgggtctcatatagagaagatggctcatttgatcgaataacatttcatataattgccctttataatttaacttttctatgtaaaatcatattcacttctgtgtgatcaattacaaatataaagatttaatttcatgagaattactgctccttcaattaatagactagagaagaagagattctacattttcccttaaatggcataactaattaatagcgaaatgtgactagaacccagattttctgaatcatggactcagtgttgtttctcctacgaagagcagatagagtacttgtagttaaacaaaattagattaaaatttcagctatcaaccctattagcaagttatttatgctgtaagcctcttattttttaatctataaaatgaagttaataatagcatttctatagcattgtaggatgactgtagttgataatatatagctagagggaggatattgaatattcccaacacaatgaaatgataaatgttcaggacgatgcatatgataattaccctgatctgatcacattacatgtatggaaacatcactatgtgggaaataaccaaactgttttggaacccttgctcatgaaggaatttgcattttgtcacactatttgcatgttcatttggttttggactgcattatgcatatttaaaacatactaaatgttatccctcaaagaatgtgtaatcttaacagtcctgagtgaagacaaaagtagacagtgatcgtggaatccagaacatactatccaatgatcaatataatacctagtaatttaaaatagagccttttactgattttgctctagttctagttaatgaagaaaagaagagatcattttaaaggaataattagtaaagacacctgcaaattttatgcataagtctgagtaagagaaattctgctgataatgctaatattatattgtcacctatatatatagtgtcatatctaaatattttaaaaataccaaataagaatatcctgctttttactatagaaaagaagctaatggaaaaccgatcatctgaccaattattaaaatgcatcctctctcctataagctctgttgttaatttcgtgatacaccttgaatatgccacaagcaattggtaatagcatcaattaacatttgggaagttcagcatggccacctaagatattaaatatttgctacaggaatgctaatgaaatccactgatgttatattcccaaggtattgtttaccaataacagcaaagctaagggttaccaaataaatgaaggaagatctacttagagctgttttcttcaattattctaatttttgtgttctcattttggttctgagttttctcacctgcatttgaggtcagagtctggaaacagggctttcagggatgcatcactaatgtcctttaggaaatatgtctttgcataatcaacgtcattgaggagacttttataagaaaatgaaaaaaagaatgaatttgactttcccttcactttttttttgtagagccattgccgtttctgtatttggataggagagaaatgaagcattgttatttaatttagcccttattataacatattatgtagtctcttagggtggcatgttaccaaaaacaagatgttctattttaaaagttgatttagtattacttcttttttttaattcacaatacattatgtaggtaggtttttttttctgtacattacacaccacagactgtattagaaaataatgttggtgtagttttattgaagccacatcatgaaacataagtattataaagagaaggctgttttcccatttcaatcagttgtctagttgatgtgtttatttttcatccaatttattttatatactaaaaaacagctcttaggaaagtgagtacatcaaactcagtttcattgatttaattttatttattttactttaggctaagttaattcaaatcaatagcgtgtatgtatttcagtgtaacctgtgatgatttctgctcaaactctacattcacatttataggaatcaggatattgccagatacgcactgatttaatgaatgaagacattgcagatattagaaacaacagtctctaatgaaataattgaatttatttttccctccaacatagttgagtggtgaaactatactcttgataaagttttttattataatgtattaagtacagtggtaaataaaatggacttcattttcaaatggatcttcagcaaaacattaggtttttaaatcacctttattacatttttatgtatctctttttgggatcttattgctttattagtatataacgtttttgatatttctaaacatgtttccaaaaatctgaatttacacattgataaaaataaaaacgacttagtcttctctgtcactgtgttctttttgcacttccattgactatgttccattcatgaataagaaaaagaaaaaaattagaagagatttattggaaagcaaaggtaactcttactactatttcatagaccatctctttgattttgcaggttagtttgtcctgtctgggggagataaaatgtagatttaatatggctaatgatttagaatcctgtctactatgaaacttaactcacacactaagaaaggtgatataaatgctgaatccctttaagtacatcttggcttgatgatgatatttgatgatccactgatttgtcttccaaaacactgtaacatttggttctttctgaaatcatcaatattattgttgtcgaaagacttcagaaagccagattgtctcccaaattgtttaatacttctttgctttttggtacgttttcttatttagttattaaataagttcttagtctttaaagctgatttttaatttttttgtcttttagggactactatattcacaaaagaataccagtaatacatgcacagcacaatgaaaaaaaccaatatgaagtagttgtttgattagtttcagcaatataaatggccactgcaagtagtttaggagccaaagagcattcctgcaatctagaattagtagtttcatttttttttcaattgaattgaaattggtcaaggtaactagataatgctaaatccccagtctactttgtgccgtgtagttattctaatcgtattgaagaacgttgtccatttgtcagcattttacaaagtgtgttaatgacttctattcctgctaccttatttttctgcccattagaataaacagtgactttatgtcacataaaagtagccttatagcctttttaaacgtttatttttgacaggagttgatggtatggtatttatgagagctgagaccagaattaaaaagttgtaacacattgttttagtgaacgaaacaaaagaacaaatattctgccacacgatttataccataattctagaatttactttatccttttataaattcaacagctaaaaaggtctactgactaatttttcttaattaaattattttcttgaaacagaatataagttcctgctactactactactaatctcatctttattggaatcagttaggtcatattgagccatgattactttttcatttttttttttttattgagacagagtcgcactctgtcacccaggctggagggcagtggtgccatctcggctcactgcagccttaacctcctggactcgatctatcctcccgcctcagcctttgaaattgctggtattactggcatgagccaccacacctggtcaagatttcttattaatttaacattttcaactatttctgcatagttgatatgtgtcctattgctttctgatttttttttaatttgttctttttggttattatactttaagttctgggatacatgtgcagaacatgcaggtttgttacataggtatacacgtgccatgttggcgtgctgcagccatcaacccataatctacattgggtatttctcctaatgctatccctcccctagccccccacccccctacaggccccagtatgtgatgttcccctccctgtgtccatgtgttcttatagttcaactcccacttatgagtgagaacatgcggtgttgggttttctgttcctgttttagtttgctgagaatgatggtttccagcttcatccatgtccctgcaaaggacatgaactcatccttttttaatggctgcatagtattccatggtgtatatgtgccacatattctttatccagtctgtcattgatgggcatacgggttggttccaagtctttgttattgtgaacagtgctgcagtaaacatacatgcgcatgtgtcattatagtagaataatgtataatcctttgggtatatacccagtaatgggattattgggtcaaatggtatttctggttatagatccttgaggaattgccacactgtcttccacagtggttgaactaatttacactcccactaacagtgtaaaagcattcctatttctccacatcctctccggcatttgttgtttcctgactttttaatgatctccaatctaactggcgtgagatggtatctcattgtggttttgatttgcattctctaatgaccagggatgatgagcgttttttcatatgtttcttggctgcataaatgtcttcttttgagaagtgtctgttcatatcatttgcccactttttgatggggttgtttttttcttgtaaatttctttaaattccttgtatattctggatattagccctttgtcagatggtggattacaaaaattttctctcattctataggttgccttttcactctgatgatagtttcttttgctgtgaggaagctctttagtttaattagatcccatttgtccatcttggcttttgttgccgttggttttggtgttttagtcatgaagtctttgcccatgcctatgtcctaaatggtattgcctaggctttcttctgtggtttttatagttttaggtcttaggtttaagtgtttaatccagcttgagttaatttttgtataaggtgtaaggaagggctccagtttcagttttctgcttacggctagccagttttcccaacaccatttattaagtagggaatcctttctccattgcttgtttttgtcaggttagtcaaagttcagctgggtgtagatgtgtggcattatttctgagggctctgtcctgttccattggtctatatatctgttttggtaccagtaccgtgctggatttataaagcaagttcttggagacctacaaagagacttagactcttacacagtaatagtgtgagactttaacaccccactgtcaatattagacagatcaatgagacagaaaattaacaaggatatttaggacttgaactcagctctgaaccatgtggatctaatagacatccacagaactctccaccccaaatccacagaatatacatttttctcagcaccacatcgcacttaattattggaagtaaactctaataattggaagtaaaactctactcagcaaatgcaaaagaacagaaatatgacaaacagtctctcagaccacagtgcaatcaaattagaactcaggattaagaaactcactcaaaaccgcacaactacatggaaactgaacaacctgctgctgaatgactactgggtaaataacgaaattaaggcagaaataaataagttctttgaaaccaaggggaacaaagacacttatgtaccagaatttctgggacgcatttaaagcaatgtttagagggaaatctatagcactaagtgcctgcaagagaaaacaggaaagatctaaaattgacagtctaacatcacagttaaaagaaccagagaagcaaaagcaaacaaattcaaaagctagcagaatacaagaaacaactaagatcagagcagaactgaaggagatagagacatgaaaaacccttaaaaaaaatcaatgaatccaggagctggttttttgaaaagattagcaaaatagatagactgctagccagactaataaagaagaaaagagagaagaatcaactagacagaataaaaaatgataaaggggatatcaccactgatcccatagaaatgcatactaccatcagagaatcctataaacacctctatgcaaataaacgagaaaatctggaagaaatgtataaattcctggacacatacaccctcccaagactaaaccaggaagaagtcaaatctctgaatagaccaataacaagttctgaaattgaggcactaattaatagtctaccaaccaaaaaaagtccaggaccagatggatttacagccgaattctaccagaggtacaaagaggaactggtatcattccttctgaaactattccaaacaatagaaaaagagggaatcctccctaactcattttgtgaggtcagcatcatcctgataccaaaacctggcagagacacaacaaaaaaagaaaatttcaggtcagtatccctgatgagcatcgttgcaaaaatcatcagtaaaatactggcaaaccgaatccagcagcacatcaaaaatcttatccaccatgatcaagtcatcttcatcactgggatgcaaggctggttcaacatacacaaaccaataggcagagagccaaatcatgagtgaactcccattcacaattgctatgaagagaataaaatacctaggaatacaacttaaaagggatgtgaaggacctcttcaaggagaactacaaaccactgctcaaggaaataacagaggacacaaacaaatggaaaagcattctatgctcatggataggaagaatcaatatcatgaaaatggccataaggtaaaagtaatttacagattcaatgctatccccatcaagccaccattgactttcttcacataaacagaaaaaactgctttaaattttgtatggaaccaaaaaagagcctgtatagccaagacaatcataagcaaaaagaacaaggctggaggcatcaggctacctgacttcaaactatacgacaaggctacagtaaccaaaaaagcatggtattggtaccagaacagatacatagaccaatggaatagaacagaggcctcagaaataatgcctcacatctacacccatctgatctttgactaacctgagaaagacaagcaatggggaaaaaattccttgtttaataaatggtgttgggaaaactggctagccataggcagaaaactgaaactggaacccttccttacaccttatacaaaaattaactcaagctggattaaacacttaaacctaagacctaaaaccataaaaaccacagaagaaaacctaggcaataccatctaggacataggcatgggcaaagacttcatgactaagacaccaaaagcaaaggcaacaaaagccaagactgacaaatgggatctaattaacctaaagagcttcctcacagcaaaagaaactatcatcagagtgaacaggcaacacagtataagagaaaatttttgcaatctatccatctgaaaaagggctaatacccagaatctacaaagaacttaaagaaatttacaagaaaaaagcaaccccatcaaaaagtgggcaaatgatatgaacagacacttctcaaaagaagacatttatgcagccaagaaacatgaaaaaacacttatcatcactggtcattagagaaacgcaaatcaaaaccacaatgagataccatctctcatcagttagaatggtgatcattaaaaagttaggaaataggccgtgcatggtggctcatgcctgtaatcttagcaccttgggaggccgaggtgggccgatcacgaggtcaggagttggatatcacctggggcctacatggtcaaaccctgtctctactaaaaatacaaaaattagccaggcgtggtggtgcacgtctgtaatcccagctacacaagaggctgaggcaggagaatcacttcaacccgggaggtggaagttgcagtgagctgagatcgcaccattgcactccagcctgggcaatagaatgagactccatctcaaaatcaatcaatcaatcaatcaggaaacaacagatgctggagaggatgtggagaaataggaacgcttttacactgttggtgggagtgtaaattagttcaactattgcggaagacagtgtggcaattcctcaaggatctagaaccagaaacaccatttaacccagcaatcccattactggctatatacccaaagcattataaatcattctactgtaaagacacatgcacatgtatgtttattgcagcactgtttgcaatagcaaaaacttggaaccaacccaaatgcccatcagtgatagactgggctttctgatcttttgattttgaggtttcattgaatattagcacagattttcttatttttttttctgtctcaatatacatttaggaaattacttcctaataagtaagaagtacatctagatagttgttggatgaaatatattaacattagctattgcttaagaaaacaactggataatgttttcctacctttttaatcatctcatcctgctagtgtactgtgtttgctcatgtttatgaacctaccacacataatataattggctctgaacttcctgaattgcaaatcctgtattcaataatttcatgcatgcagcctatttctcaatttatttctgggaactctaatcttttgcttcacagatactttgaactggcatctcatgtcttagtctgagttcctaacctttttatatttttttattatttgtattatttatatattgatttcttatttctctcccattgaaatgtaagatttatgagggcagaaaacttttccatcttgtccaccagtgtttctcaggcacttagagaactgtgtggcctaagagggattgattgtgtactcttacattattctttttcatttattatttcatttgtttcttataaccttataaggcataagtgctattctgtaggtgaggagacgaagacatacagaggttaaataatgtacccaaagctatattgctctagtagttggttatttagtgatttttttttttggctctgtaaatttgaggccatttttcttcagaacattcccttttccccagcatctttatggtacctggctatgcacttgcttttgctcataagcctaggttttgtctggtcagtcagtgaacataaataaggaatctgctaaccaatcaacaaggaggaagggagaaatcagtgaaaatcgtcactaatgttgaagataataaacattttggacaatgactgatgttttatgaagagcttttcataggaattcttatttagttattctcatgttacatgatggggaaactaatctcagagttgcaaatgttaagtgccaaaggcaacacagccaaaagtctatagctggtgcattagtccgttttcacgctgctgataaagacatacccgagactgggtaatttataaagaaaaagcggtttaatggactcacagttccacgtgtctggagaggcctcataatcatggcagaaggcaaaaggcacatcttacatggctgcaggcaagagagaatgagcgccaagcaaaaagggaatcccttataaaaccatcagatctcatgagatgtattcacaaccacgagaacagtatggggcaaaccacccgtatgattcagttttctcccaccaagtccctcccacaacatgtgggaattatgggagctacaattcaagatgagatttgggcgggggacgcagccaaatgatatcagctcgtgagtgagcatcagacctggggttcacatcctcgtatctttgcattctttcccatccattgtattgtgggaagagcagatagttctccccattcccactcttctttgttgtgtgtgtgtccactgttgatgagaatgtcactctttgttattttcaagtttttttagtcactgagctttcccatgattttcataggtcattggaattttgtattgttttatgaaatatacactgaaataagatccttggctacaattacagttttgtataatttagagagcacgtaggcaccattttcttgcccaagaatggggatagcaattcttttactttctaccacataatgtagctgtaggatgaaatcctgtagctgaagtttctcaactccagcccattgatattttgggccaggtgattgtttgttgcaggagggtgtcctgcgcattataggaagttcagcagctaccatggcctctaccctgtagcaccacccgagttgtgataatcaaaaatgttttcaggcattatcattttttttttggcttccaggggatgtaaaattgcccatggttgagaacctccggattaaattaagataataaatgtgaaaatgtacattttaagacaattttccaattcaaggtgttattaggatgagatttaagaacaatagaaaaaatcattgtggcagatgaggtaagcagcagaagggaaaacagggtatagacattaaggactagagttggctgtctcctattatagtcttgtgaaagctcactcatacagattcctgctataaatttcttgcttttgtatttttccaagcaaatatttaatacaatgttgcctgctaatagaacttcccattacagatttaagttttcttttcttttcttttctttttattttatttatttattttttttttgagacaagagtctcgctctctgtcatccaggctggagtgcagtggtgtgatctcggctcactgtaacctctgcctcccagttcccagtgattctcctgcatcagcctcctgagtagctgggattacaggtgcccaccgccacgcttggctaaatttttgcattttttaagtagagacgaggtttcaccatgttggccaggctggtctcaaagtccttgcctcaagtgatctgcctgcctcggcctcccaaagtgctgtgattacaggtgtgagacactgcagccggcctaagttttcatttctttatgaaatactgtgtagcatattcactaccatatgatgaataattaaaactaaattgcaattgtcaaaataaatgaacacatcacatttggaggtagaaaaattcctaatttttttttcccacgtagtttattgcatactattcttatttgtggtatttggtgttatgtagttactcaaagttgttacagcatttatactatatttgttttgttgaattgaaatcatagaacctgccaattaaatttaaaacaatgtcatacacgttggtttctctattacttacagagtaaaattctcaaagccccatgaggcatccttgtcttaatggcatggatatgttactgcatgtgctcttattgtccagccagctggtattcatatataagattttattaaataacatcttacacattatttatgtgataggctttggtgatggggctttgagaaagctgtccagaagagagatgtgagcattctctatgttaataactttctactattttattttaatgtaacttgctacatttgccatctgggatagaagcttctgcatcaaccattaactatcaacaccaactattccaggctgcagaatttcagtttgaaacggttctaaaattctatggaatagtgaaggcccgcttgcttcattgtgctttcctttaagtggagtattgcccagatgtggaagttagatgtggaattttcagacagaactgtttaccttgagaatggctgggcaccttccatttgtactactttttattattgtcagaactgatcaaataaatctgcccgagtatctgtgtgtgggatgcatgttgaaagcgattttattgttgcccaataagtccccaaatgctgtcgtcttttgctttccctctcccatcttaagtgcctttttgcaacttgcctcacaaatcacattgtctctacttattacccaggcttttctccagctggtaaaatggatttttttttcctcagccagattcagagtttgccctgttcttattccctgtatgtttcccttcacttttaatgtgaaaattgcaaatatatttctaaacccttctgcacaacactttccatttatggaaaactcacactatataaagtaacgagaggagatatctaaaatgtgtcttccattttctgctctgtatctccaactggaccaatttttccagataatttctcctttctttccaactttatctgcatcgtagaattcagagaactgaaagcatttcttcctttctttattttttttcatattctttctctactgcagacttcgctaactgatgaaacactgccagagcccacttggactgtttcgcaactttacttaagggaataaaagctctcatgctgaggtaaggcaaacagtccatgtaggttctcactaaaaagaagagtggattttataagctcgggcctgtcttataatctctctgtgtcttgttcttgtatgtaccttgataatttactatctgtcctttttctgcccagtggatttttgaggttcacaaatgtgagatacacaaagatgtgatatacacttgctgttccgtgtttttttttttttgcaaatatgcattttccctccagaactgttactggtaactatcctgagactcaagatgactttaaataacacttttttaaatactatacttagttagggttagacttggctgcaagaaacagaaaattcataagatcaggagcttaaatgagatacaactatatttttctctttgaattaaaacttgagataggcattccaaagctactgtagtgttccatgatgtcagggatccaggatttgtcagacatagcttttgtcctcatgattgcagatggagcataaggacaatgtgttatagtcacattccaagcagaatgtgaaaaggtacaattatttccttgtaaggaaagttcccagtagttgtggtacaactgtgctggttaattctatggatcggtgcttagtcagagggccatgtgtggctgcaaaaaaggctggaagatacgatacagtcctttttcttgtggccatgtgtccagctaaaatttatgtcctctaagaagagaaaaattagcagtattttgctctcaaacattaattttaatatatcctatattttaaaacactgttgctgggtagattgtgaactacatgtgggcaaggactgtgtataataaaaaatattatgttgtcagctcttaacggtgtcagcaaaataatgaataaatattcattgaaaatgtacatggagagatggtatttttatcatgtgaaatatgactcaaaatgagactgattttttacattttaaaacaaatgcacccaaccattgtttattcattcagtaatcactgagcgtatataccgattcattaaagtatcatttttctttctttaattaaaaatcttaaattgatatataatagttttacatattcttggagtgcatatgatattttgatatctgtatttaatgtagtaatgatcaaattagagtaactgggatacctattacctcaaacatttattttttctttgtgttgggaatactgcaaatcttctcttctagcgattttcaaatagacaataaattattgttaattataatttccctattgtagagtcaaatattagaacttatttcttctatctgactatatttttgtgccctttaaccaacttctcttcatctgcctctcccttcctttccaagcctctggtaaccatcatcctactctctatctccctgaaatctacttttttagtttttgtatataagtgaaaatatgtgttgtctttttgtgcctggcttattttacttaacataatgacctccagttgagcaaatgacagaatttcattctgttttatggccaaataatattccattgtgtgtagctataccacattttatctatccattcatttcttgatggacacaaagagtaattccatatcttggctattatgaatagtgctgcagtaagcacggcagtgcagatatctcttccatatactgattttctttcttttggatatacacctagcagtgacattgctggatcatatggtaattctatttgtagttttttgaggaaactccttacttttttccatactggctgtgctacttttacattttcacaaacagtgtataagctttcccctttctctgcattcttgccagcatgtgttattttttgtctttttgataatagctgttctaagtggggtgaggttatttctcactgtgttttttacttgtacttttcttgatggttagtgatattgaaaattttgtaatatacccattggccatttgtttgtcttcttttaaaaaatgtctatttgggtcctttgcctattttttaatgacattattggtttttgctattgagttgtttgggtttctcatgtattctggtgattaatctcttttcatatggaaagtttgcaaatattttctcccattttgtaagttatctcttcactttgttaattgtttgcagtgcagaagcttaaaaagcttaatgtagcttcatgcaatccaatttgtctattgttattttttttgtttttgttgcctgtgcttttgaggccttaccccaaaaatcttttttgagaccaatgttctgtatcatttcctctggtagtttcatagtttcaggtcttacatttaagtgtttaatccattttgagttaattttttatatggtgaaagatgagaatctagtttcattctcctgtatatagttttcccaacactattttttaaatttatttttcatttcaataggttttgggggaacaggtggtattttgttacatgaataagttctttagtgttgatttctgagattttggtgcccccatcacccaggcagtgtacaatatgtccaatgtgtaatctttcatccctcacgccactcgtactctttcccctgagtccccaaagtccattgtatcattcttatgcctttgcgcccccatagcttagctctcacttatgagtgagaacataccatgtttggttttccatttctgagttacttcacatagaataatagtctccatttccatccagattgctgtgaatgcaattatttcgttcctttttatggttaagtagtatcccatggtgtatgtaacatattttctttatccacttattgattgataagcatttgggctggttccatatttttgcaattggacattgtatcagcaccatttttaaatgagactacatgcttttggagctttttctaaaaatgagttggctgtaagtacatggatttatttctcagttctctgttttgttccattggtccatttatctgtttttatgccagtatcatgtggtttgtgttactatgactttgtaatataatttgaaatcacatagtatgatgcctctgcctccagctttattctttttgctcagaattgctttaattattcaaggtcttttgcgattctatagaaattttaggattgtatttttcatttttgtaaaggatgtcattggtattttgatgaggattgcaatcagtctatagattgctttggatagtataaatattttagcaatattaattcttctaattcatgaacatgggatatttcttcatttttaatgttcttttccatttccttcatcagtgttttatatatatatatttttttttgtggagatcttccatgtctttggttaaatggattcctagaattttttttgtagctattgtaaataggattgctttcttgatttctttttcaggttgatctctgctagtgtactgaaacactactgatttttgtatgttgattttgtattctgcaactttattgaatttgtgtatcagatttaagagtttttcgtggagtctttagatttcctaaaataaaaaatcgtatcatctgaaaacaagaataatttcacttgcttttcaatttgtatgccttttctttctttttctttcctaacagctctgactaggattgccagtactatggtgaatggaagtggtgaatatgggcatctttgtcttgttctagatcttactgggaaggctttcaattttaccccattcagtatgatgttagctgtgagtttgtcatatatgaccttaatcacgttgaggaatgttccttctatacccattttgttgacagttttcatcatgagggctgttgaattttatttcatgcacaagtgttgtttttcttatagtgacttctttaaccatttatcaagtcatgttttggatttctccttaaaaatgagtctcagacttaaggttcaaaacacctatggaaataattctctttacgactaatttttctctttaagcctacttttcttcatttctcagagaagttatcttgctctgataactttttaactcttcctaaaaatcaaatctccccccaacaagatggagatttggtcctgctgggggatttttaagtaagggctgttagctgtgattgaggtgcctgtatatatgagacaaggagccttaagggactaggatcaaattaattaaaagtcacatttattgagccctgccattgaagaatttataatgtcttctatgcaaaccaattcattggtaaggaacagcattgctattctcagcattttggaaataccacaatgttggagtcgtctcagaaggatctctgaagagttctgggaaggtgacagtcaacagcagaatagcagctgccaccacagtcaagcagttggtttgcttggcttggaagttttagacatcaaaggagtatggcttcttcaatactaaaaccagtgacaaaattgcaaaagttatttttattcctcttcaaatatgagcaaacattactgtgattcagcttatttttatataatgttacagggaatcaaattaagaattaaatgcattttttggcatagttatgtcttgtaaagaaagaaagatggtgccaggggaattttcctttcaaatatgtaaagaacttctaatgagtgaacctttcctgtgtcggaaagatagcattcacctcctttcctggcttctgtgccaacttacgattgtggtgtgtagaaatttagtgtcagccactgaaagaactatttcctaagatgatactgctttttactcaaggaataagtaggttccctttgaattgacctgtgtgtgtttggaaaacaagcttaaatatctcctcttctcataggaagaacactatttcaaagagccattttctttcctaacaaagaaattcatactgcagaaaaatcagcaatttcacagctggtttttgaaatcctgaaatgatgtatacaaatcaaagcaggagagattcatttggaatgaaaggaatatttgaattgcatcccagtttcgaataggatattgtttcacggttctacagtattataaacatgtcatgtctgttatacatgacaatcatatctcatctgtgactcatgaactttataagaaagtgacaatttgaaagcatagaattgcaggattggatggaacgatatcttctaagttatttccactccttttcccatttttggttgaccatgctaattcccctctaaaacattcttctgtagctacttgaaaacacccattgcttcttaaagtaacctattgtcaaagaatattggattttcttatgtacattgaaaaaatgacactttattggttttgattctaccaccaagagtcacagggaactttctatcttttcatcatatatataacaggcttttcatcttatatgtaacagtccttaaatattttcatattgtaataatttcctatggaacctgttgacttttacgctagagttatagtgatggaggtaatgagaagtgatcatattctggatatatggcagcagtagacagaaggtgtggttcataggaattgatcatggaatggatgtgggctgtgagaaagagcagtcaatgtttttgacctgaagatgttttactaacatatgttaagcatttactatctgctcaatatactttgctaggcattgtagcacaattaaatgtgcatttgcatagctgttcgatgatacaggtaggactattctctaagactaagagaacattagtcaggcctcttatggtgagggaggggttccctttctttccattctcatgctttgacttgagagagcaagcctatatgttattatggatcagaattgagatttcatgctcagttttaagtctaaaaatatgcttttcaatatctagtatttacatgcgtgtgacttctcaggaattataacgagagcctgaaaaattaccaggggcaacattttcagtccggagatgttataccccagttactgccactaaattttaagctccttgggagcaggaatttgattcttttattatattaatagtatctgttacataatattaactcagtaaatgcagggtatgctattgtaaaactatagtctcagtctctgtaagtggattttttaggatagactaggtcctagttaatgtgatatatctctatttctgtctatctatctgtctacctacctacctatgtatcatctatttatctgtcaatcaagagaagaaaataaagaagcactcttggagaatcaaaattttttataacatggtatgcaactcccttacgttctttatcagccacctgcatgcaaacagcattatgtctgaagttaaaacatgtaagatatatgagagtggaatccttggtgcatttcactcttgaactcttgtctatggagtaagtagcctgggggtagtttctcctcctttttatatatgtggggagaaggaattaggtggctgattatcttgtgctaaataggtttctctgccgatccacaaggtggcagggagtccttagtgccactatgacagattaaccaaataggcatctgtcgaaatgtctgatgcattagttgcactgcctgtaaaagagatgggcctccttgagaaataaatccacactgaatttcaaatgtggttgtgtccccaaaattagcaacgttttcaaaggtgtacccttcaaaggagagcagaaataaactgtaccttaaaagaactagtgctcagaggcctttgtttaatcaatggttagtttggtggtgattgcacaaattcactacattaaatttaatcagggatgtttctggtatgtgggtggcatgcttactgattaattcatttatattcttgaaataacatatgttctcctggatgaatttccacagtttggtaattccacagcatgcatttcagcatctctaaatggctgttttgttcactgtcccagagcctaagacatgctgggtgctgggtactgattagtttaccagactaagaatgacagacaggaaatggcaccattttaatctctcagaagaacatcagaggaatcatttcggtggctgtaaatacttcaggattttgatgtcaccttttcaagttgctttaagaaatcacttaggaatggtttgggagaccatgatacaatgaggtcccgcaaagaattacacctttctttgtcagggttctgaaattgattaagtataactatgtccgtgatgtaatcgattacattaaaactatcattttggagaaaagagacctgatggattacagagtctctacccttatttataaaaaacgatgaaatgaaactcagtagttcattgacttttgtagatggaaagatagtttgtagtagagctttgcattcaggactagtagttgccaccaccccccgcccatcccctattatagccagtttgtttgtttgtttgtttatttatttatttatttatttatttatttatttatttattttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctatttatttatttactttaacttttattttaggttcaacgacatatatacaggtttgttatataggtaaattagtgtcatgggggtttggtgtacagattattttgtcacccaggtactaagcctagtacctgatagccagtttaaagtgtgtacattggggaagggggggaatgaggttgttcttagacagttagaggcacagagggtatatatatatatgggattgccttatgttaatacatcacttggctttaagtgtgggaatggacaggagtacttgttatgacctgtggggccctactttccttcattctcagagagattttgcaaattgcctaaaatatctgttaatatgctctgtggctacatgcttacagacatgatgacaaggaggggggaaaatattgttcattgttgtcattttctagctggaaccatgagatttgcttaaggaagactgaaggctagtgtgacagaaaatggagctcaggaggacccagaataaattacattcctttggagggtcctgagaggggcaggccatggcttagttccttctattccactcatttcttacagttcagctgcctcccgatgtgcagttgtttagtatgcaaatcaataatcattacctatgtgaagtgttagttcacaggcgtgcaggctgtggtcagttggtacctgttccctcctaaagaactatctctgaagttgaacatctctgtttttctttgtataaatctgaatattaattagaccactgcttattaacttagggacctctctgcttttggtgacagtagcaggcagaatatagatggtagaaaacgaaatatcatgctgtttctgtaaacggtttggtgtctccatataataaaactctttagaattaactgcctccagaaacagggacaaatgtgatgtcctttctctgccccttgaattaaataacaaaatgaacagcagatcattttgatgttgctactccataaagatcattttgttattgttactaggagagagtggagtgtaatggaaagaatacatgtttacagctgggctgtaatcttggatcttctgaaaagtaagaatatgttcttgaaggaacctcaaattttgtgaatgtgcttattattttaaagataattacatggattcaatttctgtctccgtagtaacctgctgtattatctttctctagctatataatctctctttgcctccatttcttcatttgttaaatagggataataatagcacctatatcataggtttattataaaaaatgaaatggattcacatttttaatgttctatgtaattacttatcattgttgttttaatagggaaagtattggttatataaatagccaagaaaacagccaactgagacttttcttcctagattaccttggttatatcagtgcttctgggtgtggtcactgatattctacagcagaaacagctagtggggtccccaactaaagaatgtatcttattggaggctaagaattatgaggcaactatctctgacttgagaaccctaaccttatattgacatctgagatttattcatcaataaacacctttttgtaatccagaatcatgttatgtcattactttctatatcagaatttaaatgttaagggaccaagacattatgcaatgaatactaaaatgttactaaaatcatgtgttgtgaagaatatttggaaatatggaaacatgttcacaagatgttaagtaaaaaaacaggttagcaggttgtaaaacagtatttcagtatgattctaaattgcaatcattaaataattttataatcatgaaaaatgttattaaaatattataatcctgtgataaattctaatgagtactttcttgatttggctttaacattttccaaaattaaaattacaagttttttttctgattataacagtaatacagcttactactgtagctattacaagcaaaatagaaaattaggtaaagatgattaaaatcatccacaatcccagtttcttaaaatggccttactaagatttttaacaaaaatttactccacatatttatttatgaatttttatatgcaccatttctctaattttcctaaatggagtttataatatctacctgttttcactcaataatatattgaactatatgttgaccctcatcattgtcccaaagtttaaagtcattgaatagagatacagcaatcacttactgatggagatgtgtagtttggttgtcttacaatttgtacattaaagttatactatgataaagatctttgtgcataccaatttaccctaccaaaagatatgagaatatttccagttgaattttaaaatgaaaacctcattattcttttaacttactctcatttgattattgaggtggagtatttttccataggcgtctttgagcccctcaacttgacaattgtattgacaattattcactgtatgattatcgtgattattgcaattaagtgattacttatggtttctcatttattggaaggagcattgtaagggtagcagaaacactacagagcctttttttttttatttaaccactctcttgccctggacatgaggtggtgattggactctcagatgctgcttttgtaatatcgcatggtcaaatcaagccctatcaaagtgccctgtcatgtcctttcatatctccttagggttaagtatgtccccaaagccctgcgtcttgaggtaggcatgggaattatcttcaaaaatatcaacataggatataactttctctcttagattagctaagcttagaagaaaaatttctttgtggtcaaatgtttctgccatattaaaatctacaagtcaggtggtgaccagattttgtgatgccatccaaaaggttttagtacaaatttttcttaaaaatgcagtaagtaattgtaaactgtgatacttttaaattatctgcaagattattccatgaccatttttaaaatagatggtttttctgttgtggtcttagttgtcattttatagttgaccccacgtgtaacttttcgaagactctcaggattcccttcagtcctattctgtgtatctatctagtcattgtcccagtgaaatgataaaaggcccaactcagcttgttttgcaatgtgggcaacaaacatctcaataggatgtgtctcttccagttgtttttcttgtactattgatgtcttatggggagatatttaacttcacttcttggtcttattcgtagcaacttccatgactgatgagccagttgaattagtctttgggatagtcactaagtagatgggaacaggattttcttggttggaagtccatttcttgaatattcaagtttgtttgtcctagaaatttaattgactgagcctgcctagtaaaggaaatctttgtcatgccagtgtgaagttctgcttcccactttactattttcctcttaatgcagtactaatatatgttgaaccaaaaacaaaaacctgggcttatagcataacacacctggtattaaattgtggtaccaccatttgttatcctggttagttaacaactttctgaaaataaaataaggataataatatctatcttaatgtatctttttttcttatgaggtatctaagatagaagaatttctttttctttgccttcgcttaatagaggttagcattattttattttatataaacatagaaataaacatctgctggaaactcatttgagagaaaacaacccatgttggatcttagggaggtagatacacttttccattctttcttcaatctacagaggttcatgtcatacccacatcttcatctaaaaatcaaggaatgaggctggataccgtggctcacgcttgtaatcccagcactttgcgaggccgaggcagacaaatcacttgagctcaggagctcaaaaccagcctgtccaacatggtgaaaacctgtctctactaaaaataaaaaaattagccaggtgtggtggtgggtgcgtgtaatctcagctactcgggagactgaggcaggagaatcacttgaacccaggaggcggaggttgcagggagccaagattgcaccactgcactccagcctggacgacagagagagactccatcaaaaacaaacaaacaaacaaacaaacaaacaacccaggaatcattctagacattatttgtttctcaaatctgtaattgttttaggatctatgtttgttttcttttcaccaaaactaaagaaacactgttccttatttgctttttttttcctcagtctggctacttacttttctccctcatagacaaatgctaacaaccaatgaatcaccatatttctcctttattaaagctgtctccaatggcattctcagcaagttaaaatgtcaagtatatgggcctttaagaaaggtttcaaaagatatccctggggagggagggaagagaaatttgaggagggaggagggaagccatgtgacctgagaagcaggaattctgtacataaatactgaagtttactgtcaagcttccgagtaaaaatgttaaatatttgcagtgtccacaacccatgtccctgtgataaggctggttaattcctagaacataatgctaggaattcaagaatggggatcatatcctgagtactgatgatccatcttgatactgtgtcaaagggcacaggatgaggaatggaagggtttggagagtgagaataaattactgcaaatccaaacatctgactggataaactactccaagtggatatcatttattattcactccatagaaagattagaatgtacaccctagggagattaaggtaagagtaagagagatgtctaaacattttatgtgtccatcatctacgttgcctgtttatcagagtctgtcactataatgtttactgctgtaagtggttaattatgaatatatcagctgaatgctttcatgtcagttgagctgtgcagttgccacagtgagcactcttttcatgtggacttttggataaaccagcgtttagagattgtgttttataaattatatgaccaaattccaataccacatggagaatacgtgatttatgtgctaattggatcatgtccattagacatcctcataactatcttttatcggcactacagtttttatttactaaaacatagtcacatgaaagtttcctataatagtattctacactttctattctctgactcttaggaatcactactccttctgaactcctttagcaatgaatttcacaattatatattattaatgtgaaattcacaattatatattatatacatttaagtatatgcagtgagtttcacaattacatgttctttcatgtgtttatttttctcatcaaaaaattaaatcttggccaggcgcggtgggtaacacctgtaatcccagcactttggcaggctgaggcgggcggatcatgaggtcaggcatttgagaccagcctggccaacatgatgaaaccccgtttctactgaaaatacaaaaattagccgggcgtggtggtgtgtgcctgtaatcccagctactcaggaagctgagtcaggagaatcacgtgaacctgggaggtataggttgcagtgagccgagattgtgccactgcactccagtctaggtgacagagccagactctgtctcaaaaaaaaaaaaaaaaaacaaaaaaaaatattaaatcttgatttgaaagatttgaaatatcaggtgagtataaaatcattggtaattctaacaactgaaattaataatttcaaaaatattgctttttgtatgtctataaacttttatatattgaaaaaacgtatatatgcaaatatgttgaattcatgtcatatctttttaacattatctgcattataattttgaatatctttttgcttaattaattaatttatttttattatttttttttgagacagagtctcactctgctgcccaggctggagtacagtggcaccatcttggctcactgcaacctctgcctctcaggttcaagtgattctcctgcctcagcctcccgagtaggtaggattacaggtgcaagccactgtgctcagctatttttttgtatttttagcagagagagggtttcaccacgttggccaggctggtcttgaactcctggcctcaagtgatccacctgcctctgcctcccaaagtgctgggattacaggcgtgagccactgcggcaggcttctttgcttgatttatgatcttttaaaaaatttgtcatgctgggtcaattaagtggtaggtatttagaaagtaagactcttctattttttaggatctctgtggcatagtgcattgcaagtagttctcaataaatagcttttgttgtaaactaacacactggttactttctaaagtcatttgctcttttaaaatccctttggtatactaatctatactatatcactatacttgtagaccaagggatttgtctggccaacatggtgaaaccccgtctctactaaaaatacaaaaattagatgggcgtggtggcgcgtgcttgtgatcccagctactcaggaggctgaggcaagataatcgcttgaacctgggaggcaaaggttgcagtgagccgagatcgctccactgcactccagcctgggcgagctactgcactccagccaagggtttggtctacaaatatagtgatatagtatagattaattcagttgctttaaaaaaatccatatgccacaggatggctcaggatatcaatctatatcttagaaaaattattatacaaataaataggcaacaagattgagaaaaactggtatatttggtaaaaatacaccaaaaaagcaagagaggaggagggagatatgtgttttagaacccacacattttcaccaggtgaattttaaaggctataagagttcataaaatcttagcatcctgagtcatttgagagtctgataaacatcatttaaatacgtaatttaattgtttctcttttcttgttagagaaaggtggtgcaaacttattcctggaagacggtcagccatattaataatgagcaaaatgcctattgagttggttttttaaatactaagaaaatgacttttgaagttaaaacacatgctaactgttgcttagttttaaatatatatatatggagtggaacaaaagttcccactcaacagcttactgaaaaatacaaaaaggaatgcagttttcagcaggttctatttgccataaaacattttcttttcttaccattgttttatttttttctttctggtctccccctcttgccaacgttcacagctggacatctttgtccatctttcaggtactttgtgttgcatatccgtacgtgaaacacatatatgcataactattcaggtttccctcctgtctccattgttggcagaattctcattcaagttaacattaatatacttttttgctcttctcttcctcctggtttgtccttttgtcacttggaaaatattgatttccctccattgtaggtgagatgcacctacatggctcatttgtgcttacttccttcttgtttggagactcagcaagttcagcacaatgctatttattgaatttatctgtcaatttcttcttccttgcatggctgactaattcagtggaatcagcacaataccagaagcacagaggataatggcttaaattttttttttcgcagaaaattgtaaatcaaaagtagagactaaatttgaggaccaatcccttcagaaggttgcaacttgtaaagtgtgtgcaggactgtctaggtgaacatggcaacagatatgattttctaatggggcacttctcagcttttcattaaatgtctaagaaatacacagaaagacatgaattggcagcaggattgtgaaataaaaatgagaggagcctctaacataggcaaaaactttcctccaaacagacaaacaaaagcgtataatcaatgaagaaataaaaatcagaataacctcattttcttcacagtacaaaatactaaaaaatcaacagagttattttcatgaatggcttagtctttggaattggctttggacatgcattcctacttcacacatcccagtgaacctcagcacattagctggttactgagaaggtaggaaagtaaactgacctttaccttttgtgaactgggtgctacttactaggatcttactggtctctttctgccaaggtcagctcctcttgtgttacaacagagaaacgactaatctcagaatgtaacatgttttagataagtggtatggagaagcagtcatgcttagttgttgaaagagaagtatacagtatgcacaagtgtatacttttgtaagtttttatgctgttcaaagaagaactttaagatactattacagcatagtcattaagagaaaagatgttaaatagacaagatgcttttgaattgcaagacccctgtgcctaatcctgaaaaagttttctaacttctttgtgccttagtttcctcatttgtaaaatggccattaaacacttcataatattactgtgaggattaaaaaagtaagaactaagtccagtgtttggtaactgtagtaagccctagatggatgattgtcactactgttatttaccctaaataaattcaatatttatctttagttattattataccacactgttactaagttaggcttagaaggaaatgactccctgttagctttgaaggttgagctacaagatcatgcccatcaagttaaaattaaggttttgacctgacaattgaaggtgcaagcctagagagattaccttccacataagcttaatacctggcctaagtggcttgctcacgttatctaagtagaaacaaactgaaacaaacaaaactaataatcaaaactaataaaaacatccaaataaataaaattattgattcaggcaaggaataaggattaataaatttgataatgaggggctggataattgtataatgtcaaggtggaatcacacgtgtaactttctaatcaaagaaaaaaaacacacactggagagatcctactatttccatcctattccagtagtcagtcagttgttatatgccctgggatataatgcaagatataatgagcaactttcacaatgtagtctagtcaaaaaagttttaccaacatcagatcattaggagatacaggagatagaagaacaagggagacatcatcacatggatgcaatcagacaaatgacacgtgcgagacattctgtgaaacagcagacctggtctcttcaacaagtcactgtctggaaaaaggactgaactatattaagaatgactgaagaaacagaatcagatgcaatgattggtcttgaattagatacttattttgtcaaaccagatgaaaaggcatttttgacaggattgcctgtttttgtaacccaaaatatgcattgaaaaaaataagcaagacttttgttaaaatatctttagacagaattttggtatatatatatgatatatatgtgattatatctacatatatctatatatatattctgtctaaaaattctcacaattctgtgtaaagatattttagacagaattaggagatatctgtatctagctctagatatagctaaatatatattcctttatatatctataaatctatatatctagctatatatatttagatatatcttgctctagatatatatctagctcttatatatagagagagagatagatatagagctaggtatagatatataaaggaatatatatctatatagtatgtttatgacctacaagtattcttttttgatcaggttttcttgaacatcagatatatgtatataccagaccattcaacatgcatttatttttttatttttatctttaaatagagacagggttttctcatgttgcccaggctggtctcaaactcgtgggctcaagtgattcacctgcctcagcctcccaaagtgctgggattacaggcgtgagccactgcacccagtatcaacaggcatttataagcataggtataatctagtgctcttgattgattaaaagtatattttgagaattgtttattgtgattgcttgaaaggtgattattataaaaatgagtaaaataatgaatcactactcccttttttgtttcttattttgtttgtttcttccttttgtactcaagtaacaaaaatcttaatttagctctgaggatacaaatgaagagtaatgtttcttgcccctggtcccacagttagtgacagacagtcactaaaaattgaaatgcagacagtccaatttcagaaaccatgctcttgaccaatacattgaagggtctttagctattagctgcctataaaatatgtggtcataaccgtagagaacacagcaaaataccacaataaaaaaggataaatgaaacttcactatttttcatggaaaaacccaacttgtattgcctgcttcctttgtcagctttgagaacttcagtatgaagttttgtacctatagctccagctcctgaaaaaattgttccaaaagcctcaacaccagttaaattaagttcctgacagaagttggaaacattatgagaatgacacacatggtttttgttcagatcatctggggaatgcacgtcacactggcatcaacctccaacagagccttgggatgacagaagcagccgttcggaggaggcctctccttgctctgttagtgaaaagttgagatttggatggtatttttcacactcttgacagtttatgacacgctgatgggatgaaacagagagactgcatactaaaagttggctgtgacctaacaagcaaagttacacaagtcatccctggtcacataagaggtttcacctcctcatttctaaaagctaattattactagctttttgtgattaccagatatacctcttccattttttatacctcctactctcttaacatggacagcattgttgaactcaggatctgaagtcagacagcattgtcttctttgagcctcaatctgcttgtcaatgaagtagggatgatgacaattctttccatatagtgtagttgtgagcatgataaaatgcctagtacagggactgtctagtaactcctaaccacaactattatgcttgttagtccccatggcctatttattttaagcccaaagcatcttctggagctaagcactgtaatgcccttgaagtgttttttaatctcttcagttctgtctactgcacgttgtggtcttacactgctcctggccactgttgagttattcctaaaggaatacagcaatttcagaggccttctgaagctccctgtcatgcctggcaatgtcattatataccaactgatacgtttttacttttcccaattcttgacaaccttctatagtagtatttcacatatctgcttggaaaaaatatttgggtaacagcttttggtattgctaggtgttttcggttttcttcttacctttttgtttatcgtagtataattataggaattaattaatttgtcgaattgtgttatttctctgctcgtctagcatcatcttgctgtatggagataaagagcagttaattttgagtaatatactagaagtttggtattcgtgactctcatttttggtgaaccactctactgactcaaaaacaaagatttttatgtgctttgaaattttaataatcaggtaatgtctaacatttcacattttctccaatagccactcttttttgcttttatttttgcatataatcctgctccatttctaaaattgccctttgaaattttcttattttcctacacattccagtttattactatgtggaagctgataatatttatactttgttttctaggaggtcattgatataaaattttattttatggttgattttcttgtgaatgggtgttttacacaattttcaagtaattggcgtggattttatgaggccagtcaaatgtagcaaacattataaaattactgaaaatgtatcagtgatgacaaatatttaatgattggtttattttgattggtcgtagttccatttttctctaaggcatcttccttaaaataagcatatataaatgacctttaatgtatacagcatgcattttttcattctctagcaatgagagcaagcacataatgttgtgatcactgttagcccatctgtgttttaacatgctctccttagttttattctcctgtgttgttcatttagtatatggcctcattcttccacttttttttctgttttgatgaatagtttggataataatgactgacccaaggtgtgcaaatgatttaagcaaacaaagcaaaactattccactgtcttttgaaatgtaggcttcagggtatcttgaattgcattcaaaaagataaaactcttcatcagaattaaaaacatacgtttacacaaaatcatgtacacaagttcatagcagcattatttgtaatagccccaaagtagaaacaactcaaatgttcatcaactgataattcgattaaacaaaatctggcataaccataaatggaatattattcaggcataaaaaggaatgaagttctaatacgtgttacaagttggatgaactttgaaaatatgctaagtgaaagaagtcatatacaaaagacttgcaaggttctatgccttcatgtatatgaaatacccagaataggcaaatccatagaaacggaaagtagattagaggttcctaggagccaggtacagaggggaatggagagttattgcttaatgggtatggagtttctttagaggaaaaaattctggagtggtggtggctacacaattttgtgaaatatactaaaaaccattgaagtgtatgctttaaaaaggttaaatggtaaatgttacattacgtgaattttatctctaaaagcattttaagagaagacattataataaacagagagtacaaagatcagaagacaaaagaaattggtggaaattatttgacattatgaagagcattgtaagtctcaatttcagggagaattgaccataattgacaaaatattgcataaataatatcagggatgcatttggataagaaacacatattacaatcctttataatgttaacttagtatgtattccagtttccacaaatgcactccatctcccccaaagtataggcaagtagtccttgaaagttggaatggaaagattaagcaacattttcataaatatgtcactgaaacaggctcacaaagcagtacatgccatataatgggaactggggtatagaagagaggttaatcaatgctgtatagctaaactggaagtaaagagggatttcataagagaggttccctttaaacttgttttggaaggatacataggagttctccatagtgtggataatgagggaacaatatgagcagtaagaactttcatctaacctttaacttctttcttctatccagaaagggttagtcaattttgcattgagcaccatcacccattccctaaatacaattcaaacggcttacaatccttgtttttttggtttggtatgtaaggtttagttttcctccaacttctgcatttctcttcaagggaggccattaaaccctgtttttatttctaatctacaaaagctaaaaaagcatatttccctttatgaatttttcatatgctcatctgatgcttgtgtgctctctgcccctttgcctggcctgaaatctgcttcttacttatctagttcatctcttgctatttgccaatgcaaatgtgggctaaaaccagctgaaacagtaagggcatgttagcagagggaaaaaggaaaggaaaaagaggcaaatagagtaagtacccaaagaaggaaaaagagcagagatcatagatggctatatgaggttcaggcagaggaattaaagaaagtgaagaaatggttgggaagaaattagaatgatgcctgtagactggaagcagtgaaggaaacaacatcagaaattggggcaaaagttaagaataggaaataagcttttactttttaactgtgctgcaaggatgcaaaaccaattaaattatttgaaaatgtgctttattttaggccaatctatagtatacatatcaaaacttagcttgctctggtgttcaaggtggctttatactgtttggctatcctgtgtttattatgccattaatccttttaactggtctggaaggcaatttagttttaagtcagttacttttttgaaatgaatcttatttataccaaacttctcatgtttgcttgaatttaatcaaatttttatataaagtgtaatttcaaggaatttataatggagcatcaagggaggagttggttatgtaatcatacttttgtaattttctattgtggagaaatttatctgcttagttattgaaatcaaattcctgcaatagagctattaaaatgggctagcatcatctttgagaatgttccttcttaaaggtaatataaattatatccaacaggagagaaaaagttaacttatgaggtgagtagactaagagtcattaaaaaaatcttgaggaagatttttaataatatgtaaaatatttctgatgtggtagcataaatatatattataggacattattaatagtaaagtgatccaaaacatataccacagggagatgacttgaaaaaaatgcattaatgcttcatcagttgttatcttagggtagtgggtaataggatagtttttattctctctatatatatttttgccagattatctaataagatacgtttttattaataataaaaagagagacaaatgatacaaattttagaatgaggactgctcagtctgcataaaaattattttcttgcaacaaagatgcactatggaattcaaaaatggtggtaactattgtcaaacatgtagagattggagttcctaactgttgcaggaagatctaagataaagtactacaagatgagtaacaaatacatccttaaaagcccatttaaggagttcttaatcgcaaaaaatttgaataggatttaatttgatgaatggtctagttaaccaaaatagtttatctggttcagttactgttgataaatatatttaacgacattgcaattgcatattattcagccacaacataatttcattaatgactcattaaaattattgtgaaaaggaaacacttaagattgcattggagcattgggatacctcacagtttgattttttcttcttcctctccctgcacattttttacttcttatatttaagtattctgctatgattttaaaaactagctacaaaggggagataacaaaatgagagccttctcatattaaaaaatatcgtttcttctcctaccccttatttttcagtgtatgttcacattaagaaactagaaaaatctagataagcagagccaaggtaattagttttctgtaattcttacacgaagagatcatcactaatgtcattttggtattatttactgagatttgttttttctacacttaaataggcacataaatacatgattatgtatttctcacactgttttatggcctgtatttcacacttggttttataatatgaacatcttccatgtcagaaaatattattcttcattatactaatggccaaatattattccatttgtagatgtatgtacttatttaactaattttctgtctcttgaagatgaattcctgcagtggaattgctgaatcaaatatgtatatattttgatgctttacggcattaatacattttcccttaagaaagttgtatcaatttatacatctatcatcctcagttaggtacatccttgctgactttgggtggcttttttattctgtttcccatttttataagcaaaaatggtattatatcttctttaattctactggtaggttgaacttttaaacatttaactatactgtatttctcggatctcctgccgtgtgtgtgtgtgtgcatacaccccctgccccccccacaacatacacatacaaatacatatttggactttaaaaaacactatgaacttgaattttttggttgtgtatacaccagtttctaattgattagaaaaatgagaaattctcttttttttaagtatataggaactaaatcaaaatattgtgaaacctgaaaagaaaataccacaaccccaagcagaaagggcttagttagctttaaaaaaactacatggttgttaaacaaggcttgtcaagctattaaaaacaagagtaacataaaacttacaatttctaaataggaccactgtttctaaatatgttaagtggtgtttaagtcagttaaatcttacagccaaaatgttgtattaatgcatgagtgagatgcattatagatgacttgataataaagttatgtatgtttacaacagagcattttgttcttagaacatagtgggagcctgaagtcttgggattatccatgatcataattgaacatatgtttagtttactctgggcaccatattttcaaagggacataaatgaactagagaatgcttaaaatgttgggacatggttaatcatagtgtcacatgagaaacgtttgaagaaaccagggataaaaaaagccggaatgagttaagattcaagcatggcatcattatatacaaatgctagatgagctatcaatgcagatttcaggttttgattgtacccctgagatggattaagcgtttgtaggtagaagtatgaagaatctaaacagttttgtggagatattcgtagttagatcaaacattcccctaaaaatgttcagggcacattgtctcactggaactctttgttcagaaactgaacatttacttagcaaggcttgttgtagagatgattttatcatttgatggtagttgaactagctaagttttacactcattttcagccctgaaattaaaacaaacttgaacaactggaggaatttatgccattatacacattgtaactctagcatacaatgcgtgaaaaatatgctagtttttttcatagcacattttaaaactgaacatttgaaatgggctgtgtataaagataaatgaggctgggcacagtggtgcacgcctgttatcctaacactttgggaggccgaggtgggcagaatgcttgagctcagaagttccagaccagcctaggcaacttagtgagacctcatctctacaaaaatcaccaaaattagcagggcatggtggtgcacacctgtagtcccagctacttgagtgggctgaggtaggaaggtcactggtgcccgggagatcaaggctgcagtgagctgtgattgtgccactgcactttagcctggatgacagagtgagaccctgtctaaagaaaagaaggagaaggagaaggagaaggagaagaagaagaagaagaagaagaagaagaagaagaagaagaagaagaagaagaagaagaggaagaagaagaagaagaggaagaagaagaagaagaagaagaagaagaagaagaagaagaagaagaagaagaagaagaagaagaaggagaagaagaggaggaaggggaaggtgaggaggaagaggaagaagaagaaggctgatctgattgactttgtgaactatttatattcatctattgttgcttgtattacattgcaagaatacaaaactaataaaaatgtatgaacttattgtaaacttggtaaattgagaataaagatctcattttttttgtgttaactttataagaatctgtgagagccagaatgatttcagacactgatgacaattttaacagaaacataggcgtttcacaatgcagtgggaaaattaatagcagaattagaaaataaattagaatagatattagttgaaataatctgaaatgcatttgaaaggaaaataaggaacagagatttcttagtccatttgtgttgctataaaggaatgcctgagactaggtaatttacaagaaaagaagtttatttggtttacagttctgcaggttgtacaagaattatggtgctggcacctgcttctggtgagggcctcaggctgcttccactcattgtggaaggtgaaggggagccagtgtgtacagagatcacagggccagaaggaaggaagagagatagaggggaggtggcaggctctttttaacaaccatctcttgcaggaactaaaagaggtagaactcactcactaccatgaaaatggcactaagccatttttgaggtatctatctccctgacccaaatacttcccattaggcccctccttgcaacattgaggatcggattcaacatgagattttgaggagacagacatccaaactatagcaagaggaagttgctataaaaacagatcaaagaaattgggaaagattgcaacacactgagatccttaaacagtttccatttcaaatggaatagataaagccatactaagtataaaacaaaatataatgaaaatgtatgttatcaaataagtggaaggattgtaagaagaatatgaatctggaaatcagaatgaaagaaaacaatacaagttttgttttgttggtaggaaaatgttggctggaaaatgttaaataaagatataaattagagaaaagagggatgtttgtcttgaatgttcattcagtgacatagggaaggtggtgaaaagcaagaaattccaaggaatagagttaaatgaaggcattttatatgagtattaaagataggtagcgaaattcaaggtacacagaaccatcttaaggtctgaaaggccttaaaaataatccaatcccatacccagtgaatggagcttggccctatattcttgagaagtgcttgcttagtatagactcaaaagtacatttcttataaggctatacatttatagttttaaacagcttcccaatgcctatcatacattcgctttagaaatattttagaaatattattttaaaaagaaatattttagatgatttctaacatgaatgatggagtgataggtacagggaaggatgagagaccaggtcccctaaaacccagagagactaaatgtcatttgggacttttgcacagaaagaggagcatggatttgacctatgtttctcattgcatagagatatcctaggaagatttcaaaacttttgtatgtttagttttctcatctgtgaaatggcgataataatagtatctataagacagagtttctataaggattaaatggatagtatatgtgaagaccatatcatggtgcatggcacatttatgatgttcattaaacgttgctgttaatatatgagaagggctgaagacatctgctttaagtcagcatttattgaacacagttcaggggaggaagattggattacataagatggtcttcctgtcccttcaaatcaacttgggatttttttttactttgggcagctacctttcaaccttcagtgcttcccgcttccccgtataaatataagagaaaataagataatgaagaatgaactataaaacaatttagaggcttcttgcaactatatctggttttgatctctttctaattttattccacttactgcatttctaagaatagtcattgatgtgtaagttattacgatagtggctgaataacattaaaaatattttatcatgaagtagttctttctagacatttgatgattgaaaatttcatactacctctcggaaacttggaggcatagttttcagggttacagaatgttcattattagtatttagtattttttagattaaaattcccatcttagggtgtaccttctctgagccagtcattttcttagattttgaaacttttctacacctaacacgatggagtaacagggactggatttatctttctgcccaaaataacaacaaaaatgtgggaaaaaatgaaacaacagtttctagacagtaaacaataacaagcagcacagagcattgatcccagaaacaggggcaatgaaagagacaagcgttagaattgtcctggcttacatttcaaagagagcttccgggccataatgcaggaagggggaagccaggtggatcctggaaatatccagagtgattatgagaaactgatcaggcttgtcttggtatgttatgacttgaataacactgcactaattgtgttttatggaattgacattggaacattcatatctttacatttatacgtacaacacctgttaatgaagtacttagtaaggtctgtggttgcagttacaggggaaaatcattaacgatgatggtgaagcaagaaaggctggataaaaagagagaaagacgatacgtgagacctaaataagtgaaaaaatgaggggtccattcaagagaatgaaaaagttcagtttgaatgaaatcacaattgtcaaatcagagacatgatgaaagaactacaggtaagccaggctacacagggtcttagagcatcttaaagatttgtgtattgttgcgagggaacaggaagccattgaagagtttaagcagagtgtgagatcattgagtatatactgctggggtctttggatgctaactagagataaccattaaaattttctgacttaaatctgatgagaggaaaaaacttatttccctttcaacagaaacttcgggtctgaactttgtagagtttattgtggctaaaatgaccacgtttttcaaagaaaaatcgacactataggattttttaaaatgacatgtgaaagccttacattataaattaaatcaccatctcatattcagctgcattttttaaaagaatccaactatatatattgagtgtcttggtcactttggtcctgacttatactgtagctgtacttttgaataactgcatctgtccatggccactgagaatctagaccccatcactgcagatgtgatgatatttttgttattcttatttctttgcttggatttatgtaaatttttttacccttccagcctacctaactacattataatttttttggtatcagggagtatataaaggctgtgttcgtccccagtgctaagtacagaccctaggcattcaatacattcttgttcaaatgaatcttatggagaattccaacccatataggagaattctcactattcaagaatttatctccaaattttcagcatcatttaaaaatgacaaataaattttgacatgcaattagactagcagagtcaccctagttacaactggttcctatcctctccccctttagatatttgaagaaaataaagtatgttaaaagaactcaaaataaatttttaattatgatattatgattgatgattattgaatgcatgctagcttttttccctactgtttattctatatttcaccataggataatgctaatataaaattattaaaggattaattcactgaagtccttatgataaagtatttggggatccctaaaattcttctgagttttaagtggcttatttgtgttgatttgttttgaactataatattttattttattttattttatttattaactttttttgagatagagtctcgctctgttgtgcaggctagagggcgatggcaggatcttggctcactgcaacctccgcctcccaggttgaagagattttcctgcctctgcctcccgagtagctgggattacaggcattcgctaccatgcatgactaatttttttgtgttattagtggagatggggtttcaccatattggtcaggctggtctcgaactcctgacctcaggtgatccacccgcctcagcctcccaaagtgctgggattacaggcgtgagccaccgcgcctggcgaactataatattttaatgccattttttacagtaagtaaaatattaatccatcacataattaaccgttaaaatgtctcatgcccattccctgtctcatttgtaaaaagtggtacttgtattgtcacttctacggcacttatctgtcccacacattttggcaacagattatttttcttctggattcttctctaatagtgttatatttataagcttgtctcttgcacaacagaatgaacttcacaagggcattggcttttcttctatctcttagtgaataattgtcacttaggatttattgaaacacagtaccaaacatgtattaggtaccccactgatatttgttaacttgaataagttgaatatgacaactttgttttgctttgttttattgaatttttcaggattatttgtatgcaataaaatgctcatatctgaagtgtacaatgtgttaactttttgacagccattaactactactcagataaagatatagtatatcttcataattttccaaagttcttttatgtcccttttaggtagtagtctccactgtaccccaggttaccacttttctgactttttatcccttagagtatttttacttggtctagaatttcttataaatagaagcatatagtatatactcttctttgccttcttttgctcaacattttaatattcatacatattattctatctatcagtagtgtgatctttttcaattccagatagtattctacagatgaatatatcacaatttattccattcttttgttgatggacattttggatgttcccagtttgggactactataaataaaacagttatgaatatctgctgcaagtcttgttgtggacatatgcactcatttctataggagtaaaactgctgaatgataggttaagtatatgcacatattcattagaaactgccaagctcttcttcaaagtgattgtcacatttacactgttaccaacaatgcatggaggtttcatttgtgtccacattcccactaacatgcgtattgttattcttttgaccttcacgattcttgtgggtgtatagtgctattgcactgtggtttaacaagagttcttgaggactgttgattgcagatacctaattttaagagaagtatgtgtaaattgtgcatttttcaaacatatttttgtacaaaaagcagcaattactttgtctccctgtgcctttgctattcatggaaaaacgggaatattagtagtactatcttatactgtgaccctgaagagtaaatgagataaatttagcacagtgccagacacatagtaatcactttatataaaatgttaactattattgtgagtaaaggcaatatattgttttttcatcattgttagtattattgagaggcagaatggcatagtatttattgcctgtgttcaaatcctggctttaccacttactaactaatgactttaggcaagttacttaatttccctgtgtctcagtttcctcatctatacaatgggaataatgcagcacctgtttcataagattttgtgatactaaatgagtcaataggtttcttggcacataataaacaagataaatgtgttggctgttattattactaacagggtgctgttattactttatatctttcttacgagtatatctctttaaagtagcaatttatttaaatgttttcattttagcatattgatagaatattaattttaatccagcaatccagtttacctaaatattctccaaaataaaagttgaaactttttttttaagtgtaggcagttctcttggtattgggtttgtgtcaattatctcttgctgtgtcacaaaccccaaaactcagtggcctaaatcattggccactaatttagtgtacaattctggaggtcagcagttttgactgggctctgctgatgtttaccctggtcttgaatgcatggatggtcagctctgtttctagcagttgagttgcttcagttagtggaagcatttgaaccatacatcttatcagccagccagctttccctagcttgttcccatggtggtgaggcaggccaaactgtaaagagcaaagagcagaagcaaggtctctggaggcccagccttagctcttgtgcagtgttgcttccaccatgttttattcctagtgtaaatcataagatttagggacctgagaaacagacaaaacctattgatgtcaggagctgccaagttacattgcaaaggaaaggcagaagagttgtgactttttttttttttttactgaatacctcactcaagagcttgttaagaataggctgtctctggggtaggtgcggtggctcacgcctgtaatcccagcactctgggaggccaaagctggtggatcactcgagctgtgaagtttgagtccagcctggacaacatggcgaaacccagtctctgcaaaagcatacaaaaattgctgggcatggtggcagacacctgtaatccaagctactcgacaggctgagatgggaggatcgcttgagcctgggaggcagatgttgcagtgagccgagatcgtgccactgcaccacagcctgggtgacagtgagacctgtttcaaaaacaacaacaacaacaaaaaagaataggctgtctctaattctttctttttttaattattaatatactttaagttttagggtacatgtgcacaacgtgcaggtttgttacctatgtatacatgtgccatgttggtgtgctgcacccattaactcgtcatttagcattaggtatatctcctaatgctatccctcccctctcccccaaccccacaacagtccccggtgtgtgatgttccccttcctgtgtccacgtgttctcattgttcaattcccacctgtgagtgagaacatgcggtgttcagttttttgtccttgtgatagtttgctgagaatgatggtttccaatttcatccatgtccctacaaaggacatgaactcatcattttttatggctgcatagtattccatggtgtatatgtgccacattttcttaatccagtctatcattgatggacatttggtttggttccaagtctttgctattgtgaatagtgctgcaataaacatacatgggcttgtgtctttatagcagcatgatttgtaatcctttgggtatatacccagtaatgggatggctgggtgaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgatcgccattgtaactggtgtgagatggtatctcattgtggttttgatttgcatttctctgatatccagtggtgatgagcattttttcatgtgttttttggctgcatgaatgtcttcttttgagaaatgtctgttcatatccttcgcccactttttgatggggttgtttgtttttttcttgtaaatttgttttagtttattctagattctggatattagtcctttgtcagatgagtaggttgcgaaaattttctcccattctataggttgcctgttcactctgatggtggtttcttttactgtgcagaggtctttagtttaattagatcccatttgtcagttttgtcttttgttgccattgcttttggtgttttagacatgaagtccttgcccatgcctatgtcctgaatcgtattgcctaggtttttttctagggtttttatgtttttaggtctaacatgtgagtctttaatccatcttgaattaatttttgaataaggtgtaaggaagggatccagtttcagctttctacatatgactagccagttttcccagcaccatttattaaatagggaatcctttccgcatttcttgtttttatcaggtttgtcaaagatcagatagttgtagatatgcagcattatttctgagggctctgttctgttccattgatctatatctctgttttggtaccagtaccatgctgttctggttactgtagccttgtagtatagtttgaagtcaggtagcgtgatgcctccaactttgttcttttggcttaggattgacttggcgatgcgggctcttttttggttccatatgaactttaaagtagttttttccagttctgtgaagaaagtcattggtagcttgatggggatggcgttgaatctataaattaccttgggcagtatggccattttcatgatattgattcttcctacccatgagcatggaatgttcttccatttgtttgtatctcttttatttcattgagcagtggtttgtagttctccttgaagaggtcctttacatcccttgtaagttggattcctaggtattttattctctttgaagcaatttaattatttcagtggaagttactaaagaacattgaagtttgttagaaaaaaagaggatgtcactgtaatataccataattgacaagtaataactatttgagtactaactggaggagaccaagcttaaatggttattcctgggaagaatgatttgtctcagggtgcgtagatacaaatgttaccaacccaccatgacaaagtttaggcaaatacaaagagcaacactaactttgatattgtatagaacaaaagggcacaagaagaataaaatggtccacagatattgcaggtgacatgtactatatgcaacaggtgtttgtttaggttatgttatcaccctttgctctgaaaaaaaaaaacaacaaaaaactataattccaatgaggtagaaaattggattgtaacagaaaactcacctttcagatgttcttgaaagatcttcaatgtagtattctaaaagttctattgaattattttaaaccatgttatttctattttcttctgaaaagaactaggtgacattaaagaagtctggatagaggaatggaaacaatttcaaaaagtctttcttcaggcctttgatcataggcattattttcaatttggatgaactggggtattctgactacctaagaagtctattgtcaaaatctgaatttattctgcaatataaattcagtttgggtactttaaatgtcaaccgtaatgtctttcaatcagtttattactgagatttttccagatttgatgtgtggtatcaaataacttacattatttgcaactatgagaatgcacagaaagcttcgtaatttacatctaaaaggaatgcaggacagatttggttttagttttattttaaaattttcatcagaaggaaatcatctgtatacatcatactgttgaatatttccaaatgatgttaaacattctgatgctttaacaattacattaaaaattacagaattgatttaagattgtgttaagaggttatgttgttgcttttgaaaacagtgagataagataaatcagattccatctcctcagtgctgcctatgctgacctgcctatataaaatagcaaatcccatacatcgtctgtctgatttcaccctgcccatttaatccccacgcattttagacttataaaatactgtatatttttcttacttgttatttttattttccgtctacctacaaataaatttgagcttcatgcgaccagaggtttttgattgttatgtgttttggtttgcttgtttttgtgtgttttgtttgtttgttttgttttgttttcttttgttttgtctgagacagagtctcactctgtcacccaagctggagtgcagtggcacaatcacagctcactgcagcctccacctccttgggctcaagcagtcctcccatctcagcctcctgagtagctgggaccagaggcacatgccaccacacctggctaattcttataggttttgctagagacagggtttcactatgttgcccaggctagtgtcgaactcctgagctctagcatcctgcctgccttggcctcccaaagggttgggttttcaggtgtgagccagcgtgcctggtcatctgttatgttaagtgaagaatacttagcagctggaagagtgcttggcacaaagtgaacactaggtagatgttggttgaatgaacaattaggttgataaatgaaggcatttaattaagaatgtaattagtagcaaatcacctttaaaaatatatctcattttatgtttaaaaataattacaaatgtataattttaacctcctcctttaaggttcttgtcgtcttgtcagtcgaattaaaatctagccttaacttttttcttgaaatttaacaggcttattttcacacctggcttttgttcttgtagttgtaattagtcagaattagtatattaatttttaaacacacactacctcatcttttgctctacttatcaaattatctaattaaaccttgaattttcagaaaatagtttcccaattgcattctgtgtatatcaaaatgcccttgaaaaaaatggaatttgaaaatttctttcttctgtcccccgactcttgcctctttcttagtctctccgtccatatatctctccttttctctcatacaatttaatagagaatgaatttccatctttggtacattcatattaaaaatctaatgccacatatgtggaggaaaaatcatatagctacatttcaaccaaaaaagtattgtgtatgaaatatatattctatagtttacttagtgaatgttattcctgaagactacaagtggcagcaaagaaattacgtggcatatatgtgtagattaagcatggaatgagtattgttttaaaattaacctattacctgtatggccatgatagtttttgtgaggagtaaattaatgcatatatgggagaaggctttgtaacatgtgaaacacttggtatatgagaatttgtattgaaatgattagacattaaagcatcttgttcataaaattttgataatcttcttttagccatttcttcaaagtcacttctatttttgtcaaatttcacctgtcggggggtttttagcttctgacctcagtattgtttcagtggctgagattaaacagcattctgacttgtacacagacaagtaactgtgctaatatccagtgaaattgaaaatggacaggaaatctttatacagctaaggaacaaataaatgataagagaattaatccagcattattgttcagaaaattaaacacttgagcagattaacaaaacacattataaaatttggattatttgtgaagagttgcaacatttggggaatgtttttattaaatgaatcttttattttactggatgctaatgaaaacaaactcattattttttatttggggtacgagtgttttttggtgacatggatgaattatatagttgtgaattttgagattgtagtggacccgtcacccgagtagtgtacgttgtacctaatatgtaattttctatcccatacccccaccctctttcttctgaatcttcaaagtccattatatcacactgtctgcctctcaagctcatattattgaagacttttccctataattttatattatttttatgccataatctgatgcttaatttctattttatttattaagtatgtttattttagggttaacattcataatgatcataaaaatcaggtaagctacagtagatgtagaaatttaacgtgtgtacacaacagaatatttcatgaaatttgtgtttaaaaacttgatttacatgattaaatcatttatgtagttttgaaatcagtgttatattctcctcaaaataaattgcatggaagttttaataggaatctcccacatacagtataattatttatctaaaacataatagtaaatatgtttataaattttactcaagtttaaatataaatagcgtttaccgcattaaaatatgaatttatcttattttattacatcaaattgtttgtcagggtcatattttatttagcgttccactaatgactacttgaaataaatcagagaaggtaagtcccataacagcttatgatctaggtcagtctcttcagatgaagataatgaagtgatttgaaaaactgactctattactgaatagtggtatgcttacttgagatagattatttatagcccctgcaaacaagagcagagttattttatattactgagacattttgaacaagaatgttagacagagtgaattgaataacttttcttaggatttagctcattttctatcatttcacatgtgttgacttttaaaaatctatttttaattatttcaactggcaatttaataaatacatttgcataatgtcctgaaagttcagggtagatttgtatgtgtaacgttctcaaaatagaggggagaattgttgggaaagctttgcatgttttatcttaagcaatactttttccttaaaaccaaagacattgaaaattacagccacaggtggatgtttgttttgagctaaaatagttaacagtctcatttatgagtccttgctctttccatttagccccatcaaaagggatgagtttatttacacagtgaccgtcttttttttttttttttttttttttttttttgagatggagtcttgctctgtctccaggctggagtgcagtggcacagtctcggctcactgcaacctctgcctcccgggttcaagcgatttccctgcctcagcctctcgagtagctgggatcacaggcgcgcgccaccatgccatctaattttttgtattttcgtagagatggggtttcaccatgttggccaggatggtctccatcaacagaccttgtgatccacccacctcggcctcccaaagtgctgggattacaggtgtgagccaccgtgcctggccgatccttctttatttttaataaaatctttaatcagagaaacctggaaaatagcatgaaggcgtgtccatttggtggcttccagataggaacttgatttacctgcaggaagtgacagcttagtaaatgatccttttgaaaatattgctgttattactctttaaatccggatttgtattaagccatccttgctatgtccttgatccttctttgaatccattgcagactgaaatatctcaatccgccagatgttctggtactgaacaatagctgtacaataataatgatacaatctcaaacacatcacagatgcactgttagtatccattactgtagaagaaaaaactttgttagcacacgctaattacttctgtgatggggaggaaaacaaaaatccatattaatttatatctttatggtctgcattatatttcttcatgaataatctatcttaaccatttattaaactatgaatacatttttataaatctggttgacatttaggtattttattaaacacaataaatgccagaggaaattgaattaagaaagcttgtaatacgctttactactagttaaaaaaaatttgtagctgtaaatggttctgctctatatcaagaataaatctgttcccagaccacagaattcttgttctttttcataccagaggccctgatcttttttgttgatagctggtttttaacagcttcaccatatgttttattccttttgatttgtaagaaatttgattatcagccttgaacagaaatcataatcacagcaaaaggaggcaagtaacttggggaataatacagagtcatttgaacagcagtgtgaagtctgagtttaactgactcagatgcccactctagtagagcactcatcagacttcagaccgaatccacttcggacagagaagtctccataaggtattcagactggcttcccctgtctttaaaacaaataaataaactctacttaatataataataactgaatttaagtatttccacagattagcaatttacgtgagagaaatcagcaataacatcaagcatatagcctgaaagtctgaaattgatgagagggatacaattggagccactagttattaatcatacgtgtgtatgtgcatgtgcacgtgtgtgtgtgtttgtgtacaattctgtctaaattggaactgatcttaaacccatttatatttttttgtggcagaaattttatgaggtaggcagggtgaaggaaggcactattaactttgactttataaaacttagaattgggctgggcacagtggctcatgcctgtaatcccagcactaagggaggctgaggcgggtggttcatgaggtcaggaatttgagaccagcctggccaacatggggaaaccatgtctccactaaaaatacaaaacttagccggcatggtggtgcacacctgtaatctcagctactgaggaggctgaggcaggagaatcacttgaacccaggaggtggagtttacagtgagctgagatcgtgccactgcactccagcctgggtgacagagcgagactccatctcaaaaaacaaacaaacagacatcttagaattgtttggctctacgttggttatgtaatttgaaacaaatatatgttgtgggataatcttaacgtgagctaactggtatatattaactaaagtcgttgaaatatttaattttgaaatgcaataatattttctcaaattaatgctcccgcctgaaaatctgtgagccagatagtaataattaacttctacctctacctaggattcctccacctccaactattttatcattggaaatgcatgaaggacaaacaactcaccatttctgcccactttagatgctaaggtgatattgatcactttgtcccatgtggaagaacatctaatgatatgttgggatgtctcatccataagtttattagtcaatcttatgttttatttgtacctagcaatgccaagcacactgtatgtgcttcattaatacttgtgaataaatatgtgaatgaaatttcaaaaaccatgaggtgcccttttgtggattcaatatgttttgtataatggtggagccaccctggaagaagctgctttgtttacccataacagcttatatttattgtgtgagacattgtccttcacagtttacatatataatgatgatatagtcttcaagagtatgaagtatagatactgttaacatctgttttcagataaggtgctggcacttagaaaagttaggtaacttttcaatcattccagatttcctaagacatagagccatggcgtaaatctgtgcacttgttttaaaataatacagctttattgagatgaaatttatataccatatagtttacttttttaaagtgtacaatttagtatattcagagtgaataataattataatactaattcatcattacaatcaattttagaatgtttttatcacccctgccccccaaaattgcttccactcgtttcccctattcactccccaacccagctctggacaaccactaatccactttctgtcccgacatttcattaaatggaagcaggcgatatgtggttctttatgactgacttatttcacttagtctattggtttttaaggttcaccaggttatagcatgtatcaatttctttttattgcagaaaaatattacattgtatggatataccacattttatttatttattcattagatgatggatattaatcaatgctcatttgaccacagctgtctgttatctgtctttctcatgactttggattaaattactactatagcaggtctctcataccttgcaatttcagcagctccgttgttcagcgctgctagttctctttcagcactaccgcagaggacagctccaagtttatggtttctgagtcccacaggcgcctctgattctgcctagctgagatcctcagagaggtataataaagcaagcaaatctgggtaggagcacagcgactttccctctgtctgcaggtatttagagctgattgtatcctcagaatactgtgtaaacggtatattttgtgtcacaatagattatcacctttggatttttcattttcaataggaattagattatggcatctttggttgagtgttatttagatttcctgtaaatctaggttacatataagtaggtaagatgcacagtgaaattcagtccatctatcttttgatgggttattcgaagtagtagtattaaggatcatttggtgaaattacttgttcattacattgtaatgggaagttagaagccaatatgtaagtagataatttcttttacaatatattttcttttcaagtttagatttatatgcttattaactttatccttcatatcaaattaaatttgttattgaatgccttatgtaataatcatgtagcttagttacaatgctcaatcttctgtcataaggtatatttgtatacttaagaatgaaattaattacacgttataaacatcacagtggaaaatattagttggattattaatctacaccatttacattctatgaaacatatttagggccagattctattagtacttttaaaaattttacatgatccttgacattgattatgattaaagacagaccaaagggaggaaaggggtgttatatcacttatgaggaagacacttaacatcttttcgcttgagttcacaacataatttagatgaaacactgttggccttggtaattaggaaaataataaaggcgaggagttggctttatcacattgtgtgaactgacccaacaataatgtgtcagaaatacagcatattcccagtttgtttgctcaacagaagcagataaacagaaggagctttctctaagccacatacattacaatggagacataaattacaatggagctttttccattgtaatttatgtctccattgtaatgtatgtggcttgggaccattgtctttgtaataatctggtaagattgtatcttttgaaaacatcaaatgtgttattttttcaaagtgatttggccaacggggaaattatgcagttatttatttatttattcataagccactaataagggcaaaactgagattctaaaatgattagaataataataagggtgttaaaaagtgatttttcacttcctatggcaagcagaattcacttataggtccatttccctggtgctgctatgacctttatattcattttatgctcagagctatcaattgttttcaaatgttgacacttgaaaaatcgctgtatgaatgatcatgtagttcccacagttattggtgctagaaatttctgattctactctggcctgggcagctgtcagcctagcatggcagtaagtagctttcttacctattagagaatgccctcagttcaaagaaaggagacatatgtgacaactgagagggttaattgttcctataaatgaattcattgaaaagtatttcacagcacacttgtttcaggcaagtctctgagaattattttatttattgtttttttggttgatcatgaccttttattgtgtttatttgcttaatattctgaatcaacctattgctgaatttctaagtaatgtactttattagttgctaaatttaacttatcctttcttatataccaatgatatagtttccaaatcttagattcttcttgaatagtactttctctttatgttgaccaattcatatactatactttgatgaaattatttttgtgaatcttctttttttctaaatgagatattcatgtatgataaacataacctttttaaagtacgcaagtcagtggtttgtagtatattctcagattgtgcagccattatcattattaaattccataatattttcaaaaccaaaggaaacccaggacccattagcagccactccatatttacctgtccatcaactcctaacaaccaccaatgtacaatctgcctgtatagatttgcctgttcaagaagtgtaacacaaatagagtaacattatatgtagagttttgtgtctgacttctttcagttagcatgacgttttaaaattaatccatgttatagcatgtatcagtacttcacttatttttatggctgagttatatttgattctatggatatacaacattttgtttattcattcatcatttgatggactttggggttgtttttattttttgtaattataaataatgttgctttgaatattgtgtacaaggttttgtgtggaatatgcttttattttgcttagatgtcctaggagtggaattgctgggtcatatggtaaagctatgatgaactttttgaagagtgataaatgaaactgtttaccaaagtgtttgcatcattttacattctcagcaacaatgcatgagggtttttatttcttcccattcttgtcagctctatatgttgctagatttgtggttgcttgttttttaactatagtcatctaagtgaatggaaagtgtttctcattgtggatttgatttgcatgtctctaattgctaatgatttgagcatctttcatgtacttgttggacagttgtgtatcatctttggataaatgtctgttcaaatttttgtctattttttaactgggtcttttttcaatatttaattataagagttcttgatatattctggatatattttggctatgtagtctaagtcgtcagacattgttttttttcaggatgtttcagttacttggagcgtcttgaatttccatatgaatataaggaccatctttataatttctgcaatacaacaaccttaaacttttacaaggattacatagaatctgtaaatcaatttggaggtattgcaatcttaacactagtaaatattccattccatgaacacgggatgtcttcccatttatttaggtctttttaaaatttctttcaatgatgttgtctagttttcagtgtacacatctttaatatactgattttattaaatttgttcctaagtattttattatttttgatattttaaatgaaatttttttatttcatgtttgaattgctcattgctagtgtatagaaataaaacttatatttatatattgaacttgtatcctagaattttgcttgaacttgtttattaaatctaaaattttctgtggattccataggattttctatgtagaagaaattgagatagttttgttcattccttccaatctaggcacattttattttattttatttttcctaattgtcctagttaggacctccactacaattgaattgaaatagcaaggccgggcgcagtggctcacgcctgtaatcccagcactttgggaggctgaggcgggcagaccacaaggtcaggagatgaagaccatcctggctaacacggtgaaaccccgtctctactaaaaatacaaaaatgtagccgggcgtggtggcgggcgcctgtagtcccagctactggggaggctggggcaggagaatggcgtgaacccgggaggcggagcttgcagtgggccgagattgtgccactgcactctagcctgggcgacagagcaagactccatctcaaaaaaaaaaaaaaaaatagcaagacaaccattcttgtcttctttttgatctcacgggaaaagctttcatcttttactgataagtatgatgttagctgtgagatgcccatttctgcaggtgcccttttttaggtttaggatcttccttccaaggattttcctttctagttccttgagtgtttttttatcatggaagagtgttgcattttttaaatactttttatgcatgtatcaaatgatcatgtggcttttgttctttattgtattaatatggtgtgctacattgattgatttttatatgttgaattaatcttgctttacttgaataatctggtctatatcattgctttacttgaataatctgttgtggtcataattctttttatctgttgctagatttggtttcttgaaaatttttgtgtctatcttcataaggagtattaatttgtagctttcttatgatgttcttgtctggtttgggtatcatggtaataatgggcttatgtaatgagcctggaagtgtttctttgtcttctagtttttgaagaatttcaataaacattttgtggaatgtaccggtgaagccttctgctcatggacttttttatgagaagtttcttgattactaatttatttactttccttgacacagggttattcagattttctgtttcttcttgaataaatttcagtagtttttgtctttctaggaatttttctatttttgtctaaattatctaatttgttgataacgtagtggtttatagtaattgccttataatcctttttattaaaatatctgtaaattctgttgttatccccccttttattctcaattttaggattttgaattttctcaattgttttgtcagtctagctaaagttgtgtcaattttatttacattttctaagacccaatttttgttccattgatttttttctgttgttttttgtttgcaattccctttatattttactccagtctttattattttctcccttctgttgctcttcttttccagggtttcaaggtggaaagttaagttattgattttaaatttttattctttttaaatatacgcattcaaagctttacattttctttgaagcacagctttagcttcatcttttaagttttggcatattctgttatcattttcatgcatctcaaagtctgaaagtaatttcccttttgatttttttcttgaccccttggttatttatggataagttatttattttccacatatttacaaatttcccaaatttgcttttagttttgattgctaatttaattttattgtggtcagagaacgttttatgattttattccttttaaactcattgaagtttgttgtatcattttttatattatttataaaaccgttaatatttcaatatctctaaaatgtaggaaaaatgtatataaaatatagtctgtagatcttttacagtctaagttgaaaaatgttttcaatgcacttaagaagaatgtgtattctactgtttggagtggagtgttctatacctgtttgctggtctagtttgtttatggtgttaaatcttctggatcctttttgatcttctgtctgattttctttccactatttaaagaaggattttgaagcttttcaactattattgttgaattttctatttcttctttcatttctatcagtttcccttcctctattttgagtctttgttttttaggtgcgtgtaagtttataggtattattttttactggcagattgacccttttctcattataaaatctgttcatctgtactaaaatttttggcttaaagtattgaagtgtgatattagtaatgctgttccagctctttttttggttactgtttgcatatgtccttttctgtcttttaactttcagcctgtttttgtctttgaacctaaaatatttcagttgtagacaatatatagttagatcatgtgttttttaaaagccagtgtataaatatctaccttttaattacagcgcttaatatatttatatttgctataattacaaagtaatattgatgcctgtgtttcctacttgttttttatatgacttatttctttttgtttgcgactcttgtttcttccccatttccatcaacatccctgcagtccaggccttcacatggcagggaaatgacagatgtattataccctgtttaggtaattgttgccatttcagaatggagtcccagtgatgcttggtcttttaatatatgagtggaaatcagaatttttaagtttttggaacacttcaatattttaatgttgacaactaatagagtttttaaaaaatacattagacatagtttgtggaacaagcaagttatgtctaatgagcacatggaatcaaagagaaaccatttgccacctctgttttccacatgtggaaagtctcaggaccagctcaattctggcatgcttgctttcatatatgttgtttactgatacttacataaatatttcctatctgtaaaatagtgggaaatagaaatagtaaaagcttacttgtattaaatactttatggtatgctggtgatgtttatgtccctacctctttttatatcaacttattttagttttcaggtggaatatgttcaaattttatcagactccaatcaaatactgcagtagtttctaagtcttagagctgttggtaccagatggatggatggatgaatttgtgttctcatgattgagacattacgataaggggaaagagtattacagcaacagacaaatgacttggctttagccctcaactaatttattgggtgcttttcaagtttcctactcttataaacttcagttttctcttctataaaatgaaaagattagccttgatcatttttaaagtcccccaggctaacattggctatgactgacactgtggagctatgggatctgcatgagaaatttttctcagtcagtacagcatgcacaagggagaatggctttattttatgtcacaatgcagaatgtctgttgtttgctatccctaaaagtgatgtcctctatgatttacaaagcctatggagacatttgcagcataagggaccgccttcccactttttcacctcagcacatgctacctcatcacactttctccttatttttagttttatgccatcatctgcaggtaatgtttgacctaaaacctacaccattacttgttcccttttaaaaatggcttcacttgtaccccaatggcatatcgagcacctgtgagacttcaggtgttgtttgatagtttaactaaaattaccatgattatctgtgtatatgaaaggcttttaaccctccactacctaaaactcactcgttctgtgctctcacttgttttctattataatacagaaataaaaggattgcatttgaatactgaaaaattgtcttactgccagtgcttgagtgcacaaatccggttaactctcaaatgatagctattcaacctgtctttcaaagcagtagatgtgttttgaaaatttcacatttgatttataaacaaaaagactcccttgactttatcctcctgttttccagacttttttattttttaagaatgaaaaataacagctaaggaatgtggcctggaatgaaaatatccgaatcagaagcaaacagaataaaaacacacctacctttccccctgaaataacattaatgtcttattggatctgacaaaattcaatgaatttctaattaaagactgtttccccactcctgattcaacctgtcctgcctagcagtagtagcaagaatgagtcatagtctcttcagaaagtaaagcattgcagattgagttaatgatgaatttttcccccttgatttgaaatactcttgcctctgtctttccgtcaaccctagaatagtaccttgatttgtaattttatattgattttaatttgcttcattatttttcttgtagccattaaaaatatatcaaacagaatcatacttgacaagaagcataaagaaaccttccactgatactggaactgttgggttttctttctactgaagcttttaatgattctttgccaatctactttttaatcatctgaagtaaaagtagtataaagcgtgttacttgaagcattcttgacagagaatgcagctgtgcacctgtgagaacaaataactgatgttccttttggtcactcagcaggaatagcattttaataggtttcttcactgatccggcatgctaagagtagtttgtagtgtgcatttaatctactgtctgtataggtagctcattatgtcaaggaaaggcttatgcacatttataatactttgtaaactgtatgattagatcattatttagaaaattgcttgtatgggaaatggttgaatagaaacatgttttccaagcaattacgtttccttcttaaaactctttgtccttcatttaaagataaacagaacttcttaggtaacccttagatattttcctgagttatagagttttggaggattcttaaggatgtgtatctgacatattgtaagcacgtaataaatatttattaaatggatgaatgaaactaattaagaaaaaagtgagagtttttttttgatacgataaaacttttttttaagataaaaatggcactttgggaggttaaggcggcaggatcactgagcccaggagttcaagatcagcctgagtaacatagtgggaccttgtctctacaaaaaataaattagccaggtatagtggtgcacacctcgtgaggccaaacatattgctatgaccagtggaataccagtggaaagaacatgaatcacaacaggatggcaggttttaaaaccagttgctaggtctccttttattaatgttgtggagatttcagaaatgtttattaatattaaatagttttcatcctcctgaataattagggcaatcaaacactgccaaccaacatttgacatacagcataaaagtcaagtaaattgcatttatttttgctgttaatattggactatcactaagcaaatcttgctggtgtaaacttcttagtcattggccagtttgttacaaagatctatgaaaaattcttatcccagtgagccaggagaaacttctcccaggagatcctgaaatctaaagtaggaacacatgcctctctatgtgacatccattgtgacacagatggtttggtcctttccaataataaaaaaaatggtgcgttttggaatacttgtgctttttgaaactataaatcacattatgagtataaagaacacagcttttgaaaaaaataaacttttttttccaaatgttggagaaaccagtgtttccagttgattgacctaagatgggtgttttaggcccttttggatttttaaactgtttttacgtgtatgtttctgtgtgtttgtgtggtggcttgtatttatggatgtgtgctgttcgttgctatgataggaaataacattgaaaactggagttatatgttattaagaacataacaaaaataaaaacactgtgtgaaaatctgtgagttaggatcaaaaattttatcttcaggcaaatatatatagccttaaaaaagttatcacatgacatattgtaaataaaatgaagtaatgttcaacttgaaaagttagaaaagacaataaaactattggagtaagtaaaataattaaaagatgattaaataatgatcaagaaatagaaacaaaaaatagaaaacaacagaaaatagattagatagatccaagaactattacttaaaagcaagacgtacataaactgtttaaacgtcttgtacagaaaaacaaaaatatagtcattataagaaggggttatatcaatactgaagggattaaaaatattaaggaaaatggataatatttttatcaatgcaaattatataaattaactcatgtttaaaaacattaataaacaagataacctaggaaaagaaaccctgaaaagttgtcatttttacctccaaaaaaatgcagtgtgctgtcatcttaatggataaaccactttaaattattaacagataagcaattttatggtaaaaaaattgattcagaaatagaggaaaaactgaaaagtgtcctttaccaagcagcataattttaaacacctgaaacagaatctgacgctcagaataaatatcagggccggaggtggggtggtgattctgaaacccctgttagccattagccatgctcatacagtcactcccaactatatgtttgatatactttcttaaccattcctgactgaaaaacactatagagtaacaaaaataattagtagtgtagtaatagattgatactttatatgacgcaaacctaagacaatatagtacttaaggagaaagcatttcaggcatacccaccaaataccccccaaaataaaggatgcttcccttatactttgtttaacttagtgattcttaaagtttttctgtctagtaagagatgaaaaaggaataactgtaaaattggaaaagcatataaagttatttctgcctataagaaatatgattatgcccttatttatacctatgaatctgaaaactttaaactaaaaatacatgttttataacaccttttaaaatgtactgtttttatttaatttcagttttcttgtcaaaaacaaacaagagtgtacaattaaaattgataacaacaaagtataaaattcatatgaattgacttaacaagagatgtccaattcttatgtgacagaagccataataatttgccaaagaacatgaagtttcaataaaatgggaaggttaaatatgatacagaatttagtttcatgcacacacatacatatgtatatatattagaattctaaaattatcctgaagtacaactggaggaataatattcaagggtagccaagggagtttcgaaaataactaaaaaaattttttaatgaaatgtttatataatattagatggattagacaaatgaaaaggtcaagaaactgacctacatacatattagaagtgaatttctgttgaggttggcatttcggtgaagctgtataaatgtggattatatgagcatgatgtgataataggtgaaagggtagggcaaatcattatctccctgtatatcagatgaaactcagatttattaaggaataaatgttaaatatataattacaacagaatccaaacaaacaaggtaactatatgatttggggataaggtgagcctttctttaaaaaaaaggataaaatgagatatctatcgatttaatactgtagtaatttgatacaaatgtaaaagaaatacaattacaattattaacaaaatgagaaaaaatttgcaaatcttaaacggaaaaaaattgcgatatctctaaatctaataagcaaatgacatatcaattaagcagcaaaatatgaacaatcaattttgaagaataagaaatacagagagcttcttaacagcttcagtgttaatcaatgaactgttcatttaagttattatatcatgtttcaggtatcaaattggtaaacaggaaaaagaaaaattaatgcccactgtttcagaggttttcaataaacatgttattttatatttcctaagagtttttaatttaaataataaaatccactgaaatgtacatcaaaaagaaacatgcatacaaaaacaaaaggagctttattggaaatgtataggacagttcacagaattaaaagaattagctatgaacagctatgtagaaggaatttgaaagttagtcaatatcattgagcataaatcagctccattttttttttgcacgctataataagtaacttctcttgaaatgagaatttctagtagagaaagtgaccaattgatttaacttaggtaatttttgccacttgtatgaattaaggtgaaaactttagacgggctgtcttgttgacactcatccaacatgtattcatcagtttcccaaacgagaagtgggatgctgttatctgaagtaaagagaggcacttggtaggcgaaaacagtggatatccagcttggttattaataaggatgttaacagtattattttttttaatggtgggcttacgagatttctatttttctatttatgctttttgcttttttctatttttttcctcagaaataagactgttataatcagaagtaaaaaggttactgaaatatgtaactggagaatatgttgagacaccctgaactggcccatttttagccaattcatttttttaatgtgctagataaatttatgcgtcctagaatcagaaggctttgaatcaatcaagttctggttttaccagtaatgaacattagtaagacatttaactagtgttgagtcttggagctattaactagaaattatgaattatgttactatctatataaaacttttaaaaatttggcttaaaaaattacatccacatgtttaatatatttataaggcagaattccttgaacatatatatgacctttgatgaatgtttgttgaatattttcagagtttcttaatgccaatcccaaatatcacttagtcaaaaacttatttatcttgagacttctaacttctggtattatttggttatattgttaccgtttcttcactgaaaaaaatgtcacctcccaaatgtctcatccttgtgttttatttgattttgaagatgtgggtcatcttttatgatgaacacaggttctatttttatatcataatctcatgatgattatggtgaaatgaacaaattaataaatggaaataacagtagaatatttggtggattgttaatagatattaagtactctagcagatagagtcttttattttatttgatctctatatattaattcatctgtctgacaataaaatgtgtttttaaagacatgctttatcaagatgtatttgaggcatttccccccactgatctattgtacttaaaaatttttgaaagctcaaattacactaaatgactgcagaaaaagtcccaaatagtaagttgccaatttgaaacttttattagtctcaattagttaatttattgaactaatttaaatagatcaataaattaaggtttataaagaatattcgggcagtctttttcttaagagaatcctgcaagactgaggcataagatacagtctgttgatgtttttatccctttcatttatccaaacagtgtaaaacattgcttatcacattggtatgacttacaggattcaacagaacacttagtcttttgtcttcattttccccattgctttgtatttctttagatttaagttataattaacttgaatattaatcttagatggcatgatttgatatgttaaaacgaagagtttaagacgccgagctctgtggttctcgccttagtaatgtacacattacagttgccagttgacaggtttcatttatccatggttttctttaaaatgcctattgatgcaaacctttttaataagtaactcaaaaggaaaaacacacaccaattaagttgacagtgatcccatatatttcttcctctaatttcccttttgtgacttcattttccttcccccatgccttcctttctttctacatacatgcacactatcaccattctagtggcccctgcctttaggcaccatgtttaagctctcagacctctcttaaatacttgtaacactatcaatactacctattttgttagcataattgtatggactacatggcaaatatttctgaagcacactgtaaatgtctgtataaatgcaaggattagcgttgcccgctgaatctagacctgatggattatcataaagaagacaagtttgcatatctgaattcaattaacagtggtacttgtttgtgatggagttggggtttcatttaactcaatctcattaatttatgcaaggaccaaatttgtttagtgtagtttatttgttagaagaagctagcgggcagaggattcatcaaaataataaccaaaacactcagaaaaatcaatagctacttttcaactcctgatctttgtcctcacccagagtgagttctaagcaaaattgtgcaggttatcattcctggatttcgcgctccctctcacacacaaatcctgaagagcattatcatacccattggttcgttgtgcagtggatcaccgaggcatttctttatgtgtactctttggcctaccattccgttctaatggacagtcatagttcatagtgagtttgaagtctttcttctagttaatctgtcaatttttctcacacagtgcagctgctgtgaaagaaattggagctgttacactttgtgctttggtacagtttgtaaaatgctaggtaggagacaggaaaccaaacacagcatgctactaatttctttaaaacgactgatgtgctagaactcagagtctgtgtcccagagagctggcatccctttttttctgagaagactaacgtcgtttgaaagtgttatcttacttttgcatcaacgatatagatgcctttggtatgacttacaggattcaacagaacacttagtcttttgtctgcattttccccattgctttgtatttctttagatttaagttataattaacttgaatattaatcttagatggcatgatttgatatgttaaaacgaagagtttaagacgccgagctctgtggttctcgcctgtagttccagctacttggaaggctgaggcagcaggactgcttgggcccatgatattgaggccacagtgtgtgatgattgcaactgtgaataacttctctagcctgggcagggtaacgagaacttgtccctaaaaaaaaaaaaaaaaagagtatgtgtatattgatatgtaatcatgtgactagacccttcactgtatactatataggaaaagatatataatatgctagaaaaacacactataagaactgttcttaccagaaagtaagcttattccagaagaggttggccctgtctccatcaggaattgtcagaattacagggatatagcaaagtgttctttttgacacatcaggattcctttctcttgaatgaaatgactatattcttcttcattgaagcatttgtataattaatcaagatgtttgtatattactctcctcctaacatgtgagagctgcaggtattttaaatgagaatgcttcaggatgtgtagtactgtctctgtgtgcagatttactttttattttatacgtctggtttttttgtgtgtatgcatgtgtgttgtgttgtgtgttttcagacagggtctcccactgtcacccaggccagagtgcagtggagctcactccaccctccacctcctgggctcaagggatcctcctgcctcctcctcccaagtatctgggactgcatgtgcatgccactatgcctggctattattattattttttaatgtagagataaagtcttgctatgttgccaaggtttgtcttgaatgtctaagctcaagcagtcctccccacttggccgcccaagttggggataaccccacttgggataatccccaaaacgcccaaggttttgggattatagatgtgagtcactgcacctagctgtttattttacggaggggccagttaactaattccctcttctaataaaattgttttgtaaatccaaatttgttcttgcctgttactactatttagaattttgcaattttattatacctagtcaaaagaaggaaggacgattcaaaaggaagaggaaagaaaattaatattaatcaatatatatcaaatgcatactaggcttttagcatcatctcaaatattttatatatattatttaacattcacaagtaccacataagataaatattacagttatgattttacacatctgtaatatccagagatattcaagaatcatagccagtaagttggatgaacattgcctaaaaaacacatttttaaaatctgaaagccagaacacttaacccttgaacaacgttagctgcatgaatccactaatacccacattttttaaaataaaagttacaccaagggtgcctgcctttcctgcctcgccttccatctctttcacctctgtcaccccagagacagcagaactaatccctcctcttcctcatcctcttcagcctactcaacttgaagatgatgagggtgaagacctttgtgatgatccacttccacctaatgaaaagtaaatgtttcctctttcttatgattttcttaataacatttctttagcttactttactgtaagaataatgcatataagatacaaaatatgtgttgactgtttatgttatcggtaagacttttggtgaatagttggctattaaagttttggaacagtcaaaattaaacaccgatttttgacttcatgggggttggtacccctaccctcctcgttgttcaaggggcaactgtatattctttttggtgtatatagagaccctgtaaaagagaattaaactttttcaagtccctcatttgtaatagtaatacatgtatagcctttaacaattttaaagcgtgctcttaaagaacattttctttgcccatcataataaatgcttatattaggcattattacctccgttttacttgttaaaaatcctggacttctacaatctgtcagagttggagaatcaaaggagaaagtgccttagcaaagagaatatagctgaaacaagaatcaatcaggctgttggggatataattctggaatgaaaattagactgaatttgttcttaagcatctttgttgtttgagctctttgttttctcatgtttagaatgagaagtggggggatttaattacgtttagtgacctttcaagctctaaaatgttttgctacttgaaagtgtacttagatgtgttaatgttatatacagaaagaaactgactgaagctacttaataaaaagtaatcaagatgaattataacagaaatagtaatataagataggaaatcctgaactaatattaggttatgtgcctaaatttgtgatttttatttaaacctggccttaatatttggcttcatttacctttcccttttaacctcagcgtcccaccttaacatagaatcaatctatgctatttgctatgtatcccaggtggataactgttcttgtagttgaccttcataatgtaactttattggtatagttaaggttaatggcacattaattttctataagacatcagtcagtatcccattttaatttaccattttcatgatgactgctgttctaagttgtttgtgtcatttttggctgccataaattatcccgaagcaaatatcaatgtgaactcagaaccatgcatgctgatgacttctgaaattattaatgccagtacataggaaaaagaaatacatgagtgcacatttggttgataatttctttatagattaccattaacctctttctttaagggaacagcataagtacatctgtgtttatttgctctaagggaaacaacagttataattaggaataattataacagcagcagtgaaactctaaaaaatatcctggaattactatcattcctaaaatatttttatttcagtggaaacagccaccattaggatctcatgggagagttcaaagagaaatgatagattatttcagatagacccttgttgggtggctgaattctcagagtggaaatagcagataatttgggctctgttcaaagcagtctgaagaagctctgtcctatagctctgaagggacccattttaattcacagagcacattaattgttatcccccttataaacatgtctttgtttgaagcattatctcaattgtgaaatgtggcttagaacaattctagatagtatagtggtaaaaaacttcaactcaggagtcacatagatatgggttcaaatctcatctccaccatttattagccatgtacccccatgaaaattattttaaacttttagtttccttagctttaaatggaaataataaggctgtccccacagaactgtcctgagggttaaagaatctttccagagtgacctgtacttagtaaatagctcccaaaattgtggaattctgtagctgtttaaatgagaagagatttttattaagaggtttccaaatttgtcctctttagcatgccattattgtcactttcaatcacttgggttttcagtactattattttattattttttcttcatatcagctttaaatttattctcttttcatacttagtcttgtcaaagccagattgtctcggaggtcttgatgttagacgacctagtatctcaggtttctctttgtaaaacaattgaattaatacatggatgtggttaggaaagtcatttgtggtcacataaacttcagaatcctttatgtccagttcttctctgtcacttgggtattcctgttataagagagaaaggagtcatatttagtgacatgatttgaccttcatttttacttaacctttggtaagtaacagtgagctgcttcaaaatatagtagtatttgtgtattaaaaacccacattcatgatccttaatataaaccaggcactgtgggaaaccacaaacagaggaaagaacattaccaacacctgtagttatttattttatgtgctttggaaaataagttaaatgccctcaggagcagtgttcatacatgaaaaaattctctacttatgccacaaggtcacataggattgtctgtatgataaagtatacattagattactctatctattttgtaacactttatagctgtaaggttgtatttttaaacgagcaaaaatgaatcaaaatttaatttgaaagcagggactcaaacagatacttctgtatcaatgttcacagcagcattacttaaaatagccaaaaggtagaaacaacccacatgtccatcaatgtgtgaatggataaacaaaacatggtgtaaacataggacggaattttattcagccttaaagaggaatgaaattctgatacttgctacaacatggacgcaccttgaaaacactaactgactgaaataagcaagacacaaaaggatgaataactatatcaaatatcacatgtaaggcacccagagtagttaaattcagcaagacagaaggcataatagtggttagcaggggctggggagttatttttttaatgggtacagattttctattggggatcatgtaaaagtgttggaaatggataatggcaatggtgacacaatcttgtgaatgtacttaatgccactgaattgtacacttaaaagtggctaaaatgcagactttacattatgttagctctccacaataaaatgtatactgaattttaaaaagtgaacagaaacttagaaactaaaatactaagcatctaattatctgaaatatgctgttaagtgtctttttcttttattgagcaactagctgtgtgtatttaatattctaagatctttaaaatagaggaaaagttgctcttttcctatttaacattctaagatctttaaaatagaggaaaagttgctgtctcagattggtggatttcacattgatggaatactggaggattaccgaagttcactttcctgggggctctagttcatgtctgactcctgtcatataggcccaaaattgccatctcagctacacagagcctcagcttgataagcaaaggtatttttcttgcaagagctctcttgcctctggagagactgatctggaatgactgtcaataacaacaaccatatacctgaagaatcggtctcttccattttaatttcatagacatgcaccgctggaactatgattattacaggatgaagtctcctataggaaagccggctgagctaacaaaatcaagccccattagtctgtccctggagcacaaactctaaatggccaggggagggaaagtcacacaggagagggcaagtgattggaaattgtagaaaatgggagaacgttgttgcgtgccatggtctcatggagattcatggaacctggtaaattaaagtgcacatccgtcccttaaattgtcatgctgcttcaagtttacttaacttttgtacagacttttacagacttttagaagtatttgtacagacttttagaagtctctccttcttccattgcttgtagctcttagatttaaatgatcacctgttcttttttgtagtcaagttgggatgtgcccccaaacacgtaacatgttttgaaactaaacaaatatccaccattaaattaagtttctttgatgctttcttttttcctggcagaatttggtcaaagcaactatttcattgcaaccctgacttgaataaacaagtacatgcatgctcatatagctgtgtatactcatgtgggctgctttagtgccttgactcaaatttacattactttcaagtataaacaatacaatactaatacaaacaattttgggagacagtaaagtttagtactgggctctataatatgcttgtgtgtttttggaaatctgtaccgtgcattggcaatccagagagtgctggtggagacaggactaacacaatggttcccaactaaggttattcctagagaagggcttctcaacttcaacactgttcacattttgggctagataaatcttggttatggggagctctcctgttcattataggatatttatcagcactcctggcctctactattagatgccagtaacatctgttctcctctagccatggcaattaaaaatgtctccagatattgtctagtgtcctctggcggggagggggcaagaagagcagtttagagcatggcatgaaatcccaggggcagggtgttgggctaattcaaagaggcttagggttttgaagcagtgagtggtgagaggagaagaatgatagaagaaataactggatgtgtctgcagcattttcttcccatggcattgcttcttgtaagatacacacgcacactcacactcatacttttgttctacataacatatatattgtgtagtatgaagtttatgagttataacactgtcgtcagagttatacctttatcctatatccagaagcataagacggtaacttaaaatctgactgttttatctaaaaatgtgctttcttttgggtattgtcaggactcttggtttcagttttaatttctataaatccagagatttgaacaattcccctgctagcttctgtttctctttgtgtcccagatctgtttccctccatctatagccaggacaggagtaacttgattctgagaaccctgagcctaccccaaaaggtaaaggaatcacctttccctatgtccacagattaaaatgagaaaaacatttttgggtttgcttgagtcttaagtgttcttctgacctaggcacttctccagggggctggacaagcctggctcatctaatttctaccctcccctagcccccaactttccaacctcgcaaacaatcataaggagtgctccccccacctcaaaagcagagatgctttatttagtactctgaagacaaaatgaagctgcaatttctttttgaaaatcttccccccagtttttcattcccttattttcagtgagatattcatcctctactttaaatgtacattctcttatagtagttctcaaagtctggtcgaggaaacctgaaggggtagtgaaaactttcaaatggatgtcagatcaaagctatttttgtaataatactaagaaggtatttgcctttgtcactctcagtctctcacaagcatacagtggagttttccagaggctgcgtgacatttgatgtcacataagagcgaatgcagaagcaaataggaggatccatttgtctatgattaagccagacattaaagagagatttacaaaaatgtagaacatgctatcctcctcattattttttgctttatataatattttcccattgaacatgctatttatgttaatatgtaatagacttactgttattttatgaattgaaaagtattttagaagtttccattttaatttctaatgtagtaaatatcaataaacctaatccattaattaaaactctttagcattctccctaattttaagaacgccttttgtttttatggtcttacttgaatacctgagtcttcatcaagttcttgccacgatggcttttagaactccaacatttccagcccggtgaaagccacagaatcttttcagctcaagccctccagtggatgttcacaattaaaaatttcccattttttcctgtatttagatgtctctttgctgtacaacaaggaacttaccagcggtcactacacatactggattataggcaagatagccatttaagggtagcgaaaaatgtaagaatttttatttatatattttatgtgatttgaaacgattgtgatttatatttcattatgtatataacatcagtaatagagtacatatgtgtactttagaaataaaaatacctaattagaggtgtatgctttattttctaatagaaatatgctatcaacaaaagtgatacttatcctataatatttgagcctgttttggggaaaattataacttgatacagagtgaaaagaataaatatttcttttagaggatgtgatggttaattttatggttcagtttgactgggccacagagtgcccaaatatttgatcacattattagtctgggtatttctgtgaggatgtttctggatgaaattaacatttgaattagtagatggaataaagcaggttgctttcccaaatgtgggtgggccttatgcaatcagctgaaggcctgaatagaacaaaatagtgaccttcccctaggaagagagaatttccctgtccctactacctttgaactgggacattggcttttttcctgcattcagattgaaactgaaacattggctcatcctaggtctcacacctgtcagccttcagactggaaatacagcatctcacgtctactgggcctcaggcctttgaacttggactggaaatagactgtcagctctcctgggcctctaacttgctgactcaccctgcagattttgggacttgtcagcctccttaattgtgtgagccaattccttctaataaatttacacacacacacacacacacacacacacacacacacacacacaatcttactgattctgtttctctggagaactctgctacaggagattacacaaactgtaaaggaaatatactatcgcataaattaagcaatgatctctataacttcttcagtctgagaactcattccttctggtcactggatgccttacaaggacagaatagggaaataggttttacttgaagcaagaataggaatggctgtaactgtttttgaattagtactgtctgtgagcccctgggcaatgaaggtattattgtctccattttacaaacgcagaaatcaaagctaagaaagaatactttgcccagggtcctacagaagtaaataaagtagctagaatttgagccagcctttttctaactccgaggcctatcctcttactagttgactatccataaatcaattttctacctataaagcttccttggacttgagtatccataaaacaacttcccacctacaaagatgtaggtaggaaagataattttcaaagtgttttaaatgtagcattgcctaccctggagttcagttaagccacaactgatctgtggtaatttggggaaatttcatcaagttggtctagaattacagactcctgggaatagatgtgtgtgtgtgtgtgtgtttgtgtgtgtgtgtgtctataaagtgccaagcttattttccaaaaggataaaggtatttcccagtgagtaggaaatgtttgcattcttcatgtatttgtgcatggatttccaaattgatggattttgcttcaaaattagtcaagaaatcaatcctggaagttattgtgtgtgtagctcaattcagtaaagtggcaaaatattatttatttcatcctccttatgctatttagtttccatctcattcctcatggtaatggagaaatagtctatgatattgtaaacacatatggatctttaagatttattttatatttgttttagcgttcaggaggcacttggcttttgcatctctccctctttaggaaagaaaaccaggtcatgccttatattttatatatgttttacatgtatttcctttcaaaaatgtgtcatggtatacttagtccttccctttaaagaaaaccataatgcagatctcattaaggaacataaatagtgatacatatatatggaaaaggacacacattctttagtgcagtggtgggaactagtgatcttcctccaaatgccagaataaatagatgttcctagcaaaaagcagggactatatttggaacctcccctattctggagttccagatctgattactcatgtagaatctcctgtttcatatataggtgacagtgttcaggactcattaccccaaaacatggcatcttagcatttgaggaaacagccaaagcagaccatacaaactagaaagaattcccctcaccccttccccactgaagtaggtcataagaccctcatctggaggagtcctgacttatacccagaggaaagcaatatcacacatggttgccaagaagaatttgaacaaacagaatttgctaagttcttcctggtttattactgttatattatacccttttgtcttccaatcatacttctgcacggctgtccattaaaaatacacagttttggccgggcgtggtaatcccagcactttgggaggccgaggcgggcggatcacggggtcaggagatcgagaccatcctggctaacacggtgaaaccccgtctctactaaaaatacaaaaaaattagccgggcgtggtggcgggcgcctgtagtcccagctactcgggaggctgaggcaggagaatggcgggaacccgggaggcggagcttgcggtgagccaagatggcgccaccgccctccagcctgggcgacagagcgagactccgtctcaaaaaataaaaaaataaaaaacacagttttccccaggtctttaattatgcatttctgaataatctcgcatcatgtaaaacttacgttaaattaattgtatgcatttctcttattaatctatcttttgttgtaggggctttagccatgaacattgataggagttagaaatattttcttccttacacgtatacagttggccctccatatccttgggttccacatctgcggattcaaccaactgcggatcaataatgtttggaaaaaaaaaacaataaaaaataacaaaaatgttaaaatacagtataaaatctatttacatagcattttcattgtattaggtgttataagtaatctagagatgatttaaaatatactggagggtgtgcaggagtcacatgtaaatacgacatcactttatataagggaccccagcatctgcagggggttctggaaccaatcccatgtggataccaagggacgactgcattctccaaatcctgggcatgggcataccatatttcttaacatagctgcttaccatctctaatgttgtctatttaccattttctataaatctactgggttttaaactaatttttgatatgaagaaagtttatatcaatataaatagaagtaaaatttttcacaaatggaaaataataaaataaaaattttcacaaatggaaaattaacataaaaataaatttgcaaatatttacaagcgtaacataaatacacatcaacttaaactcaaatgtttacaaaataaaaataatactgtctaccagcagaagtgcaatgaccatattttttaaactatgatttctcctatatgtctatatttcatggctgaaattgtagttcagagctctcaccatcgtttctactacatacaaatcacttatgtcagtggaaatgttttctgccaagaagtgccaaattgtgagcctctcaggcctccagaccatgtttccttcacttctaaacgccattatgtcacccactgcatagttatctagtgcatataggataaacgctcaacgaagaaagccaggtcatgctttacaccttacattttgttttagacatattccttttcaaaaatatatccctgtgtaattaacccttctgtctttaaagcaaaggagttaagcactcaaatggcaatcaccaggaatgaggcccactacagtctaggagcaccagggcagtgcagtacaaaaaactcaagtagagaaaccagtgataactggggaaagttactttgactcacagaactttagttatcacatctataaaatgagataatacactctgccttattgaggcatttttttttattaaaaacagcctttgctttgtaccaggaaaaattaaaagcacttaataagcattaatttatgtagtcctcctaacagcccttatgaggctgtaaaggaacaaacaaacgtttctctctacttacactaaacatgccacactttttgaccagatgtgtgggttttgatttctgacacatccattttcaggtacatagttatgattccatttaattccgatgctgtctacctggagttacagtcagaacccacatgttaagagctcggtcccacgtgaatgccccctacttcagatgccagtcctaaatcgggctccccagaacttctggccaattgatataaattagagattcccatgaccgcctccttgggttcagccatttgctagagtggctcacagaacccaggaaagtgctttacttatatttactggtttataataaaggatattataaagaatacagatgaacagccagatggaagaaatgcataggaaaaggtatgtgcgaaggagcacagatcttccatccccaagcacctccacatgttgggcaacatggaagctctccagttgcagtcctttttggtttttatggcgacttcactatagaggcatgattgattaaaccattggccagtggtggttgagtcaaccttcagcccctcttccctcctgaggctatttaggagtcttgggccaccagtcattacccttctaaaagacttatcactttggagattccagggattttaggagttctgtgtcaagaaatgaagaagaaagaaatgaagaccaaatatatatttcttattctaaagcacaatatcacagaggaaaagagggtcagtatcttaattttataagggaggcatttataagacacagagaatctaagtaatttgtggaaggtcactcagctagaaagtgaagagctgggttttgaaaacccagattctggactcaatcattactctatgctgtatttcttcttagagtatatgaaattatccctgtgaaaatagttagactctggcattctatagctgttttctgtgacctgtgctctatattgtttttctttgcttcacagaaacgtaggtactgttttcccctaagttgttaattaatactcagataaggggcaagcacctctaggaaaaatcaaattataaatgtccagtacacttttatatcacatcacataatgtgacacattaaacagttgtggaatgtcaaaaattggcataatagatgacttgggaatgtagagtgacaagttttcatacaattgtgcctttttttgtgataatggtaaactctggaaaatttcattttctggttctgcagattgccagcacattgacatttcctgtatggtttcccaatgggaaggacagaattgtatttagccaaatctgataattttccttagttgaaattgaaggggctaaaatgcctacctacacttggatatgggcttcaattttttttgaagatacttattttccttctttgtttctaggatatagaggcagttcaggtagtttttcaggatactgcattgtagaagtaggcccttagtgaatcaagccattcatatacaagttgagtaagtgctcagagtaggtgtctatattaaggacagggtcctgtacattgtggggtgcttagcagttttgccatcatctgcccatgagatgacagtaacaaaccccatcttccctatgattatgacaaccaaaaatgtcttcagactttgccaacaaattacctttagatgtaatcactgatttagagcaatagaatttttggctctgtagggtaaatgaagtgcacctgatagcaataaatgacgcataccctgagaatgaccctgtatggcagatgcacctgaatgtgtgttccaagctaaggaactcgggaatggccaacagggagattcattccttgtctatgaggaacatctgaacctccagcctgtctattggaactcaggccacacaggggctcaagaccccgagttttgggttgaatgaaggttgccaggtggagactgtttgggaaagggtgctgagtgaaaatgctatataaactgcatgccctttgcaaatgattgtagttttcctgcccagtcccctgccgctgggctgcggagttatcttgtctagcccactgctactgggctgtttgtaaggcgattctcctgtccagcccaacaccactggcctttctccgtggtaagtaaagctccagtaaaatcccatgtcttgtttgctggccctgggtctctttttcagtctcttgaacctggtgccatcccctttagagtcgataggggttcagcgtgacaggctctttgttgtaaatatttgagattgatgatatctttgcacatattggaaaactttagatttcaggatagtaacttatgggccacaatgccaactacagctccggtaatgttacagtatgatggtttttaatgtgttccctggactagcattatcttttacaaataaaatcaaatcacatcactggctgaatgtttgagatgtattctcttctcattttaaggtttacgtaagtaatctctccaaataagtataatattaatagctgacagataaagagtcttttatatttacaggatgctttcaacttagtcttttctttaatttccccagtaactctgagaagagtttttattcacccatttgattagaaacagagacttaagaagagtaacttctgtctattctgagttagggagatcagaaaataccactgttctgagtagtattaggtgagaagagttttcttgctgattaaaatcctcaagtaaagctcttacatataagacttttatatataagaacaaaaaaccaaacaccgcatattgtcactcataggtgggaattgaacaatgagaacacatggacacaggaagggtaacatcacactctggggactgttgtggggtggggggagtggggaggggggagggatagctttaggagatatacctaatgctaaatgaggacttgatgggtgcagcacaccagcatggcacatgtatacatatgtaactaacctgcacattgtgcacatgtaccctaaaacttaaagtataataataaaataaaattaaaaaaaaataagactttttcctatcctcgagagcagtgtcaaaggctcatgactgtttttctcctgatctccaaattctaaaccatgtgctgcagtttcctatgttgatgtcactggttgttcaccctgggatgtcctatagactggagcatctgtctctatcctctccaatgagctgtcctaattatgttacatcaagacaacttgtgaagctcagaatctcaagtttctggccttacaactgatgagcagcataagccattcccactgctgttctcaatcccctccctgtcttagattcatagatccctaggctcttaagtgtcttccagaactgtttatcttgtagtcaagacccagaaattagacttccagaaacatagctcttcaaggcaggttcttcaaggtgatgatgcctgtgtcaccttgataggaaacctcctacactgtgtaatactgtcatctcagggagagccactgttcattagcttaaattgtcagctttatggttcagtgaaataaatacacattttccctaaggtaatgacttttttctcacttcgtgagagctgtagggacccttgttatcaagagataatcatattctagtggtgctacttattgtacccaatgaaagtcccaaggatgtgattatctcttaataactctaaagcctgttatgtatcatcttgtattttgtttactttgagtgtgtggtggggaacccattagtgatctctgtggttgatagtattcgttgtgaaatgataaaagaatcaaatgaccatttgtttgcttggagctagacagcacgattagaaatgcatcccaattctgactgaaaaatgcatttaaatgtaatctgttgcttagtattagtttaataaccctgatgttaatactaaattatatcaagcaaagctaatggaaattctgaaaataaacatggataatttagtatctacatgacctttacctcccacagaaaattcaggttgggttttaactacctgtgaaggaagtagatacccatgagaaataacctgctgattctgtgatggaaaatgccatcaataagttaagcaaaacaggagaaatataaggaaaagcctgttaaatacaatggcctttaagaatacggacagttgttaaatggtaactcttacctctcactttaggctatcctttgatattcaaataatgttaataataacaagtatcattaattgaatacctgctatagactggtttggcttgtctcattttatctattattgttattgagatggagtctcgctctgtcacccagggtggagtacagtggcaggatcttggctcattgcaacctctgcctcccaggttcaagcgattctcctgcctcagcctcccaagtagctgggattgcaggtgtgcgctaccacatctagctaattttttgtatttttagtagagatggggtttcatcatgttggccaggctggtcttgaacttcttacctcaagtgatctgcccccttcggccttccaaattgctgggattacagataggagccacggcacctggcccattttatcttttgaagaacctttcaaggtagataattttggccctgtcttacagatgataacaacaaactacaagaggttatataacttggttgagttcatgcagcaaataacgtggtaaagcttagactcaaatatgactttagaacctatattttgtccactgattatttaaaggcataatgtacagagtgactaagcgcaattataggagacttgtaatcaatggtgatcacatacacatttgttgttagacaaatccaggtctgactctaacaggcaaagtaaagagaccactctttggtccctcctaatgttatatgctatgtctgtgagaattgaaagctttagagatgccgcatctgggtttttgaacatgttcgttagaattattttcatgctcttacctgtcacttgggaagggttgtttttgttcttaataaataaccgacacaccttttggttttgaggtatttggaaagggtctagatcaggactgtttgttccctagggtaaaatcatcctttttgacctagaccttgccagctgctgcatctaactatttgctattagctgagaagctctgcagtcattcatggatttctggttcctttgttgtaaaattgcgagtacatttatgttgacagcagctgatttgttcaaagattggacccaatctttctgggcagagggagagtcgtctatttattcacctggttgtgtattaatttcctgcctattttcacatgtgattttatttagtttataataaaaactttaacttaggatagcgggtacaagttatggattgaacatggaaagtttagtgaatttttcatgattaaaaaaatgattataatgatagcatttattttctgcatagtatgaactgggcagtgttctcatggattacctcagtctagcctcaaaacaacagctaaaggtaggagtacattaggctcattttattcgaaaggaagctgagcttaaagaaggtgggtaaaatgaaaggtcttgccttgtgttcgcctctagggagagactattagccaatcaagtgcaatagattcagtttctttccccctgtaaagcagcacaaaagcggcccagaaaaaaattctgtgggttttttttttttttttttaaccttctttcaaggtatgaaattgggtatctacctacttgaatcatctctgttcatgctggctaacctaagatgggaagttttaactatgtctactttttcccctaacaagaatacagcaactgaacattttcccagtgaggtgtgaataaataattcctgcttatataatcagcaacttctcaacatcaactgaggtatcattagatattttcttttaagatcagttatgaaaatccactgtggaagtggaacttattttggcgtaacccttagtttataataactaagactatacgttggatccattcaatcattgagcatacatttaaggagcacctgttttagaccaggttgtactagactgtacaccttcagactgaagaataagacaacacaggtacatactttcccacagtaaaaggtatgtgtgttttggggtaagccgaacagtgataaatattttgtgatgagtggtatgctaaagacatgtgctgagtgtaactggagcacaagatccattacggtcctgagaggttatggttttgttaaaaggattatttcaaaagtaatattctcttactgttttagatacattttgatgatgtttgttgtttatttgggggggggaggtggcagagtagagtagtaattttattttgacagcaaatcccaggaggtcaggaatcttggtctgtttcttttctcctagtaaatactttttgaataaaaaaaattaatgtcaatgtaaaagctattggtctatgatagtaaaggaacagttgattatgattcatattcatgagccaggaatttttatatatggaatttccttacaaatttgtaggttgttagcattgtgacttatttgtattcattgctcacttatttgtctgcctcatttctacaggcacaaagccaggactttgtattactcacagaaaacttagcttcagtgggcttatgatttcttaactagtaaccatttagttgtaatatacagaaacttaaactagctcacataataagggttgttgaaaccatatgccaggcaaaatgatagtcttctaagcataaaaaaattatagctaaaacctaacctcatggggacttgacttaggaagtcaggaaatgtggctgcccctcaccttttaccctattttcagttcttcatttctcatgtggatcaggagtaaggatgtatgtaatcctaactctggttttctctaaagtcttatttttctggttctctcaagactggcttctttaacaataattccaactttacatgcctcaaactctcaagtgttgcaattcaaaatctctgagagagaatcttgttgacttaatgtgggtcaagtattaattgatggttcaatagctgtagcctattaggttgaatcacgtagaacatagggctggtcttttcaggagcaacaggtgggatgcattctttacaaaggagatattgtttcagaggccttcttggggtcagtcccatatattccccctcactcttcttacctttccatcctgctttctattctctttggcattgctctttgctccgtggtagctaactgacctgataaatgcattcatgatatgttagttcacccaacagataagttcttttggccaggattccctctggatgcaattacaaaaatcaaaggagtgaatttaataatgttttctataatgggcaagtatttgggaacatatgttttcttgtggtgctgatactgctttttgtgtgtacagtcaccatgcatgaaactatccataatgtatgagaatctcttgccaatgttactgctactagtggatactataactagtggctaaactgaatagctagtctgcattatgtaatttaattattaatttgaggattgaaataatcctttgaggatgaatactgttattgtccccactttaaaaatagaattgaggattatatcaattaaagaattgttcaagatcacatgattagtaataaattgaaccaatatcccatcccaagaaatttatcccggagcttatgttctcaaacaagaacaacataattattttaatgaataaaattaagttttcatttcaagtattattccactggatagggtaaatgtaatctctaccttctttctgtgaagaagaaaaaatatatatgacaaatttttagtaatatttgaaaaaacaaaaaactttgaccgatgtctgtaggattattataattttaattgttattgataggtaggctggagttgcaaatggtgccaatagctgtaaatagagctttagttttacatcagttgctgtccttaatgtaagaaagataggtgtttagatacatactaaacttttgtagctgactaatgtatatacagctggtaactgaccatattaaaaccaaacagatggtgatgtatttgtgattcagaattaatgtgaatatataatttttcataatccataggaaacattttcttacacatgtcatcatttatgaaattgtatttgttttaggggtatatgagaaaggtcagggattattttacatttctgaatatattagcaatatgaagaatacctgtttagtctctaccttctggttgttatcgatattatcctgagagtaaaggtagttaggtatttaatatagagatgaattattttgcaattcagccagagaaggcatacacttaagaaaagatcatgtttttatggctaatcaagaaactataacatttttatccaatcaattatgttatatttaagaataagccagagtagaatagtatgattaaagatatttctgattagctaatctatattatatatatctacataaaattttattttcagttattaaaactataagacagttattttacaaagaagtgatctatagcagaaacttggttagaggatacacatatgaataaacatgaaaacataaatatatacctttattctacgtaaaattaagtgtgtgtgtatttatatatatatttatagggaaaataaatttagttcttcagggaaaaatattgtgaggcaaaaattatttcacaattaaagtttaagtcggtagctttaagagaatgtacaatttatgtgaagagtgtttgtttttgttaggtaccctcattttatgtattcatatacctaacaaaaacgatgacgtctccatttattgctcaatttttattattttaaaatccttttaatgtaccctcttaagaaattgtctcttttattgaatctgaatgccataaaatattgcaggctcctagagccatcatactaacaagggaaagatagagtggtgatgaccttctcaaaagtcactcagctcatgggaggcaaggcggagaatggatcctggatcctaatctacacaattctattaagctggaaatctataccaaatgtatttaatttttactttgtcctaatccaatctgatttaattttagaccgggaagattacaggtaagcatcacctacccataagcctatctatgcttgaaaaaatgtatttatttgtgtattttttctttttattctaggaatcattgacatagagtaactccacagcatgtgtcttcaagagcttccctaaaaggtaagcttcccacaagggaagattttccttatgtgtagttcaccttgattagcatccttagtttctatggaaacattgaaaaccttcccttacagagtgatagcatgagattgtttttgatgtttttatgaatgttgaaattaatgaaagtagtgaagttacataaattaaagcctgaaactaagaaatagggactatttacatttctctctggagaagatacttaaggtaggttttctgtagtttagattaatttgataatccaaaaattttagaatttgtaatcatagaaagtgtatattgggaataaagttgttgtacttttgccaaatggtttcataggagaggatgttttagcagtcaaaccaacacaaatattaagttaacgcagtcctataaatactcagatcttaaaagttgaagcttttgaagggataaaacatgagaaatgtaactcactgtctacaatgtatgcaaattttttccttaataaaatatatagatgtaaaacagtaaaatggttatgttttactttcctgatgctgatccaataaagtaactggtggcttaaaacaatggaaacttattctctcacatttgtggaatctacaagtttgaaatgaaactctcagcaggaacatgctctctctttgaaggctcttaaggaggaatctctttgcttcctctagcttctggtggttgctggcaatgtttggtgttccttggcttcagatgcatcagtcaaatctctgcctctatcttcagttcacgtggctgtctcccctatgtgtgtccaaatattcttcttcttaggaagatagcagtcattgaattagggcccatgctaatctaatatgatcacatcttaacttgatttttatctgtaaagatcctttttaaaaagtcacattcacagattttggagattaggatttcaacagatcttttagggacatctaattcactcataacagtatgcctaaaaagagagtctagtgaaattaaagttaattattgttaacaatgtatttatgggaaaataatcataacatggagtggaggaaggtctcattccattggtatacataaaatgctgtttattttaatgatataataattatctcttgatggccagcttttctcccaagcaagataaaaattattcggtacagggtttgataacattgggtaaaatattagtatataattctgattctcagatttttaacaccctcagttaaaaaaaataataatcctggacatcagtgagaccctgtctctatgaaaaacaggaaaatttagccggatatggtggtgcatgcctgtagtcccactactgggaaagctgaagcgaaaggatcacttgggcctgggaggtcaaggctgcaacgagttgttattgcaccactgcactgtagcctgggtgacagagcaagaccttgtcataaattttatatatatatatatatatatatatagagagagagagagagagagagagagagagtcagaaatttatttcacttgattcttcaggtatttttcatgagctaaggttgagtaaggtgttttttaaccaactggctattgttctgtaacaaaccaccccaaaactcagtggctaaaaacagtaactttattatttcctatgagtctttgggatcagctgcttgggtcttctgatctggaacagactctgcagtattgactgggtatgctccttggtctgagcgcagctcacaggtcagtgcaagctgctccacaaggtccctctcctccagcaggaaccatctttcttaaggcagcaacattattccaagatactctgagtgtcctcaagcttgtttagatgtgctgtgttttcccttgcttttacttactctgttccttctccttggaatattctttctttccatctttttattccacttgaaaatgtatttcctttatgaatactgctctggtttctttgatcctattcattcatatatctttgtgtagctgaagatactgaactcatatccctgttagggtgaggcttccctcttgtgccaacatcagtgtaaacaatatgatattcacattgtcttgtaattgctagcttaattatcttaccctcccactgtgaacttctgaagccagtgattgcatcttcttgttcttcatggtattccaagaacctagcagtgcatgcacagatgatgtcttccataactatccatggacagaatgaaagatttaatgacatcttccctattctaattcctctcttaaaatttaagttgttgaaactttccagaatttggactgaaaggcaggaggtaggtttcctctcattttgatgatgccccttggactctactcaaagagggcccaggcaccctgtggtgccaccctggcctttcttcctctaccacagattgtaaaagttgtagtctgtgggacagaatatccccaaaacagttaatttgatttacataatagctctttttaacatagtaatttcaaaaataaaaataaagtttaacttgttgccagcacttaaaaatttggagattttacataaaatgattttttaaattctcctaaaagaaatcataataactttctatcctggacaatgcatttccagatgacaaagagggcttagctgaacaatagcagccttccagtgccctctccagttcgtcacaccatgccatttgctatcttctagccccagtagacacttgagtttaatatccttagctacccaaagatacatggattgatacagtgtggaggcttagctttgcttctaaatgtctgaacaaagaagtgtcagtggttgaatgggccatttagatgttcttattatatatccatcaactaagtaaaaataattttggctttgttttcaaagctctgtacttgaattcctgcatgtaatatttgaacagataatctctctgacctcttttttttacacatctgtaaaatggagactgtgatattcttcataggcttgggtcatgttaggttactttattaatgctagacaatttagtctaaactgcactcatagggaaaatagaagaagacagttacattcttctttttctggattggtacaaaaattttcatcttttgttagggtacattagcaatatgaagtactgatacatgcaacaactgggataaaccttgaaaatattataaataaaacaagcctgacaccaaaggtcatatattatatgattccatgttgatatggtttggctgtgtccccacccaaatctcatcttgtagttcccataatccccacctgtcgtgggagggagccggtgggaggtaaatgaatcaagggggcagtgatcctcatgctgttcgtgtaacagtgagtgagttctcatgagatctgatagtattagaagggtctttcccctcacttcactctcactattcttcctgctgccatgtgaagaaggactttgttggcttctccttccaccatgattttaagtttcctgaggcctccccagtcatgctgaagtgtgagtcaattaaacctctttcctttataaattactcagtctcaggtatgtctattttagcagcatgagaatggactaatatacatgtataagaaatacctagaataggcaaaactatagagacagaaagtagattaatagtttccagaaactaaggagagatgcaagcgggcagtgactgactgctacgatttctttttggaggtgatgaaaatgttttggaattagagagtagtgatggctgtaaagccttgtgaatacactaaaaaccactaaattgtgcagtgagtggtgaattttatggtatgtgaattacatctcaataaagtaataaggaaatatatgttttaggaagacaaaatttcatcttcagctgaggcaggagaatagggtctggaggcagggtaaacctaagggcaatttgcactgacttcctacaactgaatcaaaaggaaaaccccacctccccacaaccaattaacaaagggattagaggctactccctttgtactgcattgccgatgaaaaatggaaagtacctctgattggttctctcctgcaaccagtcacactggtcacgggccaagtcttcatgtgtaactttgtaacttcacttcagcctctaatttgccccctcctgcaaccaatcagacgtttgcatagggtgtaactttgtaacttcacttcagtctcttattggtcactctctgcaaccagtgagactggtcgcgggtcactccttcatttacatagtgtaactaagtaaccagtgggaaacctctagagggtaaaccccagaaaattctgtaaccagtgctcttgagccacttgctcaagattgctctcactatgtggagtacactttcatttcaataaacctgtgctttcattacttcattcttttgttgctttgtgtgttttgtcctattctttgttcaaaatgccaagaacctggacaactcatagtcaagaccctccactggcaacatagctatggtgacattctcagtcttttttgcattgctgaaaaggaatacttgaggctgggttatttacaaggaaagaggtttacttggctcatggttcttccagctgtacaagaagcatggcaccagcatctgtgtgtggtgacagcctcaggaaacttacaattatgacagagggcaaaggggcagcaggcatgccacaaggtcagagagggagcaagagagaggcgaatctcttttaaaaacaaacagctcttgcatgaactaatacagcaggaatttactcattacccaaggaatggcaccaagtcattcatgaacagtcttccccccatggcccaaacacctcgcactaggccccacctcccatctaggggtcagatttcgacacgacatttggagtggacaaacatccaaactatatcagtgatataacaaaataagcagattgtcattcaaatccacacacactgccttcctgagagtcctgtctgacctgactgccaaggccaaaggccaggtcaaattttttttttttttttagatggcatctagctctgttgcccaggctggagtgcagtggtgtgatctcggctcactgcaacctctacctccttcctgggttcaagcagttctcctgccccagcctcgtgaatagctgggattacaggcgtctgccaccgcacccagctaatttttgtatttttagtagagatggggtttcactatgttggccaggctactctcaaactcctgacctcatgatccacccgcttcagcctcccaaagtgctgggattacaagcgtgagccacggtgcctggcccaggaaaaaaatttaaacatcaggattcatggtttcatactgagattctgaatgatggggtcagacaggaatgaatttctattctaaatattttactgactacctctctcatatttctcaaaatgtaaaataagggtactgattagctcttttgttagcttaggaaaaataaatatcatgaacctactgtggttccagttaggaaatagaccctccataactgatacttttataattagtattatttggttgtaaatattaggctatcacattagatttttggcagttcaactgttccagggttggcttttctcttcctggcatcttagccagaaagaaaagaatgcctagaatttctgttagcacttaatgaatttaatcagcccccgagggacttttgatgtcagggaaatagttgacagagaaacatgatttttattctttctgtgtttctcttggtagttgacagagctttccctggcagaggtaacattacctgtgctgagagaggagtattaacatgctgtaagtgagatgttagaactaagagaacacatccctgtggccttacattaaaatgttccatgcatatgcttctgaatacaatttaagctgctgccaataagaaaataagccattgcctgaaaatgtgtgattcaattgtctatcatttttatgatttttttttaccctttcagacacattttagagattcttttttaaaaagtttgtttttggaaattgaaatgaaaattatcatctggaaatataagggataattgtgttattctgtgaagtattttataagctgtaatgttaagcagaaatttttaatcttaagtatggaaaaatatgtatatgaattgctccatttgatccaagtgatgttttatgcttttccttatggttaatggaaaggattatgctatgttgaatggccggaatatcaggagcatgggtgtcatttgttctcccaacaactatttttgggaagctaagtacatgccagaacatgtattaggaccaggtgatatggtgccaaataatatatgtatatcttctggaattttgagtttgctgtctaatagggggactgataacatacaagtagaaaaaatacatattgtgctaagtactgtaaaggaaaggaagagaatattatgatcgagaagcagagcttatagttccgcaccacaactaatttattgtgtgaccctctgataggctactgatgatgagtgggcaccgagcttctataaatttgacgaattaatcctttgaccattatggcgtgatcctctttttattcctgatgatgcttgttgacaaaatattacttcatttaaattaaatttgcctgagatttcctttctaatttgttttcaacctttatgtttagtttaggtgtatctcctttcagcagcgtgtagttggattttttcagtgtgaattttccccccttcttttttactaagggaattgaatttttttgcacttattttgattcctgaaatatttttaacattctttccatcaccttactttgtgtcaggatttttgtttctaaatgcttttccaccttcttctaaattaactggttttcttaattccattaatttcttattatttcggacgtttcactgttttcatttttagtgtgctctgccaaattttaaccttagcaaagtcaaatttaatgttcccaaataaaacctaaaattctttaactcaaattgtatcactcaaagttccaagttattttctatgcatattattttagctcaactttttcttcctcttagtaattattattatatttaatacattcaggttttaacttacatagattttcttatatactgaccagtttatttcttatcattgcttccagcatcccacttccttttgctcaaaagttcctattaaatttttagtagcttcttttaatggtaaactctctaatttttttgtatcactaaatatttttcttttgctgttatttttgaataatgttaagctaggattggaattcttagttaatggtattttcccctcaataccatgaagatattgttgtattgttttctatcctttattactacagataatgaaatctgctgttagtcaaattgatatgcttatgtatgtgatctgtctttttctttcctgctcacttttaagatatttcttacatttggagttctgcagtttcacaatgataagtccaagtatgcatttttgttgagtttttctcttacgctattctgttttccaacctcaggacacacttttttccagttgtagaaaattctcatttattatttatgtgaatattggtatttctaaaattacttttgttgtctcttttctgcattcttaaacatatttggaccatttatttctcctatccataactcctagctagcctttcacttttttctttatgtcttcattttgcattataagaaaattcctctggagtccttcagtttttaaatttgttgttcatcagtgtctattctgctacttaacttttgtatcatcaggatggctagttcatgctgcattattagcaaacagccccaagtgtcatggattaaaacaagaaaagtttatttctctctcatgcaacattctcaatgaaagttaacaggggagctctgtcttggtggaggcaccatctgggaatgtgaaggcaaaataaagaaaacctgtggaatcataaactggctcagaaagcttcctcccggaattgacacacgtcatttttcctcatattccactagcaaaagaagccaatggatgactccaaaggctataaggaaatacaatcttttttttttttttttttggagacataatctcgctgtcgcccagtctggagtgcagtggcaccatctcggctgactgcaacctccacctcccgagttcaagtgattctcctgcctcagcctccctagtaactgggattacaggtgcccatcatcacacccagctaatttttgtatttctagtagagacagggtttcaccatgttggccaggctggtctcaaactcctgacttcaggtgatccacccacctcggcctcccaaagtgctggaattacaagcgtgagccaccatgcctggccaggaaatacaatcttaatatgcacctggaaacaaaggagaactgtagtatttatgaaaagcactgcacggctactccaaatgttcatttttttttttaatttcaatttcttgttttaatttttagaagctctttttggtttatcttttttttaagtcatgttttcttgctttatcatggattcagttcctttttatttgtaattcctttacatactcttaatttctcctcatgttcattaatcttttattatttttattgtttatactgtatgtttcttttactgtgccaactgaattttttcatggtagtttttatttccacatatagttcgtaattttatagtttgagcccaccttagtgaactacttcctttctttgggaatgttgtgaactctgtgttgtgacagcattccccaagagtggttctgcttttgcttttattgagtctttaggatataaaaggtcacatatcagtttttgttaacttcttgcattttataagtagagtaaattagatcatatacttaacgcttggcccagccgtgaggtttttatttcttataggggtcatattgagtccaaagacaacagaattcctcacttcttgttcaggccatttgcatcatttttctaccttcttttcatggatttagggaatctgtgttttatatagggactttagatatatctccctgtgcttggaagactatgtctcctgtccctccttagacatcaaaaccctggctcaccagccctcaggcctatagcgagaaccaccctgtccctgaaccaccaccacattaactgaaacttattgcagagtcttcagttcctctgttcctttatcagaccttcagcattccatttcctttccttaaacttgatagatttttttaaattgttttacttatattttattcattatttttctgtgcctttaggtggtcattgatctatattagctgggttcattatgttttcaaaactggaagtttctaacatcagcttcctagcctataaaaaattattcaagttgcattatccacaatgctcttttaaccctatgactcatatcttaatatgaactaatacgaagaaaaacaagaattaataccaggtctcttgtcttctttccattttgatattaatcaattgtgtcatgttagacaagtcattaaactttcttgggctcaagcttccccatctataaaatcagcagttgaaactatatgccttagataaatgcattctcttctccaagctaagcaagtttaaatctgatgagcttttaggaaagatacaactttgtcctcagtactataatatttgattctttaattatttccagctgaagtcttttaaaatttacattattgcaataaatgttttacccgaactggtttggtaaatattttatatgcatctgtatataaagaaccatcatatcttattatacctagaaatgaatgcaattatgtttgccattttaagggtctcaagagttaatattaacaaagtgcttgttgacgtattttttttttcacatgaccttctgaagccagcctgcactactgccttttacataagtaaattagggtacatttttaaccttttcatgtttaaactaagacacatagtagctcttcaaaattgcaaaacagtctttagaacatttagtacacaataacccttctaattgcacgtgaaatgaaggactgtaaacttcataagtcacccagaagaacacaatgtaattccctttagagtatcctctttaaaagtggtctcagaatcagactccatgatttcagcaacacagtcaaagatgtactaacagatattacctaggttgccaatgaattgctgtcagttcatgttttatccatgaaaattttaaggaaaatgtaaaaatgatacatttgtttgaacttgtagagaaaattatgaaaaatccaagcttgtagggaatgatggactatctgcagaatattagcatagctctgattttgcaaacacgtggactcagataatcttacccagtggagacataccaatgcaaagtgaactaagatcttggagtactaatggacctatataacacattgagaatgttgaaacaacccgaaacaagctagagaaattggagaagcttaaacctgaggattggtgccctgaaatggaagagaaacaacagtcaactttatatgaacaggatgaaatagcatacaacaggatgatattaacatatctctgagcctgtgagggacagggaacagacttagagcaatccacccttgccgttaagatctattttgaagtgagacaggcgcttgtctcaaaggtcagggactaaatgtgtcttagagaagtcatcgtggttgttttaccttttcatccacctttgaaataaaagattagagataagatgaaatctaactagatccttgctaggagaatgaagttttaaaaggagagccatagtcacagctgtcttcagagtaggtagatgccaagtcttagggaagtacaggattaaccatgttggtaatgacagaacctaaggtatccccagcagtgttctttaagagtgtaaaaaacaaggattaggagagcaggtgattggacgcagctgctgaataatcttcttaacctcatctttactccacagggagaaaaataacaggaaaataaaagcttccaccaagtggttggtggcagtgaaacaaaaggagcatcaaaaagtacacaaggacagatttgtcctgatgctaataattctgaacaaaagggccaggaaattgctgtaaagtgctctgtactagtgtaagataaatacataattagtatacttaaataaagaaaaaaatagagtagaattctaggagtggttcttttttctaggcacttctaaagctgttattcactgagggcctaaataccttgtaatgtctcttcattaagtttttgttcatgaagtagcgagaaatgaatagctctcagtcaatatttaattgatgcttatacattgaatttaatcaggaactatctaaatgactcactaaccaacgaaaatttaagcaaggcaaatgtaacaaaggaaaatggggagcaaagcaggcaaatggtaccagattatgcatgagtaagaaatatgcatgagagaaaactttcatgtttgaagccatttgctacattcctggattactctagcacagcctaaataattctgattaatgcagcctcccaacgcatgatatagtctgcaatgaaaatggcccaaaatatataccttaatttctgtacaatgtactggttccttgttttagtgattctgtatttgtaaaagttcctatattgagtttgcttcaaccgtattgactgctgaagctcaagttctgtttatagcaaaggtcagggtctaaatatgtcttagagaagtcatagttatagttctccataattggagaactatatcgtacaacttctgccatgaatgtgagaccatctaatagtcaaactagaaagagtgaactcatagaacaccataagtaaaatgtaccccagataacatccagaccaaatctcattttatagtgcaggaaacttaggcgcagaaatgtttggttaaaagtggcacagattcacacaaaaccaaagtcttgatgttcagcatgcagaaggagagaacgtagttttccacaatttttttttcttcctcaaagatgggacaagggtgaccttactcgcattaaagaagtggatgatacttagttgtatttgaaagaaaaagagaacagagttctcatgctttgaaaacagaaagtaaatatgtatgatctcacttatccccctttatctgaggtagatacattccccgtggagtaggacagagcgtgatttcttcacgctactcggaatggtgtagaatttaaaacttatgaattctttatttctggaatttcccatttaatatttttggaatgtggttgactgcatcaacaaactccagaaagcaaaccatagataagaggggactactgtttatgaaatctaaaaaaactgaactcacagaagtagtaaaatgatggttactgaggttgggggttgagagggggagggaatgggggattgttggtcaaaaggtacaaagtttcatgtatagacaagaggaataggttttgagatctactgcatagcaaggtgactataatcaataataatgtatatttacctaagagtaaatttcaaatgtctcaccacaaaatagaggtgaggtgatagatatgttaattagctcagtttaatcatttttgatttttacatatatcaaaacatcacattttactcataagtgtatacaattatgatttatcaattcatactaataaaaacaaacaggtctggtgcggttgctcatgcctgtaatcccagcactttgggaggcccaggtgggtggatcatgaggtcaggagattgagaccatcctggctaacaccgtgaaacgccgttgagaggtgacaatgtgctagcagccctcgctcactgtgggcacctcctcaggccaaggcgtccactctggccgcacttgaggaacacttcagcctgccgctgcactgtgggagcccctctctgggctggccgaggccggaaccggctccctctgcttgtggggaggtgtggagggaaaggctcgggtgggaaccagggctgcgcagcgctcgcaggccagctggagttccgggtaggtgcaggctccacgggccccacactcagagtggcaggccggcacagccagcccctggcagcgagaggcttagcacctgggccaacgggcggaggggatgccaggttccccagcagtgccagcccgccagtgctgtgctcaaattctcaccgggcctctgctgcctccccttggtgcagggctcaggacctgcagcccgccaagcccgagctcccccacggtgggctccggcatggctggagcctctccgacaggtgccaccccctgctctgtggcacccagtcccatcaaccgcccaagggctgaggagtgcaggtgcacggtgcgggactggtgggcagcaggggatctactaggcgaagccagctgggctgctgagtttttgatggggacttggagaacttttatgtctagctggaggattgtatatgcaccagtcagcactctgtgtctagctgaaggtttgtaaatgcaccaatcagtgctctgtgtctagctaatctagtggagacttggagaacttttgtgtctagctaaaggattgtgaatgcaccaatcagcactctgtctagctcaaggtttgtaaacgtgccaatcagtgctctgtgtctagctaatctatggggactgggagaacttttatgtctagccggaggattgtatatgtaccaatcagcactgtgtctagctcgggttttgtggatgcaccaatcagcactgtgtatctaggatatctggtggggactgggagaacttttatgtctagctagaggactgtaaatgcaccaatcagcactctgtgtctagctcagggattgtaaacacaccaatcagcaccctatcaaaacagaccaatcaactctctataaaatggaccaatcatcaggatgtgggtggggtcagataagggaataaaagcaggctgcccgatccctgcagtggcaaccgggtctggtccccttccacattgtggaagctttgttcttttgctctttgcaataaatcttgccgctgctcactctttgggtctgcactgcccttaagagctatgtccttaagagctgtaacagtcaccgggaaggtctgcagtttcactcctgaggccagcgagaccacgaacccaccgggaggaatgagcaactctggacgggaggaatgaacaactccggacacaccatcttttaagaactgtaacactcaccgtgagggtctgcagcttcattcttgaagtcagcgagaccaagaacccaccaattctggacacaccgtctctactaaaaacacaaaaacaaaattagccgggtgtggtggcgggcgcctgtggtcccagctactcgggaggctgaggcaggagaatggcgggaacccgggaggcggagcttgcagtgagccaagatggcgccaccgcactccagcctgggcgacagagcgagactccgtctcaaaaaaaacaaaaacaaaacaaacaaacaaaaaaaacataaaggagtcctcacttgatgacaatgatgacagcttatatatttagagcacatatgaaatactaggtactttcctaatccttataaacacattttcttatgacgtaacctaaagtaggttccaacatctcataacatctcttcatcttgttgattaaaaacacgtaagttcagagtggttacataagcttcccaatatctcagtgtaaatctgtagcagagatgggattcccattcagttctatcttgactccagggtcagaattcataatcacttccatattgctacagttgaataagaactgtattttgggctgggcatggtggctcatgcctgtaatcccagcactttgggaggccgaggcaggcggatcacctgaggtcaggagttcaataccaggctggccaatgtggcgaaaccccatctctactaaaagtggaaaaattagccaggtgtggtggcaggtgcctgtaatcccagctactcaggaggctgaggcaggagaatcacttgaacccgggaggcggaggttaccgtgagcccagatcgcaccactgcactgcagcctgggtggcaagagcgagactccatcagaaaagaaaaacctgaatattttgaaccttaagtgaaaggagttacataagtaggcttcaagaaatgcacccaccagagtgataccagagcaactatttgcagtgaagtactaatagggactttgtgtatgagagtctgatattagcagcaggcagttgtgctgtagtgctttcagctggtattgcagaaaaaaaaaatcacacttggctgtaagtaagctgttgattgcttacacgggtttctgtggcatgccagctctccctgccacctactcttccttatcaaacagccaggagttctaagtgaggtgagaatcccacttgacaagcaggcataaaccatttgaggaaaatacaaattaaaaggctccaagacagaaataggagcattagcagcaggaagtgtcttggggatacattgtgtcagattacatccaggagttgggagaataagtgagtcatagcctcccagtggataagccctgttgtgtcagtagctgggcagcctcagaagctgtattagctatttaaagttgccagaactgctgtgaatgcccccaagctagcatctgcttagtaacatccttgaattatgcgcagtatgcctatttctcaagtagcttcagcatttctcctaacttctgacctgtgtcaaagcatagtgatagaattttgttcgtgtttaaggacagtaatacagaatagtaaagaactagagatattttgctcaagatcacctagcgagtcaatcaatgagctaaaattacaatgttgatctcaaggaacttttggtctgtgtaaaaatatggagcataaatataatgtcattgcacacatttgatcaatgtcttggccaagaaatctcagttgtcagaaacagaaaccctcttaatttagtccaaacaagaatttagtttacctgaaggatacagggaatctcatagaacttacagctacgaagtacagctttgttcaggtcaggagcaaaggttacctttctgtatttctgggacctatttcagggaccctgtggcacttagcattctctcttcttccccaatcccctcctgcgccctcctccaacccctgaaggtattttctttcatctttgcagtttcttctttctaccttagtatgtattcagtcgatactggccatcctagctctagactaacatgacccactggattgggtctctgtatcctaaccagagattccacagtgagaaaaatctcctgctccaaacagtttttagtacaaggaaaaaccaggacctcctaagataaagagttgcattcttggcagagaacccaaagatttttaaaatacattcagaaaattgccatcaatgctcaattgtaatctaattcaaattgtagcaggggcagggtttatccctggttagtatataacaacaccgggaagccacttccttcctgccttccagacctcccctcagttgttgcctgggtgctttttaccttgattggctcagtgtttcctgactgctaatcttgtatcaaagagaatccaatacaggtattggtgtttccacttcctgttgcttacgtcatttctagctattggtggggagaacagttgttactggaaaggggtcccaatcaagaccctaagagagagttcttggatctcacataagaatgaattcgagaagagtccataaagtgaaagcaattttattaagaaagtaaaggaataagagaatggctactccataggcagagcagtggcatgtgtagctgggttcccatttttatggttatttcttgattatattttaaacaaggggtggattattcatgagttttccagtaaagggatgggcaattcctggaactgagagttcctcccctttttagaccgtatagggtaacttcctgatgccatggcatctgtaaactgtcatggcgctggtgggagtgtcttttagtatgttaatggtttataattagcgtataatgagcagtgaggacaaccagaggtcactctcttcactatcttggttttggtggatttcagccagcttctttacttcaacctgttttatcagcaaagtctttctgacctgtatcttatgccaacctcctatctcatcctgtgactaagaatgcccaacctcctgggaatgcagcccagtagatcttagccttattttacccagcccctattcaagatggagttgctcttgttcaaacacctctgacacagttgctgtcttttttcagctctggtcaggaacttattacaggcaaagtgctttacagcttaaaaaaggagggataagggaatagatgctgtctttggctttggccttctttggaatatctagcttcttaactaagaataaatttttataagagacatttagatactgttaaagactagcactagacatttttactagaaattccaggattgtcaacacaataagatttatgcagattagatggtatggtgttgtttattattacaacttgataactagaccagtacttctcaaacttaaaagcgcttacagaccacttaggaatcctgttacaaatgcagattctgccctaggaagcctgtatggtacctgagattttgcatttctaaccaagacctaggtgatcctgatgctggtgacccacaaaccgtacttaagtagcaatgacgttaagatactgttttcatatccagaatcactgtacttttcagaatagaaattaatagtctaccttcttatttcagacctgaacaaaatgaacttcagtttaggtgggttacttgcttaaggacaatatagtttgtaacagtgttggaattaaaagctagattctggtgattctgttataccaacttaagggactaatatttattatgtcgattccatgctgttttgttcactttactgaaaatcactgcatacgtagccttaattcactatcgctgtctagttttcagctctagtaggtattgtaaacataaacatacacagaaacagatttatctattttccagccaagcttttgcaaagcaaaatccaggctgcagagagattgttgattgatactaaaattttgacagctgagagtatattttcagcaacaagatgagtaacttgggctaaaggagactgatgagaataaaacttagatttattaaggacctttccagtgagcagtctgtgtcatttctcaatgcaaaaataagtagtgtccaattccaattatatgatcctgcaacacgtaatttagctttgattaattgctataaattgctatcatcttcttaatcctgtatgtatttggtatcaggctttaatgcctgtaaatttaaatactggggtactcaatgaatttccaaaataatactctacagaatacatcctatttcatttagaagtttttaaaataactccagctactgtcttttatgtaatatgtgaattctacacttatcgtttcgttttataaaccgtatgtagcagcatcagtggattgggaacacctgtgtaccccatgtgacattttacttagtgtggacgaggggaagtcaactgcagcaaaatcatttcttttgatttctaacaatttcttctagccttatctgtaggatacttgacaaaaaaaggatacaatatttctatctatttaagatgtatatcacagtccacttaacagtttgaggaatgttttggtagtttctgtgaccttgagtaagctttccatttcgagcctccgtttttgcaactacaacatgcagacagtaacacctacctcgcaggataatatggatgaaatgacagcatatttaaaagcacttaaccagtgcttggcataggaagcactcagcaaatattcttttcttatttcctgaagcatttaatatatttaggattaagcgatagcaaaatgataattctctttacttacctctggcatctagaatgctcttggtgactggaataagttttaattgtaatcaaaactgaacgattaatagtgtaaacttgctgagggagaaataaggaggacatgctttccagaaccaattaaaaatgattttagatgatctgctatttcatattccccacaccattgcttttcctattagcaggtataagtgagaattaatggcaaataatggcaacacaaatcagtactaaagtgcatagtcatttttcatcatgcagctaaaacggtattattaatgtcaatttattggttatatataatgaactactatgctggagttttgtagaaattattttttattccaatatagttacttgatcaaggagactaagttccttttataaaataccagaggatgtcatgaatgaagaaatatggctagtccggtgcaggctgtgtatgcaggagaatgaggttttctctctcacaattacgtgagcctctgcagagtgtactttttcctggcctccagttgtggttaggtgctactggtagatttataaatatgtcatagttatatcaaatattttaatcattctgagccttttcgcctcatccaagtaaaacaattgtcttctccaaatgaagtattgtaaatatttatttgcagattttaatcaacctgtgacagccctctcatatgataaaatggtaactttgtaagattcgatgccccaaagatacatctgcaccatttaattagctggatgtgagtctacagtagagtcaacttagtttttacagatgggcttattttctgattggagagaaccgcatacagctatgtaattattacaacgtataatgtacaacatacattatatatatagtgtataatactccagtgttcacttaggagttcctatctggaattggtcttgtatctgttataaacaattgtagtttctgatagaagttacataaacatggagggatttttattggtatgatttcaaacaaatcattttctaccttaagactgagtcaaatccaaactagcatgtgcttaactgaaatcatgtatatatgattttgttttgttttgtttttgagacagaatctcgctctgtcgcccaggctggagtgcagtggcaggatctaggctcactgcaagccccgcctcccgaattcacgccattctcctgactcagcctccagagtagttgggactacaggcgcccaccaccacgccctgctaattttttgtatttttagtagagacagggtttcatcgtcttagccaggaaggtctctatctcctgacctcgtgatccacccgcctcggcctcccaaagtgctgggattagggtcgagagccacggcacctggccgtatatatgattgtttattcactaattccttcacttgctgaacagatattttggagtttctaccaaattctaagtattgtgcagtatactgttaagcacaaccttgtttcaaaggaagtagtagtcaaagcagagtgaaaaccagatgaacagattattcgtcttaatctacagacttagaaggaaaaaactaccaggcattatctgccagatcttctcataagcactttcacatattttctgtcatatgaacagattatgactatttattgtgattagacctgtgttattttgaagcatgaagtaaatggaaaatgtcacaggagaggtgacattggaacaggatggtaaagagtaggagattgcaagagaaatctattctgtttgagaacttctaaacagaaggtcagtttgagcataaattaatgattaatttttattcccttatttttagcagtaaaaaaaaatattttactgttcagtttaaaaatgtttctggaatccttagggttttccttttgctccccccaccccttaaacaattctatttcatctttcagtgaactggaaatactgaaaaaatataattttgtccgtatttcagtcttctataatatgtttgcccaatgaaatatgaacacaatattgcataatactgaaaactggctgtattagtccattttcatgctgctataaagaacttcccgagactgggtaatttataaaggaaagaggcttaattaactcacagttcaacatggctggggaggcctcaggaaacttaaaatcatgcaggtaggctaaggggaagcaaggaaccttcttcacagggaagcaggaaggagaattcccaagtaaagggggaagagccccttataaaaccattagatctcgtgagaactctctcactatccggagaacagcatggggaaaaccacccccatgattcagctaccttcacctggtctctcccatgacacatggggattatggggattacaattcaagatgagatttaggtggggacacaaatccttaccatatcactgggatttaaaaaatttgtaaatgctcatcatttacctgtctgaaagagtggtgtggggttcaggatttcctctagcgtaatgagtcagaatactgattgttataaatgttcactgtggctcttttgtgggtattgcacaatgtattgttgcttttcttaagcagttcataaagtaagtaaggaagtgacttgtatcatggtcatgatataaattgtattagacaatacatgatgagatgctcaattcttaaaggaggagagattcttctttaatcttaatagcattttctctgtatctccttcctagaacataagttaacgtgtgtacctgtattaacctcacccaccttggtttgcaactcactgagcacaaggaatatttgtattaatacagttgttctaactcagtgcttttcaaccaggggcaattttgtccctcaggagatacttggtagtgtctggagacatttttagttgtcaacactggaggataggtgctattttgtaaccagtgggtagctgccaggtatcctgctaagcatcccacaatgcagaagatggcctgtacaagaaagaatcatctggccaaagatgtcaagtgtcaaggttgagaaaccctgctctgtactataccctggggtcattctgtgactttggcattgttagctcatacattcagcccacactaaaaaggagaaattgatcacctaatgtgtttatccaactgtattggaataagagctgagttattaggctggaaattacatgttctgctgctataaaaaaattttacttttataaaataaaaatattttctacctaaaaaagctgaagaaataacttctcttgtactattgtgtggccgtagcattagtgacttcattcagtgtgtagacattgagcagtgagcttattgataggccctgcgaatctgtgagggagcaggatagacacattgttctcattagctctctaattccacaggatctgagacagatgtgaaacaaataattacttaaatacatattaaaattttaatatagatacatgatttatggtcagcagaaacacagaaactatagaaagacctgagttggaggggtctaggaaaagttccatttaagtagaaaaaaggaggtgtaagagttgaccaggttgattaagcattccagggagtgggaccagcataggcatgaacttggtgcattcaaaaaactgtaaggaaccaagtatgactaagtgcagcagttaaggagagtggcttgagcatgaggcagggcccagatctatcaggggtccctatattccatgtaaaggatttctaactttattctaacaacaagagaaggagtttatcccagctctggcaagatggtggtggccgtggtgctggcagctgggttgtgccctctgcagagccatggcggccccagggctgcgcggcacacatctgaggagctgtaggtgtgactggtgggaatgaaatgaccaaggcccagcgggcaattcctgggggtgtagccccaaccatcttctgtgggatcctggaccatcgcctcccagcctacatcctatatgaggactagcagtgtcttgtgttccctgaggtggctccataggctcctgtgcactttctggtcattcctaagaagcccattcctcggattaaccaggctgaagaagaagacagcagcttcttggacacctactccttgtgtgtaagaagatagcaagggctgagggcctaggagatggataccaacttgagatcaatgatgagaagctgggtgaacaatccgtaaatgacctgcacattcacttacttgggagctgacagctccagtggcctccagctttaacctctgaactgaccaaggaccctagacctgggtgcttggatgggaaagagaaaaagggaagctgtgatgttaataaaactgctctctcccaaaaaacaatcaatcagtcaatacatacataaataatgaaaacaggggaagacttttagggagaacaactattataagattctcacataaagcctaaataaagcaattgaagaacattacagactgttttttttcctttttctttatattttcttatttttcatgtatctgctgagacaatgttccaggtttctacaggaggatcttatgatccattaattggattgaattattgtaggtatctatatctgaaccagtcaaagcctggctgattctcttatgtggtaaaatgtcaaagtatcttcatactgcacctctccattagtaagccatgtttttagcaccttgtggtaaaatatttttcagtgttactaaagaaaataaactagtatttttcaaatgtctcctatgtaatgggagggaagtaacattcattggttgtttaccaagtgctaggactaggctaagcctgtcacctctcttcttcctctaaagcaggtgttttgtttttcataaagattagaaaaccaggtctcagaagttctaaaatgccctagtaggttaagactacaattagtaattggtaaacatgctgttagaactaatctttctgactcccaagactgcaacttttctctctgcaacatggaggagctaggtcatttatatgtctcatttttaagctatataacaaccatgtgaggtagacattattattcacatattttatatgtgtagaatctctatctagggtgtctcagttagtaattcctgggagctgcagtttagatccagatttacctgactctggaaactcttttcttttcactgcactctgatactgtctacaaaaattaccaaagtctaacatctttcctccttttatagactttcacgaagatagagaataactggtcagcatcctcttcaaagtggctttctgtataatttaaagtaatcttcaaggtggtattgatagcaagcttcataaagcatggactgtagtaattctgccaaagactgaaacaataaatagtaaggtaacatataatctatagctttaatgtaggtgatttcctacaaatagaaaataaataatgcctattgcatatttccagttatatgatctcttcttaacaatcattggagaatagaatatttataacagactaggcaactttatgtttcacccatctgagagctagagctttgcctggatatagtgctataatatttcaatatgactccttaaccttgtctagttgggggcttggtttgggggtgggcaacgtggtatatttcaattaaattaactttggaaatcatacagtgctagatttgaactctactgctgaaaccagctggcagtacaactttaaccctctgattcgctgagacattttttattaaatggaaataatatttatctcagagttgttgtctcgatatttataaggtgcctagcagagtattagatagaaattcattaaattggaaagttccaacatagtcatcatcatagttgctgcccttgctgtttttattctattttgttgttaatctttctatttccaaggacccctaagggttggcacagcagggagaaaggggtcctactggaatctttggaagtgttgacaatagaatttcctttaaaaaacctctcaaatgttagctgaggttagatcatttcaaaagaaccttctggcatttgttgacaatagagccattctagatctcttttaatctagttgagtccccggagaacagttaaatagttatagtgcaggccttgcgcatgaagcaaataaagtcaatggatactttattgcactgagttgggaaattacaagtaaaaggaaaaaaattatatcaaatgtggcccaatgaatctagtttcctggtaattgaaagcacttgttagtgattccaacaaagttaagggaaaacattctattgttaaaaagagacacctctctatggtgaatctaggccattgccatgacaatatcaagtcttgtcatttctttattttactttttgttctctctgaaatatgctgttttcatagtccacaagataatattaataatagtgcgatttggctttgtattggagacatttttcaaagcatttatttatccgttggggataaggaagttacaatacaatacttgatatttcgtgtgtatttcacctggtaacttaagtacgtttctaaattttcaattttggaaactcctatggttgttctttggtttaattttttttttatgatgacagaaaagactgtaatgtgatttgaagcccttgtaacgagtacaggtaataatgtatccaggatctcttttcttctcctcaatgccaagttaccttacttggttcagcctgacagtttctttcatctgcactccctgcgtagttcctacgtttaacctgcctgaaacacagctcctcttggtccctcatgtgggcaaaagtcagccccattctctggagtaatgagtttgatcttgacattcagcatgcttcatgatttgtcctcaacttgactttctaatttctgaatgaacatgtttcccattactttccaggcccagtcaaattaatcttaatgatgttgaattacattgaacacaaatttatcttttcaaactctgttctacacagttaataataaaggaacaaggaattgggggaaatgcaaagagagaaaaagtgggagaaagagacaatagaatgtacatatatttctatcttacgttctgctggtgatgcttcttgccaaagtgaggctgagatgagatgtgagattcccttctccaagttgccatctgcctcttttgtgtgaatatcttgcaattctcagtgtgattcttgagtttaaataaaaaaatatatatataccatgttgtccctaaatacaggtcaaaagtcatccacatatagtgctgagtttaaaaacagtgacctatttcaatgctaggaaaaaacaaaacgtaaacacaaaacacagaagtctgtctatgttgggtttgatgaaaagagggtaaaatgttttatttttgttttcggttctgcctcaaatacggttttcctagtctacaaaattatattaacagtggagcaatttaactttgcattgtagacatttttcaaagcatttatttatcctttgggggtgaggaagttacaatacaatattttatccatacccaacatggcaactccataatgaatttgggtaattttattacatgatattttcagcttgttctttgaaccttagctctcaattatactactttctctactggcagcctatcaatgtttggaaagcctcttcatttcttggttatttcagtttccaaaaagtgaatttatacaggtagaaaaaagtacattttcacgttttaattaactgagaatccaggaaactaaattcatcaaataatgttgtcaatttcatataagtaaagtctttttataagtcatccacaaaattttaaacatcaggacctaaattctgggattctgattaaaaacttatgcccatttcattcatgataatacttttctaattacaattttcctctttgttaaaaaataaggctggacgcagtggctcacacctgtaatcccagcactttgggaggccgaggtgggcggatcatgaggtcaggagatcgagaccatcctggctaacatggtgaaaccctgtctccactaaaaatacaaaaaattagccaggcatggtggcgggcgcctgtagtcccagctactcgggaaactgaggcaggagaatcacttgaacccgggaggcggagcttgcagtgagccgagattgcaccactgcgctccagcctgggtgacaaagcgagactctgtctcaaaaaaaaaaaaataataatagtaataataataataaataaataaataaaagggagtggaaaaaaatctaccaaaccttggattcaaagtccatttctttcagagattttattgtaagcattatcttattgactatgttcacataacttttaagagctaaaagaataccacgtttaatatgttgcactctaacaattttaactaaaaatattcatgcttagttacagtgtgtagaaacccaaaatattaaggatatatgtactttgtgggatgatcctctgatttaatatatgtggtctcttgaatctccctatattgaaccttcattttctaatatttattgtgcagttctctctctgtggtgtgtgtatgtgtgtgtatgagtacagaaatggtatataataaaaagcagtttctagcataaacaacaaaatgaataaactacacaaaattacagaaaaaacactaatctacagaagaaaaaaatgctggacctctaaaagtgaactatttattattcttgagaaaagcttatcaaatgagacttgcaatatatataagttgcttttccagattttattttaaaaatacaaaggcaaattactagtgctgtatttgtaagattaaactgcccactccccaatcagatttttggattatttacatgaaacgaaaaacacaaaccacccttgaaaatacgaaaatcttaattatagttacggtgtacagtggataagtgaagttagaatatctttctactgatggaaaaatgtcacttggctttgagatgagtcttttttttatttttattttttgagacagagttttgctcttgttgcccaggctagagtgcaatggcacaatctcagctcactgcaacctcctcctcctggattcaaggtacataccaccacacccggctaatttttgtaattttagtagagacaggggtttcaccatgttgaccaggctggtctcgaactcctgacctcaggcaatccacctgcctgggcctcccaaagtgctgggattacaggcgtgagccattgcacctagcatctttttaacacagggagagaatccattgaaacttttttttctctgtaacccctaacaacgttcggactatttcagcctttaaccatttggccctactgagtgtcattagattggcctcaggatccgtaagtactattatttttctcttgagcttacctctacatttatttaagcatgaaccttctcagtggttcactatagctttacaattcagcactttatccaaatacagctagaaaacttctttttttttttttttttttttgaggtggagtgtcgctctgtcgcccaggctggagtgcagtggcgcgatctcggctcactgcaagctctgcctcctgggttcatgccattctcctgcctcagcctcccgagtagctgggactacagggcccgccaccacgcccagctaatttttttgtatttttaatagagacggggtttcaccatgttagccaggatggtctcgatctcctgacctcatgatccgcccgcctcggcctcccaaagtgctgggattacaggcgtgagccacagagcctggcctctttttttgttttaacctctcatttcgaggcttctgtttgatctgtgttttagttagtctgagtttatatgtggctgtgtctagccatttacgtaggtcaattggactcaaaacccatctttcacttgaacctgcctttctttacctatcctatgtgcaagttctcttgctatttattttgacaccccacaaatttatcgaggttaatagactactaattccaaagcatttctaaatcagattgagtctattctctcagatctgtgaatacctattagggatggtatttgagataaaaatatgaataaaccgtacccttcacattttcttaaataataaaaaaaaactgaacagaagtgcaagactataaaatctctgactgcattaggagatcattattgcagtgttcaagtgtatggttatgactacaaagcaagaaaataagttttcttctctggttaacttacagccacatctcaagcattataaagaagtgaagagggaaatgataacgtaaaattggatggtgaattaaactttcattgtgtgttgagctcatcctaagactaaagcacagaaacatgtccataaaaattgtgattgtttttttgagatggagtctcactctgttgcccaggttggagtgcagtggcaagatctcggctccctgcaacctccgcctcccaggttcaagtgattctcctgcctcagctcccgagtagctgggattacaggcacctgccaccatgcccggctatttttttctatttttagtagagacacagtttaaccatgttggccaggctggtctcgaactcctgacctcgtgatctgctcacctcaacctcccaaagtgctgggattacaggcgtgagccaccacacctggccccaaaattgtgatttttattggttataagacctaggcattgtccctgtttttgagttttggaaagctaacattttaaactcctgttcacaaaacaggtgagagtaggactttcccctctcactgtgctaatcatattactatcgttggtcttgtatcaatttttaaaacatcatagccattattattttgcagtctgtattatttcttctaagtattaaatgacagatattgatatgaagagcaagaggctctccaaggaagcctcatctgtacaaagattagcaagaggttgcagcaattatgaaagttgccagaaatcacaaatgttcctaattttagggagaataggatgccccccatcacacataatggctttatcatcaggatttgagcccatgcagcagaatatccaggttctcttagaaaccagatgcttccttcctcctgcttggaaattggaaatatatttacatcttcaagaatgcgcgaggttcttctctgaagcagagccctgcattgcatctaattgtagaaattacaaaacttgtcagaaagttaaaaaaaataaaagaaatagtaacagttgcattgatttagaaccagctgcctttcttttatccaccctgatagagtagtgctttaattatttctcctaactaaaatgatacttccctcttgagaatgtctgggcctgtttatactgtcaccatcgttttgatacacaattgtccatattgatactctgtttttaccattaattttccaaagagcctctgaactcattgatagtgccggaacacagccttgccaacacagtgcccagccctggtaaactgagtcccgacaccacttttagttccaaaatttggggaaaaaatattattttgctttcacattctctctgctctctttaatacacacaactgaattcacagcctgaggccagcagagagcttagttatccacatctaaaggccccatgtcacaaaatttatctctgatatttaatatctttgaaagcacttaatacaagcccagtgttagctattctgtagtatgcctgaatccattaaaatgaaaaaaacctcagtaatgatattatgttgaagagaaatgttttataactgtcatactttggttttcctgaaatcataaaatggtcatgaaaatgatttacaaaaaaactgggttagagtgtaccagagtaccatagtcaagtataatgacatccaaaagaatgaaatgagcatggatagaggagggagaggtgacagagtaatgaattgccccctactgattttgttcctgtttgatctgacaacattggaatgacagctgctgaatgagacaatttgattcaaatgatttgcatatttttcaccagaaaaagtggtttgtagtttatggaatgagtcccttattctaaatatggtgctaatttcaagtacaggtatcctctgatattttgtgtaagtgaatgtgttacttattgttaaccagtattgatgaatttttattatagatccaaaaaatgatataattttagagatttatcccaatttctatcaaccagaaggtgaatatataccagttttccaaattacatggtgcatccccccacctccctcttttggtggaagattaggcatgcagtttttaagacccaatcaatctattgatagtgttaagtttcactatcctccacctgaaaagcgtgatttaaaagcaccaaactaagtatagcaaagttcttgcattgcttggcaatttcataatttcaggtttatatcgagtgagaattacaatgtgaaggtctttacttgttttgggctataatttgagatggaagtgggagaatgtgtagaatggttgctgatcatatatcccagatgctgcatttgtgggagaatggattgatacccagaggttccttctaacatagttcatcaagccagccagaaatttaagttaaccttgatatcccctgaggttaggttcccactgcacttggagtaaagactagcattctttttgtggctcatacatgccactgtgccattcaactctttcttttgtagcacttattcaaggtacttactgcctttttaaagtttgctcatctgtcacctttcaatacaatttacctttaacaccctatttaaaattacaaaccccaaccccaatgctctggctaacttttgcccttcactttttccttttttcctctagcatttatccttgcatctgtctgtctcagcatcttggaatatgatctcaaagagcacccgattttgtccgtatcgttcaaagatgtaactcaaatgtttataatagtgctttgtacatagtaggttctcagtataacatttgttgaatgagtggttgtttttgtatttcttttattatttaatttttgttcctccgctagattcgtgttcaggattatatccccagtgcctttcacttatttttcatgtaacatatatttttgaatgaatgaatgaatcaagaaaaaggttctggaataattttaatatttacctgtctgttaaaatattctcactagacctgttagaaactcaaagctaaattgaagctgatgtgatttctattcactaatttcctctggcaggcagtgattgggaaacatggtaaataatcagcgcatgtagttgtgctgtttaaaatacagcagttggccaagttctgtaagtatacaaatatattttcagtagatgagttaaaaccagcatctgattactttgtgctgtttggcttaaatagaaacaatttcatctcatttaaataaacaatcatcatatttttcatataaatgatgatataagctctggtaataagggcttatgttattgcttagaataggaaagttgcataaatgtgatcactctcaaaataatcttttgttacatcctggggagggggtaatgacaagcacttgcagtagctctatttatttatttattcatttttattgaggacatatgcttcagaggcttaaaacttaaaagattgaagcagtattataaaggagacataaatggcttttaatgcttgctgaaagcagataaacttaaagacttatgaacatcgtggctaggaatatgtgatagaatgtagaatccaaagggcaataaaatataaatatgtttctaatttgtgtattcttccttgtttaccataggatgtgacacattcagtgctacaagctgactgtctatgtccatatgggaagtatacacattgttctaaaactataaatcagggacatagttgaaatttgacaccaggttccaatccctaatgtcctctgaaaaatgtgagtttataaaggaaagcaatgtttccaagtaaattcattgtcttttggggctggctagctggcttttagagcctgacaggaatgtttttatttcttcagctctagaaaaggaaaagaggaaggaggcagtagaaaaaccaattgagtgagagtcagaagatgtgggatctagtggtaggtgggctgtaataaattgtttgacttaggccaggtgtggtggctcacacctataatttcggcactttgggaggctgaggtgggcggatcactggaggccagtttgagaccagcctggccaacatggtgaaatcccatctctactaaaaatacaaaaattagccaggcatggtggcgtgcacctgtagtcccgttacttgggaggctgaggcacaagaatcacttgaacctgggaggctgaggttgcaatgagccaagatctcaccactgcaccccatcctgggcaacacagtaagactctgtctcaaaaatcataataaaataagataaatagattgacctgaaaagggctttgtttctaatccccctggggttcccaaaactttttaaggtagggaagaaaactggggttagaccaattaatctcaaagtttcatccagtaattacagattcagtgatgactgttgttctttagttaacctcagaaaatctgtgaggtaggccccacgtgggttaagcacagttgcactccttgggcaggaggaggtagtggctgtttaaagacctagagattaatgaaataattactctgcctgcacctcttttctcatccctaaaagggaggactgcttttctgtacttcccaggaatgccgtgaatcgagtacgtacaactgtgttgtttttgaacgctgaaagccaaggtaataattagaaagtgtggatgtcacacttattttataaacactctttaaatggatacatgagttagtgtttgcttgatgttgcgaagcaagctgcagtttttgtctactcttcaccccacctaagaatctagttttcagcattaggcaaatgcttctggtacaagcatgtattaaaatttaaaatctgttaatgggttttaagtaggatcttgatgtttggcagaagtatcaataacatcggcgcctaaaataaatattaagttgtaattttaaagcttctattgtcatatttggacagatagatactgtgcagatacagtatgtggaagcattttaaggaatttcagttctagaaaggctctttaaaggtcaacctaattaaagcaatgtttttgagccagtacaaagtagatgcaattattggaaattcattgcaacagcacggaatggcatttcacttacagtttaaactttttatggttaatttagaaagcaaaaatcatcttttttggggggttcctgatctctgacttaaatgacattttaatcaataataatgatttctttgttaggattaggagaacttttgttctccgggatacatggcaggaatatttagcagctctattttagaacccctaaagaagatggttcttttgtaatgcaagtgctgatctaactcagtaaaggaaatgggcttctcacgtagaaggtgatatgcatggacatttatttaccattgtctgtccatagattgtggaatgaattggcttgtgtggaaaatacagaatgacctatccctggatcccagacagagttttggatactacaggttgtctctgcaaggaaggttacccagctcccttaaaatcattctataggaagttcccctccatgcttcttcatgcagtttaactctaatacctaaaaagaagagttgttctttccccttgatgtcacatcctctgtgtatattaagagtttaacttaaaaatgttacccatttcattagattgcttgagtatgatctgtaactaccccgtatacttcacagactaggtcctcagaagtcctctgcattttcacataaactaaaaacctccagtggtggtgttcacttgtctatgtgtgaagtagggacatcatgcattcctgatggacctcactaatgtggcaaggcttgtttgaaaaaaagaagaaaaaaaggccatgcttctaatgagaaataattattggaagcaataaaatatttatattccattcattaaacacactgaccacgaggaaattaaaaagtattgaattccaaaactatcacaaatacagaaaatatacatgaatgtttaaattttcatttaatgatgaaatgaagatcacattcttcacccttagcaatgctaatcacgtgtcactggttgaaatagtgatcaaataaatgagaaaaagatgaatgactttcccaaaatgttagacctatatttagatataatttaccattttgtaccataacctattacttattttagcaaagtcccaatccactgattattgtcgcattgtgtcatactcttcaaaaaaatgaaaagtccatctgacaatatgatatcttagaaagtcattgtaaaaatctgcttcagtcaaaaaaggttttatgattgcatattaactttgaaattaatcaacaagttgacagtagacagtctctagtgtctctaaatatatggcatgtctttgccataaaatagaaattgctacctacagatattatctgaggcattattttgccttgcggagggtatctgttatgttagagaagtgatttctaaacaaactttggctttgccaaagtgtcatgctgtttgtattttctttggtatgtcacaagtcatcccaacatttccctctcatttctttctttttctttcttctttttctccctaaaactgaaggagatgggtcattttgaagatagaaaagatattacggtggccctattttctaagggactttcaatactccataatatgacagcctaagcttctctagcagaaaaggccgcctgggtgcatcagttaagttacagatcctactctgctttctctggcaatggaggaggcaggtgattgcctaaacacaaagctcctgccaatttctgaaaggcacagtggctggagcaaaaagcaactcatcttcccaggggcctgccctattctgaacatctctaaactaaaatgattcttcttttcttttttcttgatcagtcttcagtcactatttttatatcatgaagtgttaccgggtttatgtgcctgtccacatttcataaagttagaggacatatggtaaaaatctaagaataacatcataaatcatccatgcctctgaattgcttgaaaatgttaaatgccttggttttggtccagatgttcaacttgccccttttataccagcctgacatacatcagttgaaagaagaaaaaaaaaaagagaaaaccctctgctgttctctttcagcttaatggttgatatatttttctttcttctctgactttgccatttattgaagcatagacgggtgccctaccctacatgaaagctatttcctactgcttgtgaaagaaaaaaaatatgaaataaacacttactattctgttacaaggtaacaatagagtgctaattgctgagtaaagtcatgtagccccaggattatgttgagggactccactataaatttgaagacacccataatccatgtatcaggcagaaaatgatttgctgtgctgcacttctcctttaacagtttctatcgaactatttaattaaatggaataataattattattccctgatccaaattagaacactttcttgtttaacgttcctagtaagtgcacaataaatattaatgttaatggtgatgatgatggtgttgatgtgttttatggtaagaaccaagaattatgggagcacagaaggtggatgacttttcccttttgggcaggagcagtcaggaaagaattcacagaggcggtaatatttgaagtggtctttgaagtatcagtatttctatatcactaggtgattcttgagatgaagataagtgtttttgatgcattaagcacagtccacagttgcagttgtcactgtttttaggtctttctaccttgaggatttcccagttctcaattttcatgttctgtttgtttctgtataattttgtggagttgggcacttgtatgttaaaaaaaaaaaaaaaaaggtcaggttaacatataatatgctctgctatttccacttttgatatttgctttcttctctcatgttggttgtgtgctgaccatgcactgactcattatctgtcaatgctcagttcttatacagtgttaaggcaccagctgaattaacacaaaaagaaaatgacagagctcagcagggcgcggtggctcacgcctgtaatcccagcactttgggagactgaggcgggtggatcacgaagtcaaaagatcgagaccatcctggccaacatggtgaaactccgtctctactaaaaatacaaaaattagccaggcatagtggagcacacctgtagtcccagctacttgggaggctgaggcaggagaatcacttgaacccgggaggcagaggttgcagtgagccgagattgcgccactgcactgcagcctggcgatagagcgagattccatctcaaggaaaaaaaaaaaaaaaagaaaatgacagagctcttttcattccaagtttttagataccatatccagttgttgttgaacatgatggcattattagtgttttcagtagctcctctccctaataggaaggaagcaaatgggttgcattgaactctctttaatatgagtgctatcttcagcagtgcttcattatacaaagtattaatagaatgactggccatgcctgcaatcctcagtcattttctctagcttcctcacccacacacaggttgttaagtcaccaagagatgtgttacttctgtgctgtgccctgtgaaagctttcctctctagagatctggtatcttcacaggaaaggtcaaataggtttcattgtctttgcacagtatcacactaatttaagatttgagtttcttttaaaaaacacagctgtgagagagagagagctcctctgaagctgagacagtaaaactgaagatacccggaatatttataacatatgtttgcataaagcaagcttgtccaacctgtgacctgtggaccgcatgtggccaaggatagctttgaatgcagcccagtataaatttgtaaactttcttaaaacatgatttttttgtgattatttttttttaacctcatcagttattgttagtgttagtgtattttatgtgtggcgccagacaattcctcttcgtccagtgcgacccagggaagccaaaagattggacactcctggatgaggcatttttaaaaagcagataaaataccaatgtaaagatttatttttccaaaagagtggattaaaagaaagacaagtgctaacaactgttgttgtcacctcatggttttttcagttgtctgtatgagatggcatcgttactgactcttgcaatatttggaataatataaactaagtaccacagtgtagtttgaggcttgagttctataaatacccatttcattaatttggggaggagaaatagatgcgacaaatgggcccaacatacattggctcaacaaaatagaatttatttctcaagttcataaaaatcctgggtggtttcatgtgcgggggaaggagagagtcctctgatccacagttattcggggatgcaggcactgctgtttcagtatgggccttcccaaattctggacatcaccattccattcctcaggatgggggaaagaacccatagcagcttgtgagaggacagtcctggctgtgctataccttatttccactcacactggttagaagtcagtcccattgcgttttttggccatgcacaggggactggggaatatagtccagcttagtgccctggaaaacgggagaaagtggaccttaatggacaggtagcaatctctgctactctcattcatttattttttattcaacatgttttggaacaacctatttgttagagactgtgctaggtgcttggtttatcatttcattagcccactggcctccccgtagtacttcagggaaacagctaattaatttgtgtctctcatgagataaatgagactccagatctaactaaaacacataggaaacttgacatttcaagcttagctcctttttttttttgaagaaggattacaaataatctggtggtagcattatttttttttctcccttgtgaatcagccataggaagaggagaatttgtgttgtcattcttatttgtattctgtaagaatgcttccctttactactggtattagaggaatgtaataccaataccaatatcactatcaattagaggattataccatagtttcataatcttttcaatgtaaggtagtttaatcagtcaccatccacacttcaacaattttccttttcattgccatgtaggttaaatgaagtcaaatacaatgctcgtgtctcttgtattgcccattcattgcctagcatgtttacctatacaataggcatatgatagtcttttaaatatggaataacaacacaagcagcataaaagattgagacagttttctaataatcacaacatatatcccattttttcttttatttcacttttctttttttcttttcctttcctttttttgaatttctttttcctgcctacctttttccgtttcctttttttttcttctgtttttaagctttaccctgcagatggttaccaatatgattaaaattcttcaagaagcatgcagatctgcctattatagaagggaaaactataaggttacagattctgggtactgatcccactctggccactaacttctgatagtaccttggatagataactttattaattgaggtggttgacctcaatatcctaatgtaaaagatgaagatattgcatccggagtaccacaggcctcttttgtcttttttatataactgctatgttagtataaattgttatttatgagcattagatgagtatttataaaatatgtcagggataggagatatcatttgttgttaaaatcttatttttgaaattagactgcaagaatttgaatctgttgtcatgactttttcaggctatttgatcttgggaacattatataacctctcaaagtgacagtttcctcatttgcttaaactactgtgggttataagaatatcatcatggccgggcgcggtggctcacgcctgtaatcctagcacttttggaggccgaggtgggcggattatctgaggtggggagttcgagaccaacctgacaaacatggagaaaccccatctctaggaaaaatacaaaaaaattagctgggcatggtggcacatgcatgtaatcccagctactcgggaggctgagaccggagaatcgcttgaacccaggagatggaggttgcggtgagctgagatcgcaccattgcattccagcttggtcaacaagagtgaaactccatctcaaaaaaaaaaaaaaaaaatcatagggttttggtgataatttaattagatactgtgtctcttggtataagctctcaataactttgatcatctgaaataaaaatgtcattctctttcctctatccattgtgttttcacagaagttagggaaaatgggatgagaattttccaaagcagcccttcctttttatgtaaaatttagatattggcagcgtatctcagcctcaatggtaacattagggtttgcatctctgttgttagtccaggaatctgtttttctcttttgattctttaagtcatttggataaaatattaaagagcactaagatctgatgttgtagattggaaagaggaaatagttgaagaacatgaaatgtgtctattttacctttatatagctatgcagaacaggtgagatttggtatgaatttgaatagtaacgatgcttaccactcttgaaggatattttgcaaattttaattggtttatctgaacaccacttttaggggctaagtaaatattcccactttacactgagtagatctaacaaaatgatcagtttacccaggtcatttactacattgactattgccaaattcagtatatccagattggacttgctgatcatgcatgcttagtgggtttctttttttttttttccattcttatcctattttacataagaacgaataacttattctctctagagtttgtagcttcatttgcaaaaggggatgcctaagagaggaaagagcaaactaggtgtctttctagcttcaaagattgttattttgtgatttctgtattagttggtttataattgaccagatcaatttgaatcatatgtgtttttctattttctgaattcaacactgttattttctattgtcttgagtactgatgtttccaaatttttaaacctttcccttcttttgttttgttttgtttttttcttccttttttttttggagacagagtcttggtcagtcgcccaggctggagtgcagtggcacaatctcggctcactgcaacctctgccttctgggttcccgccattctcctgcctcagcctcctgagtagctgggactacaggcgcccgccaccacacccggctaatttttttgtatttttagtagagatggggtttcaccatgttagccaggatggtctcgatctcctgacctcgtgatccacccgcctcggcctcccaaagtgctgggattacaggcgtgagccactgcgcctggccttgttttgttttttctagagagaaatgggccccaatatttgccttataatactttgtaccttgtcctacatttcccccttagaacaatgtacagaacagtcaacatgacaatcagatcaagtttcaccttctgcacttaggtctcttacttagctatcactagtctggaggtgttgggaacataacttaaactctttgaactatagtgttctgtaatgtggcattaataaatctgaagtcaaaagatataaaatatgtaaaagcgcttaggagaatatctggcacataatgcatggtagtttttcccttctaagtctgtaggttaagatgaatatttgaagactttcaaactgattttcttccaattaaaatatttgtaaatgatgtataaaaagtctccattctttaacaaaggctgttaaaggctctggtactgttttgattatataaattaaaaaattatgtatttcttataaaatattgcatattttaaaaatgtttttagctcattgaaaatattcagaaaacatatattttaatatcttagcccagaatttgaaatttttctatgaaggtgcaaggttctaagaccaaattgtctctgtagagctgtgtaaaattaaaaaaataaaatttcgaactggccagaaaatgtattgttcttcccaaatcttgagacaaaggcacaaaccctgtttcattcacacacaaaaaataattttgatttgcttagggacataagatttatggctctgtgatgtctgctagagatatgtttaaagtggaccactctatacagctttatataaaaaacatggtatacaccttactgaacattcttttcttacattttcttcctatcgtgattttttttttttttttgagatggagtcttgctctgtcacccaggctggagtgcagtggcgcgatctcagctcactgcaacctctgccccccgggttcaagcgattctcctgcctcagcctcccgagtagctgggattacaggcgcgctgtaatttttgtacttttagtagagactgggtttcaccatcttggccaggctggtcttgaactcctgacctcatgatccacccgcctcggcctcccaaagtgctgggattgcaggcatgagccactgcgtccggccctattgtgatttgttagtctgagtttagattacttacaccaggaggcattttttagcctaaatctgtaatcagttaaacaggaacactttctaaaaaattctagttcctaaaaggcttgacttctacttttattctgctcatttatgtgactggctatttgagtttgaattactggtacattaggaacgaaaataaggaatgcttccttttgcttccagattagacaatataccctgttaggtatgccagtgctgtgagttaaactgagctgtaaagtacaggaagggtagcattgtctgacagaactggaaaatgatggattaaaagtaagataaaggccaggcctggtggctcatgcctgtaaccccagcacttcgggaggccgaggcgggcggatcacctgaggtcaggagttcgagaccagcctggccaacatggtgaaacccccatctctactaaaaatacaaaaattagctgggcatggtggcaggcgcctgtaattccagctactggggaggctgaggcaggagaattgcttgaactcgggaggcggaggttgcagtgagccgagattgtgccactgcactccagcctgggtgacaacagcgaaaatccatctcaaaaaaaaaaaaaagtaagataaatagcttcattgacaattgaggaccttaatatgtctgacattaattttaaaagtccaaggaggcaatatattatgtagtatttcccagacttatatgagcatataacttaactcacagaataatgataatcttatccaattacctatccagcatgtgaatcctttttataatacgcttgccttatatttatccaacctctgtttaaatatctacagtaatgagtaaccatttatagtgatgatgatgatgatgaaagtgagaatgataatggctaagtagtgctttcttcctttatactttctatgcacagttttaactgccttaatcttcccacaaccctttgaagtacgtactatttattttttccatttcacggttgagaaaattgaggcctggagggattaggtaaattgtcccaggtaacacagcacaaatgggtctgggtcctagggaatcttgtcaagaatccataaatgtaacgacagcactattttctctctctctccttctgctccctctccctctctccccctctccctctccgccactctctcttcccccatttccctttgcctcccttcctctccctatccttccctttctttccctccctctccttcttctgtctctccctcttctctcttctccctctcctctcttctccctctcctctcccttccctctccctttctttcctctcttctccctctgtctccctctcctctctccctatctcactccatatatatataaattctgtatacagttactccttgacttgtgttctaataaacccattgtaaagccacaaaattataagtcaaaccattaagttggagaccttctgtgtatgtatatatcacaaccatttgatacctatgactgactgtaataactataattaaaaatgtattcacatctctaattcacccttgaaaaaattatattctctgaagttggcttttctgctgggagaataagattagggcctactttatacggttgttgggtgaatcaaataagctaatgaattgagcttacagcatgtagccgtgtgcatcataaggactcagtaacctttaattgctatcattattattaacatcattaatatgttgttgtacaggaacaagcctaaacgtaggccctggtgtactgatggacctgcttaagttcactacttctgagcacctggagggcaaatgctatgaatcctggcttaagttgctttagtctagccgtggcatgcttccaccaaagttctcatcttaccatcttacctcttccaaagtcgcctaattactcgcagcacataaatccgcctgttagattaaattgtggggaaaaagcaagggaaactgcttagatttaatgttagagaatgccaagaagagacatatttattatgcttattttaatggttttctaacacaatagattgggaaatcatgagtttgtcaaaaacaaatcttaagtcatggtgaattgcaaatgcccagctaaatcaggacttaaaattactccctttgtggaaatctctttttcttctatgacacctgaataggactctcacatctcccatgctcttagcccagctattcaggcagctctcacatgtaaatttgtccctggctcctacaccagtaacaactcaatgtgtgcgtgtgtgtgtgtgtgtgtgtgtgtgtgttcatgttacctctacattatatccttggtttctaagtagaaggactaatttttacctatctttttttaacctatttttgcagatttttcttttttgttagtgcactgccttaagcaatattcttttttaaaacattggtttcatatagccccttctacagtggttgacgttcaaactcatttggcttgaaagtcattgttggttttactgcctccattcagatcctccttttctctcttgcttcgcctcttactcttccttcctaactggtctattctggtattacccagaacaaataaattacattgctgatatcagagtgacctgttaaaagtataaacatatcattttctactttaaaccataatccataactcatatcaacaaggttaatcccaaactctttttaaaaataatctgtctactactcaactttctactcagttttttattttttatttttatttctacactttttatttctacagtaatatcaaatcacttaaaactctcccaacaaacaatacctgtttatagttttgtttatattactcttgttgcactgaataacctattagcatacttaaggcagagtctttgtccttttctccactattacctgagcaatattcctggtgtcttgttcatagcagatgcttgtattagtttcttaggactgccacagcaaagtaccatacacagggtgacttaaaatgacagaagtttattctctcacacttctagaggccagaagtccaaaatcaggtgttggtagggctgtgctccgtctgtaacctctaggggagggtcgcatctctcagcttctgttagccccagttgttctgcagcttgtgggagcataactccaagctcatctctcatcctccatcttcacatgctgcattccctgtatgcctgtgtgttcaaattttttcctcttctcataaggacataagtcttattggatatgacctatcctaatgaactcatcttaacttggttacatttgcaaagaccctgcttccaaataaggtcacattcacacgtaccaggggtcaagacttcaacacatctttttagcgacacaattcaacccataacaatgttccatcaatatttgataaatgaatgaatacatgcattctcactcagcagtcgctcccgagaatccttctttttatgttcagaagagaggttatcaccccaccttcattttataggaattacgtcttactataccttgcacacactacttattaattttcatgtcacagtatatttgttcatatatctatgacattggttagattaggaattcctcaagtaagggcctatatattatttatcttcatatctcattgccttacatggttcccagaagggaaaaatgagtgcttattgaactcaaacattctctgaattcaaactctgaattcaaacatttgcttgaattctgactggattattttccttccccacctcaaaattgcattgctgtctgcttgacctttgtgtgacagtagaatggccaggtggtaaagttgcagtattgagacatacaacccatagtttttctgtctgggcctgttttactgtaatcacttcagacaacaaagaatgctttccccatctggggccagttcccctaactagcaaaatcctagaatgccaatagctgggtttcttggaattagtttaaatcattgtttgcaatatgtgtttacattgcattgaaaatatttgttggaaaagatgttttcatttttagcagtcatttttggagacgtttatgtaagagaagcaaatatcacatgtttgaagctagaaaatttctaaggagtacatgaaaattgcaaagcaatttctgtttgtagcttttagatttaaaaagtgatggctaagggcacattttcctctttagaaacgaaagggaaacatttcaacgaattattaagtattacataagtcttttaaaattatttgagatgagttataactgaaacatatacatagggtagttagtgataaattgagaaatgcaaaaatttaattgagcattggagataattattgcagatatttgagataagatgtagctgcaactaagcgcattcaatttagagattatagaaatcatgcatgtggcaaacccgtgaacctctgtttctctccatctgttggctttgcatctttacttcaggaagactacctaaagggaagaaatagaagttagagttttgaacttgctaaccataagtcgtgtgacttccaatatcagttatagtctactatagtaataaataaatattcattttgtgtgtcatctggaattactcaaatttataaaacttatctgatagtaaatatacaataatttaaatgaatgaaatattgaaaaatatctaaagttacttagatgtgacacagtctattttgctgtatatctcttaaaaatgcttttggtaatgcaagggttctttacaaagtattgtctttgtgaagcagttggcaaatcacttattaaatatttaacctgatgagttagttttattattcttaaggcaaatctttattaagagtaaaaagaacatttaaaaaataagtgtacagcacttgctactactgtgaatttattttttatcaaaagaagtatgattttgtattattttgttttgactatgatgttacataataatggcatccttcttcatttatgcagttggcttttttattgtttaagaaatttgtttatattactatttggttacttaatacatagaagaatatttaataatagagacatttgaaaaatataaaaattataaggaatataatgatcataaacctaaagatagctggatgaaattcactttgattttcatttctaagctcttttccaaaaagccaattttcaaagcaggttttcttgttttattttgctgtttttcctgcaagagttgagacactggttttaagggatacacttccattattcttcattatttcttatgttccacccattatacgtgaactatgtgtatcattagaagacagaaaacaaagagctggtcttcccaagaataaagtgtgaatcaaattgattttaaaattgctctgtgccatgcaagctgtgaagttctagaagagtacagtcagcgtcttggaaaagcctgtgtaaaataatattttggatccattgttttggttttcacacagtgacttaagtgtggcattataatttaagtggaaggcttttattggaaatttagcttagtagagctagattaacaatatatgaaattaaaaaatttatgttttggcagcaatttttgtgttttgtctgcagaaggtccttcaagtggggaagtttcatgctgaaagagccagtacaaactatttctgatgagctgtagatacatttgctaaaaaattttcagttattattgctctaatatgctaaatacatgttaaatctgtttctcataatttaaatgttctggatacaaaaatgcttaagaagtaagtatatcagaactgttttcttctgggatcaatgcattgccattctcagtggatgaagagctgagatttgggataccatgttgcaaatagaggagcccacactggcctcccttcctctactctggccacaccttgctattaattactcgaggataagctaaattatttcattcctttgctttctctcagaataaaatccacactccttgctatggcctgcatagtcttatttagaaatctacctaaccaatggctgggcacagaggcttacgcctgtaatcacagcaatttgggaggccgaggcaggcagatcactggaggtcaggagtttaagaccaaccgggccaatgtgacaaaactctgtctctgctaaaaatatagaaattagcctgggatggtggcatgcatctgcaatcccagctacttgggaggctgaggcaggagaatcgcttcaacctgggaggtagaggttgcagtgaaccgagatctcaccactgcactccagcatgggcaacagagctagattctgtctcaaacaaaaaacaaacaaacaaacgaaaaccaggccaggcgcagtgtctcacgcctgtaatcccagcactttgggaggccggggtgggtagatcacctaaggtcaggagttcgagaccagcctggccaacatggtgaaaccctgtctctgctaaaaatacaaaaaaaattagccaggcgtggtggtgtgtgcctgtaatcccagctactccggaggctgaggcaggagaatctcttgaacctgggagggggaggttgcagtgagctgagatcgcaccactgcactccagcctgggcgacagagtgagactccatctcaaaaaaaaaagccacctaagcaacctaattttaactcttgccactcattcctgcatgttgtgcctccaaagaatacccttttcaccgtgatctatcttcacgtggctgcagccttctcattatgttgttctcggagaaaccttccccgtgatgtatcttcacatggctgcagccttctcattatgttgttctcggagaaaccttccccgtgatgtatcttcacatggctgcagccttctcattatgttgttctcgaagaaaggtgtaactcttcagagaggccttgctttcaactatctttcataaatgatcccagttctactactgatcgccttattttatttttctaatagctcttaccactactgcagtttatcacttgtttgttctttctgttcctccttcattcctctttccttttttcttccttttctttccttttactatggtctatctcccttgagaaaatgaatattccatgagaaaatggatcttatctatctccttcattgatgtatccccattgcctagaaagggaagaacaggaactttacagtgaagaaaaggaacctggcagataccaactgaatcaagtgatcaaaggtagcatgacagtaatgggacagatcattattatgagcttgttgatgggttgcactaagaaaaaaaatttcacggaagtatctaattatgaggaaacatcacacaaagctaaactttacaaaataattgtcctgtaatattgaaaattgtcaagaacataaaagataaagcttgaggaactgttcaagattaaaggagattaaagggacatgtcaagtgtatatgaactatctcagatttgctttggttttaaaggacattactgggacaactggaaaaatatgaatagggtgtttacataataatactatatacatgtttattttcagatgacagttttactgtggttattgaagaaaatttccttgattttaggaaatatacaataaattatttagggttaaataaatgtcatgtctgaaacttactgtcaatgggtttaggaaaaaagagtgtgtgtgtgtgtgtgtgtgtgtgtgtgtgtgtgtacagagggcatagaaattatagaggaaatgtagtaaaatgttaaattttgataatcttggcgaattgaagcatatagtaattatactattattgcaactttctgtaagtctgaaatgatcataaaagttaagaaagatgcacctagttaaagtttctatccattaatatataatcagagggcaaaatagccacacagaagcagcttcaaatactggtgtacattcaatgtgcttactaaaacacatgatatagcattaatgttttacttgtttacaagttgaattgatatgaataccgaagacttgtatttttcctgttgaaataattgtaggtaagctagtagagcttatgggttccacttttagaataacatacaggttaaatattttctatacagctactggttgattaataacctcaataggatttttttccccacctaacttcctttgacgtaaaacaatgtttgcagaattaaagcagttttacaaaagaaataatgttgaccatataaccgagacttcatcaagccactttaatttctaaataatgatgttttatttgtttcttgcacttggaaattttgctcagtgaattgcccgacccaaaccttcaattgaatgtcttttaaatagtttgtactcaaaaatggcattttcttctttcagaaaatattttgttcttcaagtatgtttttgaggttataaaataagagatgcaaagcagaattcataatggttattatctggcataaaattgtaataacaggtgttccttgcagattccaaatagctggactgtaatggggaaccagatttagtttgtaatgggctcagtactgaccttccctgctgcactacctgtgggcatcttgctaacatgataaaatggccagaatccgagaagcacctttgtttatggggttggatacttgccatatcttcaaatataataaccagcatccaatcaaaaatgactgaagcataagagtgaaacagagtgcataataagagtgtgttagagtcatttggtgtgtgctgattttaaactcatttgacatcctgttctctgattaaatccacgcaagccccttttatgactatttttacaactgtactatctcagctctacatggctgagtcattatcaaacaatatatgaagccatgagaaacccagagaaagatggaaaagctttggtattatatgaagaatacaatgaagtagctgtccacagcaataaagtcacagatgaaaaccagatataccagtctagtttattaactcatgttcttctaacatatcccccacacaatatgagtgaactgagccttgtttttttgttgggaagtataataaataaaggatgaaacagacgtgatgtttatatgtaatgccaagttagttagctcaaaatttagattgagaaaaagaactgactacaaaagctttgcattggaaatttacatgacgcagcaagaattctgagctcagagctgcttctcccataaacttttgagaatcaaagactgcccttgatcacaaaaacttaccgtagctagctttttgattttgacccaggaaagctcattgaatgcattctaatgtcccatcagttttggaaaagtggtagtgaagcttcttcgaataggggcttccagtctactctttaaatggggcaaatatggacagcagcataaagcactgagggtgagtttttattcaactcatttcattcaatatgttagaattattgtagctgcttcttatgcatctcagattagaactgaaccatctccaaattgcaccctgctaagcagcgccgagccaagtaaaatgttgctacatgaccccagatcagaaatgctaaatcagatcctgccacactgtctctcagccttcccaaatccacttggctatcttctgtaaggaaaagttagtgtcaagaaagcaaaaacaactttcacgtcatcccctgtgaggctgtctcttcaggaagtctataatcagctgtcctctggtgtagatttggtgattttatgtataaagtcacttagcttgttttctcctggctttagaacctccaacatttcctttgcaatctctgttctccaccttcatatccatcaaattctggtcattaaatgtctctggttggcttcctactcattatgccttgttaccagatgaaaaatatgcacacagtcttcatgttcaaggagaacctctgtagcctctcaatttcttttttttcattttattctattttaaattacacataattgtatatatggggtacagtgtgatcttttgatacatgtgtacattctgaagtgattaaatcaggataattagcatatccacctcctcagatatttatttgcagtgataaaattttaagtcctcttttagctatcttgaaatatacaatgcattattattaactatcgtcagcatgttgtgcaatagaacacaaaagctcattcctcttatttaactaaagctttgtacacttacctgtttctagaactcttgacttacccattctattagtttcctaggactcttgtaacaaagtaccacaaactgggtggcttcaacaataacaatagaacaccaaaactcattcctcctatttaactaaaacttcgtacgtttacctctttctggaactcttgacttcccattatattagtttcttagggctcttgtaacaaagtaccacaaactgagtggcttaaacaacagaaatttatcgtcttacatttctggatgttagaaggccaaaatccaagttggcaggttgattacttctgagagctgtgagccactgttccatcctattcttctaccttcttgtggtttgcctgcgatctttggaatttccttgggttacagcttgttgccttcattttcacatggtgttctgcctgagtgagtacatgtgtctgtctccgcatttcctatttttatgagaataccagtcataatggattagggcacaccctatgaccatatcttaatttaactagttatacctgtaatgaccctatttttaaataggtcacattctgagctgctgaagatttaggatttcatcatttgaattatgagagacacaatttaatgcgtgacactcatcttgccacagtgtcttgaggccttccaccttttaatagcatatggcagatagtaatcagtcattcctttttagtacatttctgttttttacagatgtatatatttctgtctattctactatacttagagaaatattatgtatctttattctagggagatatgcacttaacaaaaatattaatatgtgtgtacgggcctaacaatgtgtgagattatataaagtataataatgaacatttcaaatcatattaccttcttttttaaattatcatccttacataaatcttatgatgttttcaagtatttctgtcttcatcattgaagctatgagaagataagttatatacctaaagagatcaaggaaagataggaaagaatcattgtaagtccactatgctcttcaaataatataatgaccagtatgaactgagataacctttagacagggtagtaggaatcactattgctactacccccatcattgtcactgctcttggtgggtctagatatgttttatatcaattatctgttttaatcctcctaaccctaagagacagctattagttgggtgcaaaagtaattgtggtttttactattacttttaatattattctcatcttacaaataagaaaagtaagactccaatgttggtcagggttatccacgtaaaatcaaacaccagtctattttaatccaaagctcatcaatgaaagctaaattttaggcatattaatgaacatgaatttgcagagtgtgtcgtttaaaaaggaagttgttttttttttaatattgagaatgaaaaaaaggcataatagcatcaatccagagtaaaggaagcccctagaggctgagtaggcagattctagggtttccatgttaacaggaacagtatctgatcagagggacagggctagacctaactgggtgagaagatggaatttcatagatgcactggttcaaagataattgagacttatgtggaaaatctccttttgatctactgctaacccaaagtctcctttattaacagttaatgaaaactgagccctataccacataccaatgtacacatgaaaaaagtgctcacatctttagttacaagagaaatgaagattgaaaccatatggaatgccaatatatatccactgaaatggctgatatgaaagaggctgacagtaacaaatactggcaaggatgtggagcaactagaactctcatgtgttataagtcagggtataaattggtgcaattactttggaaaagggtttgacaggtttataaaaggcttaaacacatctatgctatgactcagccattatgtttattatgtttgtacacaaaggagtttttccaagagaattgaaaacatgtctacaacaaaccttatattagttttttttttttttttttttttgagacaatctcgctctgtcacccagactggagtacagtggcgcaatctcgactgactgcaacctctgcctcctgggttcaagtgattctcctgcctcagcctcccaagtagcttaggttacagacccccaccaccacacccagctaacttttgtattttcggtagacacgggattttaccatgttggccaggctggtcttgaagtgctggcctcaagtcatctgcctgccttggcctcccaaagtgctgggattacaggcatgagccactgcacccagccagaatgttaatagctttattcaaagtagcaaaaatggaaagagcctaggtgttcatcagtaggagaatacataaactgttgtttattcatacagtagaatatgatgcagtggttaaaaatagcaacatgaatgaatcttaatacatggtgagtacaggaagccatacacaaggaaatgcatactgtttgtattcacatacaacaccaggataggggaacataatctatagtgtaataaatgaggtaagccattcttttgggggcaggattttacaaggaaagaatataaggaaactttctagagtgataaaagtattttatatattaataggattatggattgaactatatactttccttttaaatttcaacttttaggatcacatggtacactgtgcaggtttgtcacatgggaatatttcgtgatgctgaggtttgtgttatgatcgatctcatcacccacgcagtgagcatagtactgaataggcagtttttcagtccttgccccactcttttcctctcctctctagtagttccagtgtccattgttcccgtctttatgtccatgtgcacccagcgtctagctcccagttataagtgagtacatgtggtatttggtttttctgttcctgagttaatttgcttagagtaatggcctccaactgtatccatgaatgacatgatgtcattcctttttatggctgtatagtattctatagcagaactataccctttagattgttgcggtttaccatatgtgaagtattgttcaataaaaataatctttaagattatcaagctgtatggcttataggtagctcttgtgttgaagaaactactacatgtgaattcttgtgcttacccacatgctcgtgtaggaatgagcgcaaacacacaggaacaccatataacacatgcatgggaacatattccttatggggctgtttgttgttgttattttttttttttttagacaaagcctcagtgtcgtacaatgacatgatcatggctcactgcagccttgacttcccgagctcaggtgcttctcccacctcagccttctaattagctgggaccacaagcatgcaccatcatgccctgctaattttttgtatttttgtagagattaagttttgtaacgtggcccaggcttgtctcaaactcctgggctcgagccatctgccctccttggccttccaaagtgctgggattacaggcatgagccaaagcgcccagcctagcctgtttttaagtatgaaggataatgagacataaggtagattggacctataatgtcttctcagaaatcatgttaaagacccaccgtatgaaaacagttgggggaatctgcccttttttgcccaaagcagtcctcacattggctttactaccccctccccagcctcccacattttgtactttgctctggacatcctcacgagccagatcctcattgaaaatgagcccctttgaattagctgcttaaaaagatggagctaccatgatgccacaagaaacccagcttgtgcaaaggcagcactaattttaaaactcaagtgttatgtctgggttttttttttttttattaacctctcctagaactcttctgtgctgtcatacataaatcagaagattatgaaagaactagtcaaagtggctgtttccttctaaggctgtaatttggttccatgaattattaattattagactgatatggcatcagctcctcagaacccaatataaatgcaaaagcctcaccttatcagttataatctaaggagctgcagtaatgtcattcttcccatttagtggtgtgttatggggtttaggatattcaacccaacaaacttctgaaataaaatacaaagtaaaggatatttttgtgtgtgacgagatttgaaattcagtataaggaagcagatgtggattgcttcaagggttttgattgttttgaaggatggagttgtttcatagatgctaaagcaaataacagggcatgtaaaagactgtggttgaagaaaactgcctgaaagtaaagctttggaacatcttgcatctctgctgctgttagggaggaaataaataatgcaccatggattgaagttgtgctaaagatacattcagtatatgttgaaagcaaacatctgatatagtaagtatatttttcttatgcgaattacagctcttatattctttgaagcaagaactaaaaacgtattaattttttgtttgtttgttttgctggagtacttagctttaatacttgatgatgcctcccagttttctttggttctgtctttaatatgtaatgtcatgttattttaaaatgttctgaagaaaaaaatttataagcttaaattctgttccgttttgtgagcacaagattagtctccttttaggtgcaagtttttttttttagcagtttctggatattttagaagtgtgctcctcacatatacatacatctgattgtatcaaatacagactacagtatgcagctaatgttgcaaacgccacactgctcagcattgcagtataaagaaggaagtaacacctaagctgtaatgtagccaatggattgggggttctatgaatggaaattctaaccaagtagaaatatatgttggagttagctatgctaaagtaaatgtgttctgtttcactaacttagccattctaagagattatttagaaataattagtttgctaaatctctgcaaactttcatattattcatagaaatttcagtagctttgttactctgagcacactacagcaaccccagtgctctttgacttaaatagattacattttttaacaaattattttatggggttgaatttggtctaagaaaatgaagagtgtattcattctattaaaaaatggctaaatatgaaaatggcttgagtgataaaagtaccttgactatgctctactgtttctatatagtcagttttaagaaactgacaaattaaaaattttctcgaactctctgtaaagttaaaatattaaaagtcgagacagttttcttcattaggcctgagaggcaaaggtgtgatatattagcatttgaaaaataaataacagtgcatcaaaaattatgaaaacttttaagtatgcttaaagaataggatttatatccaaaaagtttcctgaaataaatagattgtgccacataatttatgactcattaaaacaaaaacaaaagatgatatttcttctttagtgtgaaataactcattttctattttaaattaattgctttctataggcaaattaggggcaaatattcatcagaatggcaattacttgaaattttttcatgtttaatatggtactgttttcagttcattaatactattgaccaacagctactataaaaaattaatacttttccaaatttactttctgtatgagagattgattcattatattgccattgaggggaaaaagctatgtagaagtaagtttactatggacaggtttagtcaatactgtgttgagtagactgtgcatgagatatagggtagatttagacctgaattaacagtgcatcagactatgaaattttgttcagtattaaaacaaaattatcttgataagcatctccaaaatcacatttctggcccatcattgttggggtgtataccacggaactgagagttccctgaaacacttggaaatgatcactgatctggacttgatcccaaatgatggggctcattctcctttcaattttgctaacttattttgatctcctgccttcagttttaccagagatttgaattatgtatttggatttgcaataaactatagaatatggaggctcaggcgtttccatatattgatttattacatacatcttaagttttaaattggccaaatcaaaggtagtaggtttaaaacccatatggtaacttaggaatcagacagcatttggggagaagcaacatacagaaaatatcctttggtccaacccagtcattaaaacaagaaagagctattgaactggggaaaaaaagaaagaaaagagaaaaaaataatatcctttaggttagagtgctggctttccccacccaatatctgtgtcagtttctctggggtccctttctgttctggtttgcccttactctgggttagtttagattccttatcaccagccatggtaagccatagtaagcatgttcagcttcctcacttctgtaccctatctagtgtcttatgttatttttgcccctgtaagtttgagccattgtaacttctgtggccatagtttcaagactatgcttatgatgtggatgaaggtgtttttgtttttgttgttgtttgtttctttttctgtgggataccttaggattcattcatttgtgatttcagaatggagtgagagagagctgtttttgaaaataagttatgctaacttactagctgttactagttacataagttctctgagtctctgtttttttctctatttgtaaatgaaaatgttaatattaactatcttatttgattattgtgagaattgaatgagataacacatgtaagatacttggaattcaccctccatatactaaatgctcaataaatctactatgttcgagtatgatatgaggaaggtttatgcttctctaaaaatcactgcaattaattctagtttgggttaataatggatttggtctgttatatggattctaagtggaataactatgaatgttatttaaatgtatatttatatcaatgaagagtgaaaatcaaatggtttcatcattaccagcttaccacataatcatgctgtggtggaaatctacttgtaaagagtaacctctgcatttttcttcagatacaatcaataaatgtgagtgatttcattacttatgaaataattcaggaagaaatataattgtgtgcatcatgtaatataattgaatgtggacagacaaaccaagactaattacgggcttgggttttcccaggaaatatttatgtaagtaacttctataggtggatatcagtcctgtaaggattttgacattcttctgccttcagtaatgcagcactttctcatcttcaagagctagctcatttgtgaagctttcctgtgtaaccctaccacgaaataatatttttctactttaaacaattctagtatcacaaaaccagaagcttgtttctgtgctattttgaaattttctccatttttccataatatatatgtacacacacaaacatacacacacatatgtaaaagaaatatatatatatatgtgggtgggtgtatgtgtgtgtatatgtgtgtggtgtgtgtatgtgtgtgaatatatatatatatatatatatacatatatatatatatatatatatctctttttttccttcttcttaaattttattacaagatattggaatcacatgcttaccatccacccttcctcctgccacttggtggatatttgtatttctgtagatacttaagtaaacaatatagctcagcttcaaaagtcttagttcaacaaatcaaataaaaagatgcaaaatgtaggtttagtaacaagttaatgttctcatgtatgagtaatggtgcaaaagccatgactattataattttttaaatatttgaagtgttgtacctataagcaaagaaactaactttgtggtggcttttatttcaagttttccaatccttactttaaagacatttggattatgctgtgcataataggagaaatactgccctatgttccaactttcaatttctaaatttatttatatattactatatataagtatattattcaaaccccatcacaggtttgaaattaaccctcttggggaacatcataatagttttcttcttagacttcttataggataggtgtgtattgggaaattagcacattacttatttttacacataaataatcacttcattttaattttctgctctgatttccacctttcaggtatgtataccagatactgaaatggctgatcccactttgatcacctgtattacagaattaggttattttccaaatttgacaaaattgcaattaagaattgcttcttagtagactttgcagagtatctgagttacgttctttggatctcatgattttagaaatgtttagagaacattttgttcattccactaatgggaagatagaccccaagaggtttctcaaggtcagagagcctgctagggaaggagtcagacccagaaatcaggtctcctgacttcttgtataatgtcctttttagtgtaccatatttcctcagtcagatcgatctactcgtccctgctgacattcagaaatctcccaggtatttgtagataatgtagctagtggctattttggagcatcagtctagaagttaagataataaaatagagttttcactttattatgtttttgtgtgtaaattatttcacaacttaaagctttatttttttctgtaaaataatcataggtttctaatattttggcttttctagttttctcaaatgacttgattgaagacaatctgagtaattcaagactagagaggcaaacaagaaagaaggaagaattatttcattcttattaggagtgaacagtgcacatggtttgaagttttcatcagggattccgaatctgttgtttctatagctaataatagattgctcttcagataggctgctaaactttgtagaggttaaaactttcaccacacgagtgtggctgtttgttcaccgcagtgcattgccaggtaaactttaaccgaaagctcaagagatttgatattttaatcctacaaaagcaattttgtttgccagcaaagtaatacctggatttttagtttctcagaggagctaggcatagaatttaaaatgtattagagctgcccttggggctaagaacatctgctggactgtagtctaataaaacagaatctgacaaagatgaggtctatgacatgtactctgctacaaccatacttgagtagatcaaacgggttggtttgacaaactgatcaagacaacaggcttatggaaactgcctcactaggacagctatcctcttccttcagggttctgccccaaatctcccttgcagctgaatttaatgggattttatcatatccccaacatgcagtctaagagctgaactcccacctcttttctgtttgacagaatctctcttatgagcttagggataaatattgggacttagaccaaacaaaaattggtgaaatttttggaaaggagatgtagatttaaacttagaattgtcaggttcaagtcttttcctcctccatctctgattttttattttagatttttaagtattatgaattcatagtagtcgtacatattaaaggggtacatgggatattttgaaacaaacatacaatgtgtaattattaaatcagggtaattgggatattcatcacctcaatttcctgtccctccatttatctgtattaggaacatttgaattccactctttcagttattttgaaatatacaataaattattgttaactagtgaccctacttgtgctactgaacactagatctttttccttctatctgtattttcgtactcgtttgccatccctctttatcccaactctgattttatctaagcctctcaatgtgtcttatatctactagtttcttataaaatatagtaatagcaattcccaccttctttatggtacaatgtttttctagggaatttaatatacctaaagtatatgaaagttctttaagcaggttataccttacgcagtacaaattgctgtgattgcaatagttccttgtgtatctcatcttttgaagagaggagtgtattaacttcctggagctgccacaaactgggtggcttaaataacataaatttattgtcttatcgttctggaggctagaagtcagagatcaaggtgtcggcagggttcgtttcttttgaggtctgtgagaatctgtcccatgcctttcttctagctttgggtggtttgatagcaatccttggccttctttgtcttgtatcacgccgagctctgcttaaaccttctctctatatactagtctatgtccaaatttcctccttctaaaggatgccagccatatttgattaggggcctgctctactccagtatgacctcatcccttacactagatataacctcagaattatatctgcagtgaccctatttccaaaaaaggtcacatcctaaggtactgagagttaggacttcaatatattaatgtgaagggggacacagttcaacacataacaaggaacataacattttttttgtctcactgttcttaacttactgctgcttttactcaaaaaatttgggatgaccatgatgtttctggatcttcccgtccctctgtccctgctcttcctgtaaatctcaacctactttctaatatatttcttgtataatctcaaagtacaagaatatgcataccataagataagcactgaataattgtaaatcactcttagtaaattagtagtctaggctaatctgattgtcagctgttaattttgtggtttctgagaatcatcaaataatgtactcaaacctgctgattgtttatatttttttgaactacaaagaactttcatttacagtattacatctaaaccaacatagttaatatttatattcttatcaaagatgtcaaacttcaggtgtagaggtgatgaaatgccaaaagtcacctggctagtaattaatacagcctgaattagattttaagagtttttaatttcaaacctagaattctttctgctctatcattatgctgctctttagaaaatgggtatagtaaggtttgtgacctctgtttgaaacccatggaactacatagtggaccctatgagtacagattgtccatataatactttctcaatttcttcacatcagacatttgtgatttctattatctatccacagtggttattgtgcatgaggctctatagttgacataaatagtgaaaagaattgtttcatttctctgaattgttgttctgcagaaacctcatgtatttgttttctagtgctgctctaatgaattaccacaaatttagtggcttaaaacaacacccatttattagcttacaatatttatggatcagaagtgtaaacacagcatggatctctgcttagggtctcacaaggcctacagcaaggtcgtgacaggcctttccccttcctggagctggaggagaaaatttgttttcagtctcattcaagctgttggcagaatccagcaggatgtgattgtatgattgaggccctcatattttgctggtttttggctggaggtcattctcagctcctagcatctgctcgcataccctggctgctggccctcttcaaagccagaaatgatggtagagttcttctcacattctctctgctctccctttctacctcatctgtcctgcctcaccttctcctccacatatttctgaaggaggctcttctgtcttccccttctgcttttaaggactcatatgattacattgggccaactgattatctagggtaatctccctgttgtaaagtcagctaattaatcaccttaattccatctgcaaagtcccttcacagtaatacttagatcggtatttgatagaataatcagtaaatgggaacctttgagggacagctctagaattcggcctataacatctcagtattttttttctttttgcattaagcattttcaaatcagttctttacccccaaaatcatgttgtttagaatgtactaggtgctttcaacttatgttattcttatggcatctgaatgggatggagacagtcatccccatttcttcgataagaaagtaaaggcaacaagtttaaaaggttttatcagatacacagggagtataatttaaagtatatcagagttcttctcagtgtaaagtacgtctgctagtttttaacataataaaagataacaagcccttattttattctttctgttttaatcatttatgtaattgacttgttctttccatatttcttcccaatgtatgaatcctatgagattatcatccagtttcagagcaggggcaggaattgtttgggggagtaaaaatacatggattaaatgcctagctcttggtcagtatggtacatatatttccaagctttgtttggtgagagagcttgaaattaatgacaacccagtagcaatgagcacacctaggactcatatcttggtatttaaatatcagttcttcaaatgctctttgaagtagctgatttcaaatctggggtagctatagtacaagatgagcctggagcaactttggcactaaaaagttagaaagtcctcaaaaagtaagagtgcatgtcaaaggacataggcactgacatgaaagaacccccaatgaccaaagctgcaaaattggagcaacccaattaataactatagttatttatttaacccatagaataaaatagatatatgcgaacccatactgttatagataggtagatagatagatagatagatagatagatagatagatagataggagtcaaggatcagctcttccttccagaagaattataattaataaatgaattatagaaggaataaaagaaattgaacaccatcatcaaaacactatgttaatggctgggcatggtggcacatgcctctaatcccagtactttgagaggctgaggtgggtgaatcactcgagcttgagagatcaagaccagcctgggcaacatggcaaaatctcatctctacctacaagaaatacacaaattatctgggtgtggtggtgcatgcctgtagtcctagctactcaggaggctgaggtgggaggactgctagagtccgggaggtcaaggttgtagtgagtggagatcacgtcactgaactccagcctagatgacagagtaagagcttatcttaaaaaaaagaaaaaaaacagggaaagagaaaaaaaaaactatggtaataattgttgcagatgagatacactggcatgctaaatcttgtggatgaaagttcaaaaaaaacatttcttactctcaaagtatatcctcccaaaatttattaattataaaggggaaatgttaaatttcacattggaaaaacccagcagataccaccttaatcaagtgatcatgtttaatatcaatggtaagacattttgacatcatgtacccctgacatgacacagtgagaagggcacatcagttctgtggtttcttgtgaaaaatatataacttcaatctcatcatgaggctgcaccaggcaaacctaacatgaaggacactctataaattaacttagcatcattcttcatcgtatcttcatatcacaatacaagaagaggatgttagtgaaaccattggtaaaatccaagtaaagtttatagtttgttccctgttttgataattgcactgtggttatgtaaggtatgaaccttggagaagctgggtgaagagtgtatgggaattctctgtactatttttgtaattttttaaaatataaagtaattttttttaagtctggctctctcattaaatagctttgtaatattgtacaacatacctcttttgagtctcacattgtccatctgtaaagtttgcctaacaatacagagcctgttacaaagtatgtgaaatctaacagagagacaatgtagcctcatagttaaaagcaattgctttgaagtgatataagtgtggttttaccagttaaaactgtggaggaatgcaaaacttacctaactttattaagcctcagtttccccatttttagtactcagatgcacttactgtgaatcttaaatatgatatagcaggtaaacatttaacccttcttagtaggagatgaactgagaatgaggaactacaaatttgaatccaaagtcttaaattccagttgcacttattaggatttttttacatgaagcagatattaaaattaagcatgcaagatatctttcttcgtctaactcacatattgaagtgaacaacttttatttagggagtttttatacaacagcggacaagggaaaatttagctcgtgttattttgaaagtggcaggaataaatgtttgattaataagattacaggcatatttgcatctggagagaaggttcataaaagagttatttttacttgtaatttatttagcttgaaacagagggaaaaaattgagattaatcagttgtcaaataccttctgagaaacccaaatatacttaaagaatcatgctgagatctgacatacttctaggtttttaaaggaattttttttttctttttgtttttgttttggctaatcagtttatgaaccactttgtctatgggtaaaccaagatctgataactctcagaacagaactttcataaatctgtctgtggaaaaatgcctcaaaacatataaaaatcataaaataaagggaacaaatataaagaacactggagagggatttgggtgttgtgtctgtatttttgcagtcttagcttcatgtgctgcctgaccacatacttcgtacttgcttcctcctctgtcatttgagatgttatttggttgtgagaaggtggaaatagcactgtatgttaaaattgattcccaaatgcgtcaaaatgtcgtatctgtggtctgatggacaacaaacaaatgcaatcatgaaaagttattcccatcctgacaagactttaagaaaatccactattttgagaatgggtaagttaaaaaattactacataaaataaatcttcccttcatgtaatattccctatgtgatgagtctaaattgttggcagccatactcctaataatacacgtatgtacatatctgtgtgtgtctatgcacattttaaatacttgtgacatatttatttaaagtttatttatgagcagtatggtagtttaaaaggattatgaaggtcattctgtgtgtcaaacgttgttttaagaagaaagtatctgaaataaagtagcacttatttgttgctttgtttttattctgattgcagacaactgtgtcatacagtatatgaccaagtagatatttttctgtacatcctaagagagggcttggactaggccatttctgtattgatatcctgagacctacatatccctggagaccaattacaaaggttcacaaggttgtttttattttgttttctcttgattcctttttaatgaggtctcccagtaaacagcaagcatgatgctttcctgttggaggcctgtctgccgccttcaaccatttattactaattcatctgggaaatgatttataaattaaatattaggaaaatgtacttgaggaaaaaagtggtaagaggtacaatttataattctcatttaggagaaagtcatgccagcagtttgctaatggaaggatgctgagagtcactcatagaaatacagttgtggtttatgtaataaatagagatgtacatgaagagaatcttcaatgtatatttttgggcatgtgattcattttaataaattgtgaagacagaagttcccaatttttctcttcaagtgaacccttggaaaattgggaaataataaagagcagaagtgacctatcaatatgtgctatctcataactcctcctcatgacaaaaatatagtatttatcaatactaggtgaaaatagcttcatcatagaataaaatgtggtgttagtagatgtcagtgtcatcatagatttgtgcaagaagggattccagatgctattttagaacaatcttctcattgtacagatgatgaaactgaggtcatccctgtttatgacttacctaaggtctcataacttttaagatattaaatttttgagattatttataaagcttcaagatttatttttgcacttgtaggcagtttttgtatgaaagaaatctgcttttcagctaatcagtcagattaggattgtgtcttatgagaatatcttttacatttgcgttgttgaaggaagatgaacaatagctgtgtctctacacccagaattaaagaggaacaaaattatagctttggaatcatcttctaaaattttattaattccagggaattaaagcacactcatcttgcaggttttatttaataaaaacgtttgttactttttttaaagttctgagtaatttctaggtatcttttcttttcttttttttttttttttgagatagtgtctcgctctgtcgcccaggctggagtgcagtggcatgatcttgactcactgcaagctccgcctcccgggttcaggccattctcctgcctcagcctcacgagtagctgggactacaggcgcccgccaccacggctggctagttttttgtatttttagtagagagaaggtttcactgtgttagccaggagggtctcgaattcctgaccttgtgatctgcacgcctcagcctcccaaagtgctgagattacaggcgtgagccactgtgctcggcctctagatatcttttcaatactgctatagtggttgcattatagcaatcattaatctcaaagatataagcagtgaattcataactgtgaaatcataactttgtggttaatatttttttctgatcccattttaatctttttaaaatttcatttctgtttgaatatttagactgtacttgaatataaatttcaaacataattaagcacatgttatctttatttaaaagatgaggcatatgtatattatctatgtatacactatttaaatatgtccatgtatacataaaattatatgttatatgtaattttctaaattatatatatatactgaaacagacagatacagtttatggctgatattttctggtgaaaataatttaccagtatgggtttgttggtgtctggctgtcaccactaagaaaagattctactgggtcattataaaaatttcagtttgggggaatgttaatagaaattagccatattatagtttggacagcacctatatgcagtttcatttaccgatattaacttagcacatgctggtttatgaggggaaacagaattcagtggtgcacatttaatcatttttctttatctaatttaaatcatattcttcttgataaagtgttatcttggccaatgtaagaagatggaggaccctcccatgaactttgtgggacagacactgaaaatctgtgttgacagcatgtctctaactcatccttctcacaacatttgctgttggaatagaacagagaattctgtaagagtcatagtttttagataaagattgttacagaggcataataattccagaagatttccatcttctaacaatctcttgaaatcaataataaagacaatggctttctattcgtccactttaccacatcaggcagtggaaatagaaaatgatataaaattaatcccttctcttgacaattgtaaaatggtaatcctccattttatcctctcagaggatatttgaagataacttttttattatcctattttcatattctgtctcataacctcatatattgtatagcccatttcattgctggtggtcaaataagactgcggtagaaagccacaggtaggttactagggttctgaagaatgtatcagcacagaaaaccaatttcagatatattttcaatgttattgctttagaatacatctcctttactgagacatcaaaaatcaaagactagatgagctcattcatgtgaataagcttggggataaattacctctttctagtttcatattaaaagagcagtagcatagtcagcctgactgtgggatcttggtcaagcaaagctaaatgttcttttcctaatttttcatattatttaagtgtagtgtcagaactattccttagtgtctttgttagttttgctcttaactgtagtctcatgtgttcagaatgagcaccagccaacaaatacagacaaatgcaatatttcaactgtactttacatataaaaagatggtgttaatacactctcttctgtggttattatgtagtttacttacaaactgacatgcatttttctcacttataagtgggagcacgtatgagaacacacagacacagggcaacacacactagggcctatcggggtcaggggcaggatgagggagcacatcaggataaatagctaatgcatgcagggcttaatacttaggtgatggattgataggtgcagcaaaccaccatgatacacatttacttatgtaacaaacctgcacaccctgcacatgtatcccagaacttaatagaaattaagctaaaaagaagaaaaactgatatgcatgatgcatgcttatttcttcagaaatattgagatgtttatttaatagatgccataaagctacctgaaatctaactaagagaatcctagtttactgcatttgttggcaaaaaagtagactattgatataaaatattttgaagttgcagccttacatgattgccctgtttagttttttggaatgtcttttcataaggaagtttgattctttaaacttggaattccaaaattcccagtactttcaatcaatggactaatcgcttccctgcctgctgcctgcctgcctgccttcctccctcctgctctttctttcttcctttcctttataataaaaaatcaagttattggaaaaagtattgagtcactttattctttgtgtcttactatgtaagtttcaaatttttgtgcctttttgcttttattctgtcgttgctgtatttcgaagcatcgttttccccttttccattgagatgtagtatacataatgtaaaaaaccccttaaatattacgtttcatctattgctccatatatgtactcatgtaaccactaccttgatcaagatagagaatatttccattaactttaaaagttctcttttactccttgtctgtcaatacctcttctatcctgaggtaatttgtcttctgacttctatcaccgtagattaattttgcttgttcttggacttcatataggtggaatccaaaagtacgtactgttttatgtctggcttattttgctcaacatactattttttgagattcttttgtattccatgtatcaggagtgtgttcttttcattgctgtatattatgtcattatatgaatatatcgcaatctcttcatcctcctcctagtgatgaatataactgaagcaaatttacaaatactttttttttttttggaggcggagtttcactcttgttgcccaggctggagtgcagtggcgctatctcggctcactgcagcctcctcctcccgggttcaagtgattctcctgcttcagcctcccgagtagctgggattacaggtccccaccaccatgcccagctgattttttgtattgttattggagacggggtttcactatgtcggtcaggctggtctcaaactcctgacctcaggtgatttgccctcctcagcctcccaaagtgctgggattacaggcatgagccaccacacccggcccagtcaacagttctcgtgtcagatgggtgtacccacgtggggttgtggtttgctcttctaattcttatgcaatagtaatgagtctttaaaacaaaatcctgtgtttgaatgttcttgaaatctcagaaattatctagcaaataacagggcttttttttttcactgcatgtgtgcatcatacgtatatacctttgtaactgaaaacaaaaggtagaatcgtatagtagttaggatagaaagctgtagaatcagattgcctgaatttgaattacagatattctacttgatattgtgtgagttgaggcaatttatttatattagctgtatcttgctttttaaaaaataaaaaaggatattagaaccttcctcatagaattgttttggtgattaagttagactttaccttcagagtagacagtaagcactcaataaatgttaactgttattgttccaagtatgtacattatttttattcaaaaatgtgtgcaggattccatatgattctacaggattccatatgattctacatacatatgcatcgttaaaatgtactatgtagattaggttgatctaatgactgtcttctctaaccaaaattgtcagagggctaactcttctcactcattttggctcttgtatctctactttagtggaaccaaagtgaatgataacaaccagagagagattgcttcttgactacaaataatgagatactccagtttaaattagttcaacaatgttcttgatcaaatcattctcaatcacttattttcagaatccagatattactgctgtgaataacaaaagaaaactcaaatttctgttcttgaagcattaagcctcttgatattgggaaaatggtgttaagtgtgaaagaaagacagccatctaatttgttggacatctaggtgtgtcatgctaaattctttagatttgaaaaataaatttttcatagtatttttctattctgaaaatatttttatataaaccatgatttctttttttttttgagacggagtctccctttgttgcccaggctgaagggcagtggcgtgatctcggctcactacaacctccacctctcaggttcaagtgattctcctgcctcagcctcccaagtagctgggattacaggcacacaccacaacacacagctaatttttgtatttttagtagagacggggtttcaccatgttggccaggctttggaactcctgacctcaagtgatccacctgcctcggcctcccaaagtgctgggattacaggcatgagccactgcgcccggcccatgatttttaaaataacaaatttaaattatttttctgactacctaccatttatagctgtaagtgtggattctttcagttaaatatttaacgtgtttggtgccaacaactcagtatttagcctaatccctatttcagaatccagagtctatattggtgccattcgttgaataccgaggatggcacagagctaaacctccatcaccccatagacagtggggacagtgcctccagcatacgaatgatataggtagagatatggctgcaaaatggtagatgtgactttctgacttgagggatttcagggttttctaacaatgtaggatggtgggtagataccaaaggtccatggctttcatagaccagtgatgatacttgaattatttatgtaagtgtttcatccctcctattaaactgcaccttctttgggagtaaattttaggtattaatttgtttcttctacaccatttagcatattgcgtgcgcttagtagatcccacataaaaatttctcattaaatgaagtaagcatataagcctaaaaagtacagtgaaattttttaaaaatgccattttaaaagaatatgacaacaaaaatggcatatgtatgcattaaataaatatgtaaaatgactctcaataaaatgttaattgtgtagttatttttggctgggaattcaagtgattaaaacttctcttttttgtaattatatcacttgttaatagtaattgatattatttatattatcagaaacaaatgaatatgatcatagtagattataaaggaaaacataaacaaaccattaactgtagaaaaatcaaaattttcaaagctacttttcccaaaattatcatacctagacattcaaggagttgattttgttttgtatttaaatttttctatagtatggagaaagaaggaatattcaaaattatttttataaagccaccattacattaatacaaagatctgccaaacacagcccaaaagaatatttcagatcaattatacttaagaatatatgttcaagaatcctaatttaattcatcagattatttgtacattaaaggaaaagcacatagaaagaaaataaacattgagtgagcctcgttgcaaaactcttctgatatttcaaaattgggaagcagtttcctttccatgtaaatcattatttccaatatattaagtataatacaagtgtaggtttaatcaatttctattttggtaactcatttaagagcatcactattttttatactgtggatgaggtattctgacttctcagttgccttaaaagagtgccagggagtcatactgcagtgttaaatgtgctcttctgccttgcattcatgctaagaaaaccagtgtctattatgtggctcctcgctttagccttctcagcatgaatgaccattcaaggagcaacagtattttataaaagtattgattgtgttggtttgtaaagggccccataatgttcttcccacatcaaacctgtgctctctgtgtaagagaaccataatagctacagcctcctggtaatgtatatgaattgtacagaatttcagtttatggatcagctttgtaatagtgcagagtttcacttggcttaaccaggtgtgggcaattgttgggtgcctttaaaaagtcataacatttccagggacagggatgtaatgggtcattttataagaaagaagaaaatgtattaaacgtaccacattatttttagttcaatggtaggtgtaagacagaaagtacgtttgcttggtatacatttctgtgggacccagtgtttggctttggtctgctaatttcctttgccttttcctatttaagtttttttcttttattcttctattaataatatgatttctataagtttcagaaactttctaaacaataaagtactccatttctgcactattgaggttgatgttggccttatttattctcaccttttttttaaatttggtttttgatttgggatttggggtggcgctggcttattagcgttcttggttgcagcacattttcctccttcagtaacaactctagaagcttaataaccaaagttataacctacatttgttttactgtgctctaatactcttaactaccgggcagatttcagtataaggtgaattggcatgagaattgtttagtcaatcaatagccatttaataagcatttggttacatgttttggaatttttaagagacatataagatactagtgtgccatgttctcacagagtgaacaatctagggaagcaagaaatatatatatatatatgacaatggttttaggtaataaaatagaacttttaaaataagttataagcttatttcctcatagtgatcattccatatcacaggccacctgcatcctccataaaagaataggattcttaaatttgatgtttaatagattgtgtcactttacattagccctaattaactttttcctagtaattttgtgaccttcaaaatttacttaatttatcaatgccattagtttttcatttttaaattggagatagtaggaatatctgcgttatataacatatgtaaaatgtaatttaaatatacagaaatgaaaattgggaggtaatctaaccatcttgtgttacatatgaggaaatcaacacactgaagtaggaggcttccccaaaatggaatattgagcttcattagtggatattacatttgttgactcttcatgtttcctcattggagtttccagatgccactcttgcttctgaaaatcgtgtatgacttgtgatgtaacaaaaatcagagggctttccagtgtcgcaactttcttttttttaggacggagtctctgtctgtcgcccaggctggagtgcagtggtgtgatctcagctcactgcaagctctgcctctcgggttcccgccattctcctgcctcagcctcccgagtagctgggactacaggcgcctgcaacctcgcccggctaatttttttgtatttttagtagagacggggtttcaccatgttagccaggatggcctcgagctcctgaccttgtgatccacctgcctcagcctcccaaagtgctgggattacacgcgtgagccaccgcgcccggcccagtgtcgcaactttctatggtataagagttactttgtttagcagaagtctcacagtttgagaattaaccttctcagtggagagctggcagactggttataaataagggcttcagctcccttagtgtgggacatgctgcccgctcccttcaggtacttatctgtcctggaccagacagaagcacatctgcttttcatttagcttacttccatttctccacttcctctcttttgtcagtgttaaagcttaaaatgatgaaacaatccagcagttatccaactacagataaataactgctggactgtatcatcgtagacagttggtgaaaaattctagaccagaatccagtcccttcagtcttgtattctttctaatgtattgagaacaagacaggaacattgattacctatttttagctggtttcaaaaacagtaacctcaattccacaatcaagatttggattcagaaatactgagtttgcactgagctctttcctgcttcactttggggtcatgagaaaggctgtgaatttctgcttcattccgattccctcattttaataacctgccaggagacctctaggggagtgattgtaataaactagctaataaaatgagattagaaccttcaaaactaaacatcctcttatgatacaatccagcaatcacactccttgagatttacccgaaggaggtgaaaacttatgtttacataaagacctgcacactgatgtttctagcagctttattcacaattgccaaaacttggaagcaaccaagatgtccttcagtagatgaatggttaagtaaactgtggtacacctagagaatggaataatatttggcactaaaaagaaatgagctatcaagccatgaaaagacatagaagaaacttaaatgtgtattactaagtgaaaaagccaatctgggaaaaaagctatatactttattattccaactatatgacattctggaaaaggtagaatgactatgggaagagtaaaaagatccgtggttgccagggatttggggtgatggagagattaatagagcacagaggatttttacggcagtgaaactaatctatatgatactataatgatagatacagatacatgttattacaaatttttccaaaaccatagagtgtaaaacataagagtaaaccctaatgtaaactccggactctgggtgataatgatatgtcaatgtgggttcactgatgataataaatataccgctggtgaggtatattgatagttcagagaggctgtgtgtataggagggcaggcatatatggaaaatctctgcaccttcccctcaattttgctgtgaacctaaagctgcctagaaaaaataaagtctgttaaaaaatcaccacagaggcaaaatgtgagattagaacaacctcttcaaaataatacacagaaagtatttacaaatgctaactaagacatagggttcaaaacgtaaaactgctcacagcccaggtactaaaattagatcaatctaatcattagatactcaatcattagatacaatagaatttgccccagtagcaaatgtttacttttgattctgttatacactacttaacatggtccagtgtcagcataaggctgtaatttggcgattgcatttctttatttaataactgctgataaagctgaaataaagaatcagtaaaaaggtttcacttttgtaaagcacatccagggtttataggaaaggaaatatttcagcatttctgatatataaaagaacaaaggtgttatattaagaaaaaataatacataaaacaatatcagggacattgaattgatgaaagtaatcagtaacattttaaatccatgttggcttgcattgtgaaagaagggaataatttacagttcatgatatttgtatttagatgtttgtatttttattgtgtttagagaatcccaggaaaggaaagaatcctacaacccgtaggatgaaaaaagctttggatctcatgccaggacaagggcactgatgcccaaaaagataaaggccttcctcagaatcttatgggaaaagtcaaattatttaaaattagctccagggttcatgagtaagattaattggtagaagttaaatggctatatggttcacgtttaaaaataatttctaaaaattggataccccttatgagagaaaatataagtggctttgagtaatagtttatattccaattattgcaagtaatcaatcatataccaggtaatttcctgacatgagttacataccaaaaattatattggatgaaaagctcgaatgaatataggtaacattccactctaatgtagctttctgtatcttagaacattcaactttattaagactttatagtttttaggaatagagttaataaagaacttggaatcttctatcaagaaataaagaggtgggagtggggagatctacctctggagattctcatgtgttcaggatatattcaacgtttatttgttcctaggcagggtacagaataaactgatacccgtaagtccattctagcccaatgtttcaaaaaatgctggcattttagtgaaatgtaatatggataacataaggtaacattgcgaatagtgaagtctgcaactaaaagataaagcatttaaatgtcaaatagcattgtgtaaataaatctaaaatgaaattttcaaccagtttttaaaacttacttccactaacaaacataacatagtgtcatgcagaagatgatgaggaagcaaagaatatgttaaggaaacctgtagaaaaccaaatgccttcttgtattaaatgagtttaccatgtctttcaaggaataatcatgtttatacaaatgtgtgtggtttccaggacccatttttcttttccttccctatacatgcaaacatatacaaatatatcagctcacatacttatttccctgtggtttcagactattaaatgtttataattactctgcttgatgactgtaatttttagttacagatcgaattgtcccaggtgtggatgctgccaaaagccacggtcattggcaacatgacatctggaagacagtctggcatgtagagtcagggaatttgctagaagttgttcctcatacagtgcaatagtacaagcaagcattgtgactccctgcagctggtgctgtcagtgccctatccatatgcctcagacctttaattgtgtttctgaggaatgcttctaactcctagtatctgcaggtttgttcctcagcactttttccaaaaactgtgggaaattgcactgcttatatgcacaagtgagcttcatataaggagaaagaaaaccctctaggaatagttcttaattaatgactctcaagaggtgctgtataaataccaacttctctcacctctctggtgggataactctgtgaggtgtgctttatgtcatgtcagagtttctctgcaggattgcctgctatattcactgcttgaatagaaaattcttttttttttttcctttgagacagagtctcactctgtcccccaggctggagtccagtggcacaatctcgggtcactgcaacctctgcctcccaggttcaagcaattcttgggcctcagtctaccgagtagctgggactacagacatgcactaccatgcccacctattttttgtatttttagtagagacacggattcaccatgttggccagactggtcttgaactcctggcctcaagtaatctgcctgcctctgcctcccaaagtgcattgcagctgtgggccaccgcgcctggccaaatgttctttactggacgccttcaatccccttgtcatttcctcattttctttctggcctgcacttcttaaactagttacactgtaatacttgttttagagtctgcttctgtgattaacgtttctgatcagtaaaatggcatagcactgcttacctcaagagatggccgtattttgtcagagaaagaatgtacttcacgttttgcctaataaagtaaacgttcaggacccagcagttgcattttaaatgatcccagtgtttgccctgtttttgaagtacacatgtgcttctgggaaaactcaaactaagacacaccccacacccaactggcaaacacatgccctgttgaaagagtctgcagaagagtccttgcttcaggtacatttttcacattccagtcccagtttagccctcccccatcaccttaatgaccaccattgcataacaagcaatgccttcttgtgaggcattagaggtgactaggagtgagctttagggtgggtacccttcagggggtttctttttttttttttttccttgactaggagtctggctctgttgcccaggctggagtgcagtggcgtgatctcagctcagtgcaacctctactcacgggttcaagcaattttcctgcctcagcctcccgagtagctgggattataggcacttgccaccatgcccagctaatttttgtatttttagtagagacatggtttcaccatgttggccaggctgatctcaaactcctgacttcaagtgatctgcccaccttggtcttccaaagagctgggattacagatgttagccaccgctcccagccccagccttcatattgtttatcttgatttcttttttcttctctgttgtagtggatagcaccagacaatcagtagttgaagcccttttcacatcttcactgggcattctattaaatgacatatgtgttctccccaaactctaacatctgttcattgaaaatagggcaaacaccaagaccatttgtaatacaattgctgactattgaatatttactttgttagaaaaaatgctaagtactttacaatatttctctgcaataaaactcatcttttgagctaacaatgctattctcattctactaaggagaaactttagtcacagagagattaaataatttgctcaacaacacacaaggaagtaagagtctgggagagaatttgtacttttcccttccttttagatgtcattcataaaaaaaaaaaattagtgtacctgattttgtactcctagccactatttaatcctgcctctgtaattagcttttatggataagtttatctttccgtactcagaaaataaaatagtaaaataaaaaggcagcacaaggtgtcactaagtggctttcaccagaggtgaagttgtacagaattagagaggggttttaaccacatctagagcactgcccatagaggaatgcagaccaatttctgaagtcaatttgtgttatcccctgctccttaacctgggttccaataccagttacatttaaggaactctccttccccctctttccagacatttccatggtagaaacacagtagtagttcaggagttaggagacctgggctttagagctttttataaaatgggatgtctgaatttgatagtgtgcaatgttccttccaactccaaacagatgttgtcattttcacagcctctagaagccacaggtaccttctcaattagaagttctaaatgatttgtaatagtgagcactatttggattcctgacagcctatatcaggaaaataagcaaagttttggatcaagtgcttatatctaaagccattgctttataagctggtcttcactgccaattccttcttccctatagattgttggtatttctggtctggatgggttacaagaatttattttattgatttcctgaatctctgtacatccttaaaataattcagaattggaaagaaatacatttagctctttgtcacatagtgtagagatcttttgacataaagagagagctgctgatattctgtttcccctaatgcctgagtgtggcatggtttcaaagggttgctttatcacatgtagacatggagggaccatcaggtaatgagatataacatttcctggaaattaattagtggtgtgttgtccaggaactaaatttcttttactcctgtttgccacctgtcctggatgtctagtgccgaatttgaatttccatgccaaactgaaaaagcagcattggctttagttgccctctttttcacattaacttagggttttagcatgtaaagcgactgcgttgttttagtggaatgaacttagaatgaacttcaacagtgatgaactgataaccaattaaataaataattgattcatctgagaacagtctgactcctagaagtggtgttcctaagaagcttttgtgtaactgccctctggaaagcctcacaagttgttgcctttctttctttattttttccaaatggacaatttttgacaaacaaacttctaagagcagtcaagtgtcaaatacaaagttatggctggtgcagctgcctttgggatcacacgctccatttattcattatagaaagctcagatgcacaaacatgtggtgccattttgtgtacctgtcagtttagtgcgtttaatgaacattgatcatgctcatccagacacacttctcgatgctgcaagcaggaagtcagtggtttctgaaagacagggtgaaaacttgttttttttttttttttcaaatgtgcctctgtggaatcctttttgcccaaaatagatgcattaataaacatgactaaaatgtaccttaaattcactacaaaagagaaaagatgttgatgaaaaatttgctctggttttgctaatattaagtccagtatttgtctacttaaagtagaagttttgatgacttggataatcattagattgctatctagctatttgtagttttgtagcatcatctgttccaaaactgattttttgctctcttttaataccctgttaattacaaaacctcctactgggtagttttaccatacataaattctgtcaagtactgctgaattaattggtgccgaacatcgttccggtctatggtgggagtaatagttcttattttcttgccttttaatgtttggacacaggaaaaggaatatcacacaccagggcctgctgtggggtggagggagggggttttttttgattaggcaacatacctaatgtaaatgacgagttaatgggtgtagcacaccaacatggctgtcaaaattcctttcaaaattctcataaaagaggtagtttagcttctttttttaaattgtattatactttgagttctagggtacatgtgcacaacgtgcagggttgttacatacgtatacatctgccatgttggtgtgctacacccattaactcgtcatttacattaggtatgtttcctaatgctatccctcccccctccctccaccctacagcaggccctggtgtgtgatgttccttttcctgtgtccaactgttctcactgttcaattcccacctatgagtgagaacatgtgatgtttgtttttttgtccttgtgatagtttgctgacaatgatggtttccagcttcatccatgttcctacaaaggacatgaactcatccttttttatggccgcatagtattccatggtatatatgtgccacattttcttaagccagtctatcattgatggagatttgggttggttccaagtctttgctattgtgaacagtgccgcactaaacatatgtgtgcatgtatctttatagcagcatgatttataatcctttgggtatatacccagtaatgggatgactggatcaaatggtatttctagttctagatccttgaggaatggccacactgtcttccacaatggttgagctagtttacagtcccaccaacagtgtaaaagtgttcctatttctccacatcctctccagtacctgttgtttcctgactctttaatgatcgccattctaactggtgtgagatggcgtctcattgcggttttgatttgcatttctctgatggccagtgatggtgagcattttttcatgtgtctgttggctgcataaatgtctttcttcttttgagaagtgtctgttcatatcctttgcccacttgttgatggggttgtttgacttattcttgtaaatttgttagagttctttgtagattctggatattacccatttgtcagatgggtagattgcaaaaattttctcccattctgtaggttgcctgttcactctgatggtagtttcttttgctgtgcagaagctctttggtttaattagatctcatttgtccattttggcttttgttgccatttcttttggtattttagacatgaagtgcttgcccattcctatgtcctgaatcgtattgcctaggttttcttctagggttcttatggttttagatctaacatttaagtctttaatccatcttgaattaatttttgtataaggtgtaaggaagggatccagtttcagctttcaacatatggctagccagttttcccagcaccatttattaaatagggaatcctttccctatttcttgtttttgtcaggtttgtcaaagatcagatggttgtagatgtgtggtgttatttctgagggctctgttctgttccattggtcttcatctctgttttggtaccagtaccatgctgttttggttactgtagccttgtagtatagtttgaagtcaggtagcgtgatgcctccagctttgttcttttggtttaggattgtcttggcaatgtgggctcttttttggttccatatgaactttaaagtagttttttccaagtctgtgaagaaagtcattggtagcttgatggggatggcattgaatctataaattaccttgggcagtatggccattttcacgatattgactcttcctatccatgagcatggaatgttcttccatttctgtcctcttttatttcattgagcagtgctttgtagttctccttgaagagctccttcacaacccttgtgagttggattcctaggtattttattctctttgaagcaattgtgaatgggagttcactcatgatttggctctctgtttgtctcttattggtgtataagaatgctagtgatttttgcacattgattttgtatcctgagactttgctgaagttgcttatcagcttagggagattttgggctgagacaatgggattttctaaatatacaatcatgtcttctgcaagcaggggcaatttgacttcctcttttcctaattgaatgccctttatttccttctcctgcctgattgccctggccagaacttccaacactatgttgaataggagtggtgagagagggcatccctgtcttgtgccagtttgcaaacgaaatggttccagtttttgcccattcagtatgatgttagctgtgggtttgtcataaatagctcttattattttgagatacgtcccatcaatacctaatttgttgagagtttttagcatgaacggctgttgaattttgttgaagtccttttctgcatctattgagataatcatgtggtttttgtccttgtttctttttatgtgatggattacgtttattgattttcgttatgttgaagcagccttgcatcccagggatgaaacccacttgatcatggtggataagctttttgatgtgctgctggattcggtttgccagtattttaatgagtatttttgcatcgatgtttatcatggatattggtctgaaattctcttttttttgttgtgtctctgccaagctttggtatcaggatgatgctggcctcataaaatgagttagggaggattccttctttttctattgattggaatagtttcagaaggaatggtaccagcccctctttgtacctctggtagaattcagctgtgaatctgtctggtcctggactttttttggttggtaggctcttaattattgcctcaatttcagtggctgttattggtctattcagggattcaacttcttcctggtttagtcttcggagggtgtatgtgtccagaaatttatccatttcttctagattttctagtttatttgaatagaagtgtttgtagtattctctgatggtagttaatatttctgtgggatcattaatgatatcccctttatctttttttattacgtctatttgattcttctctcttttcttctttattagtcttgctagcggtctatcacttctgttgatcttttcaaaaaaccagctcctggattcattgatttttttgaagggttttttgtgtctctatctccttcagttctactctgatcttagttatttcttgccttctgctagcttttgaatgtgttttctcttgcttctctagttcttttaattgtgatgttagggtgtcaattttagatctttcctgctttctcttgtgggcatttagtgctataaatttccctctacacactgctttaaatgggtgccagagattctggtatgttgtgtctttgttctcattggtttcaaagaacatctttatttctgccttcatttcgttatgtacccagtagtcattcaggagcaggttgctcagtttccatgtagttgagcagttttgagtgagtttcttaatcctgagttctagtttgattgcactgtggtctgagagacagtttgttatacttcctgttcttttacatttgctgaggagttctttacttccaactttgtggtcaattttggaataagtgtgatgtggtgctgagaagaatgtatattctgttgatttggggtggagagttctgtagatgtctattaggtccgcttggtgcagagccgagttcaattcctggatatccttgttaattttctgcctcatggatctgtctaatattgacagtggggtgttaaagtctcccattattattgtgtggatgtctaagtctctttgtaggtctttaaggacttgctttatgaatctgggtgctcctgtattgggtgcacatatatttaggatagttagctcttcttgttgaattgatccctttaccatatgtaatggccttctttgtcgcttctgatctttgttggtttaaagtctgttttatcagagactaagattgcaacccctgcctttttttgttttccatttgcttggcagatcttcctccatccctttattttgagcctatgtgtgtctcttcacgtgagatgggtgtcctaaatacagcacactgacaggtcttgactctttatccaatttgccagtctgtgtcttttaattggagcatttagcccatttacatttaaggttaatattgttatgtgtgaatttgatcctgtcattatgatgttagctggttattttgctgagtagttgatgcagtttcttcctagcctcgatggtctttacaatttggcatgtttttgcagtggctggtaccggttgttgctttccatgtttagtgctttcttcaggagctcttgtaaggcaggcctggtggtgagaaaatctctcagcatttgcttgtctgtaaaggattttatttctccttcacttatgaagcttagtttggctggatatgaaattctggattgaaaattctttgctttaagaatgttgaatattggcccccaactctcttctggcttgtagagtttctgccgagagatcagctgttagtctgatgggcttctcttagcgggtaacccaacctttctctctggctgcccttaacattttttccttcatttcaactttggtgaatctgacaattatgagtcttggagttgctcttctcgaggagtatctttgttgcattctctgtatttcctgaatttgaatgttggcttgccttgctagttggggaagttctcccagataatatcctgcagagtggttttccaacttggttccattctccccgtcactttcaggtacaccaatcagacgtggatttggtcttttcacatagtcccatattccttggaggctttgttcgtttctttttactcttttttctctaaacttctcttcttgcttcatttcattcatctgatcttcagttactgataccctgtcttccagttgatcgaatcggctactgaagcttatgcatgcatcaggtagtactcgtgccatggttttcagctccatcaggtcatttaaggacttctctgcgctgttgattctagttagccattcatctaatcttttttcaaggtttttagcttctttgtgatgggttcggacatccttcttttgctcagagaggtttgttattaccgatcgtctgaagccttcttctctcaacttgtcaaagtaattctccatccaggtttgttccattgctggcgaggagctgcattcctttgaaggcaaagaggccctctgatttttagaattttcaggttttctgctctgctttctccccatctttgtggttttatctacctttggtctttgatgatggtgacctacagatgggattttgttgtggatgtcctttctgtttgttagttttccttcaaacagtcaggaccctcagctgcaggtctgttggagtttgctggaggtccactccagaccctgtttgcctgagtgtcagcagcagaggctgcggaacagcaaatactgcagaacagcaaatgttgctgcctgatcgttcctctggaagcttcgtctcagatgggcacccggccatatgaggtgtcagtcggcccctactgggaggtgcctcccagttaggctacttggaggtcagggacccacttgaggcggcagtctgtccgttctcagatctcaaactccgtgctgggagaaccactactctcttcaaagctgtcagacagggacgtttaagtctgcagtagtttctgctgccttttgttcagctgtgccatgccccgaagagttggagtctacagaggcaggcaggcctccttgagctgcagtgggctccacccagtttgagcttccttgctgctttgtttacctactcaagcctcagcaatggtgggtgcccctcccccagccttgctgccaccttgcagttccatctcagactgctgtgctaacaataagtgaggctccgtgggcatgggaccctccaagccacgcgcgggatataattttgctaaaaccattggaaaagtgcagtattaggatgggagtcacccaattttccaggtgccatctgtcacggcttcccttggtgaggaaagggaattcccggaccccttgcgcttcccgggtgaggtgatgcctcgctctgcttcagctcatggtccatgggctgcacctactgtcctgtacccgctgtccgacaatccccagtgagatgaacctggtacctcagttagaaatgcagaaattggccgggctcagtggctcacacctgtaatcccagcactttgggaggccgaggcgggtggatcacgaggtcaggagattgagaccatcctggctaacacggtgaaaccccatcaccctaaaaatacaaaaaattagccgggcgtggtggcgggcgcctgtagtcccagctacttgggaggctgaggcaggagaatggcatgaacctgggaggcggagcttgcagtgagccaagattgggccactgcactccagcctgggtgacagagcaagactcttgtctcaaaaaaaaaaaaaaaaaaaggaaatgcagaaatcacctgtcttctgcattgcttacactgggagctgtaggctggagctgttcctagtcggccatcttagaacctcccctagtttagcttattataattagaaggtgccattttttaataaattttttgtttgctgtgtcagtttttattgggagcaaattaccaaaaaaaaaaaaaaaaaaaaattctgtgttcaattagtttaccccagctagaggtgcattatatttagcaatgatttacttataactgttgtgtgggagaatatcctaatcagtttttggaaaaggctaagtatacctatattattctacatgtgttgttattttagcatttatatttcttttgattgagattttgtttcatcaccctggggcacaagatagctcaagaagacagatgtgctcaaattatgcaacagacttatctaaacagctcatgggtcttccaagttcctgatgaaaattagaattgaatcataatgctaagtgtctcacatatccaccctttagacttgatcatcttgtgaaataaatggagcattgcatccagtatgtggtacacttcaagaaaaaaaaatattcacctagcctttttgtggtctaagactctatcatttaaaaactttaaacaagtatataatgaagtgtattcagagatattcattgtagctttgtttgtaatatgaaaaaatcatgaataatctaatattctatcagtagaggaaaggttctaaaaggtatgggccgcacctgtactagaatattataaccccattaaaaataagataggccagtatattctgttatgaagagatgtgtgtgtccgtgagaaaagcagcatatagaacaatatgcatattgtgattattttcatttcataaatgcattgaaaaaatgtacttcttttttatatgtacgtgtatgtaggtaaatgcaaagaataagttttgaagcaaaattatcttcctttatggaggagaatgggatagggcacattgaaaaggtgcttttgatacaaacatctccacttttcagttttgcaaaagtgatgcattagactgaattttgtctaattgtgtgtaattgactttttttaaagaagaaattccgtggaatagataagaggaaccataattaatccaatcaactcagagggactgaacacgtgttatgtgtcagtcactatgcttgccgctgaggacacagtagagagcaaagaaacatgctggccctgacctcagggatatagaaactataggaaattgtataagtgtgcaaatttattattatgtaggaaaagtacaggaaattagaaaatcttacagttttctggtcagtgaagttttcctgaggaaggaatttttgcaccaacaactggagcctgaatcaaggttaactatacaaggaggttatttatgaagtcaaaacaattgaaacactaaagagagagttgggtgaataaacatatagagtatacctgagttaagtggaaattttaagaaataggccagattatctcatctatcttattgaattcaactaatctgtaatgccctgcaaatcgcaaaccatccaaaaagatgggtcactgtaactctcactgcacaaacaatgagccaggtaatattgaagccagaatatttttgtttcttcatttttgatttacttacgtagaagtggcccaagtgagtttcaactcaccatcacccacattatttgagtaactaaacatctgccattgcccaagccatacccaaatatcacctgaactaactctccctttctcccttccatcactgtgcttatgcattcatgtgtccaataaaatatttatggaacgttttgtatatgctagatgttggggaaagcaaacatggtccttactctataaatgtgtattctgttggaagaaacagacaaaaattaatagtcacaaaaagtgattaatgttatgaattaaatgattgaggtgccaagatagagaataaagaagagggcttattttagttgtttttttcagtgaaggtctctgaggaagtagcactgagctgagacttcagcattagaaagagccagatatgacagcatttctccccctttttaaagccaaatagtattccaccctgtgtgtgtgtgtatgtgtgtgtgtgcgtgtgtgtatgtgtgtatatatatgtgtgtgtatgtatgtgtatatatatgtgtgtgtatatatatgtgtgtgtatgtatatatataccacattttctttatccatttatgtgataatggacaccaagattgctttcatattttagctcttgtgaataatgctgctgcagtgaacgtggtagtgcagatatgtctggcacactaactgcttttttttttttttgatacggtctcactctgtcacctaggctggagtgcagtggtgagctcttggttcactgcagcatccacagctcaggcttgagtgatctcacctcagcttcccaagtagctggattacaggtgcacaccaccacacccagctcatttgtttttttgtttgtttgtttgtttgtttagttaagatggggttttgccgtgttgctcaagttggtctggaactcctgggctcaagcaatccacccacctcagccacataaagtgctggattataggcatgagccacagtgcccagcaaaacacactaatttcaattactttggacatatacccagaagtgaaattattagaatcatatagtaattctatttttagttttctaaggaactgccatactgttttctgtattggcttactaatctacattcccatgaatagtgcacaatggtttccctttctccacacctttgccaacacttcctttgtctcttccataattgttctaacagatatcaggtgatagctcattgtggttttaatttgtgtttccctgattatcggtgatgatgagcatgtttgcataaacctattggccatttgtatgtctactttagagaagtgtctatttaggtggctcatttttttattaggttatttgtgggtttttttgctgttgagtttcatatatattttggatattagccctttattagatgtatggcttacaaatattttcccccaatctgtggttgtctctttattagttgtttctttggctgtacagaagctttttagtttgatgcagtcccatttctttatttttggttttgttgcctgcgcttttggggtcatatctaagaaatctttgcccagaccaatgttgcggagcatttcctgtatgttttcttctagtagttttgtagttttcggtgttatattcaagtctttaatccattttgagttgatctaggtttacgatgtgaggtaagtttccaatttcattctacttgcgagtgtcttgccagttgccacaacatggatgaacttggaggacattatgccaattgaaataagccaggcgcagaaggacaaataccatatgatttgacttgcatgtggaattttacaaagttgaactcatagaagtagagagtgatggttaccagaggctgggggagggattggatagggaaaggggaaatgttgatcaaagggtgcaaagtttaatttagacaggaggaataagctttggtgatctattgcacaaagtgatgactataataaataataatgcattacatacttcaaaattgctgagtaaattttaaatgttttgccataaaaaattaaaagtatgtgaagtgatgaatttgttcattagcctgatttaatcatttcatattgtaaacatatttgataacttcacattgtaccccacaaacatgtataattattagttgtcagttacaaataaaatttaaaagaattgaacaaataaaatgtaaaaatatatctgtttaaaaacaaaaaagaaagaaagactctacaagaagagtaaagggaagggcatgtgcaaaagtcttgagctaggaaagaatttgggacattcagccactgaaacaaggagaatgtaaatggagaagcatagcttcagttgaacaaagattgtagtcccagattggtgcagcatctgaggggaaaacaatgaaggcacagcccttattgagacagtgaaagattagagtttgttttgtaatttccggggctggcactgtttttcttggaatcattgaatcttaggtgtggaagactctaaaaggtgatgtaattaggtcattttctctgttgcaggcactttatattggaggtgtgagtagctaaagttctctatgactacaatttttttccacaccttggagccgtttttgtgacagactcaaagacctatcatccatttcttccacgaaggcaatattgaatatatttggagcatcactcctgcctcttcctatatgctgttaattcatgtcgccagcgtcctaaatgaaagtcttcttcatatccaaagaatcttggcaataggaagcatttaaagtcgtcattattttaagtgaagctctcttaaactctgagacagaggagaataattctcttataccacaagaagggctttttcaaatggtcccccatgaaatctatttctgtgtctttccaaaatatgtgaagcagagagttgagccaattatctaaatcatttaagtcaaagagcttaatactaaagtgaatatcctgaattattcccatgattgtgtgtattattaaacaccattaattctaccaattaattaccaattcataaacttctaaaaaacttaaatataaatacagtcatccctcagtgtctgcgaggaattgcttccaggacctcccttatataccaacatccatggatgctcaagtcccttatataaaatggcatagtatttggacataaccaatgcacattctcctgtataccttaaatcacctctggattacttataatacctaatacagtgtaattctatgtaaatagttgttgtaccatttagggaataatgatgagggggaaatgtctgtacatgttcagtacagacacaaccatccaactttttccaaatatttttgatctgcagttggttattagggagaggccaactgtataagctgtatacaatctgtaatagtgaccctggcagcctgtttcagcaaggcttctcagttgacctgcagaacacaggaaattattttagttactcatcttcttagttctcccaaaaaatgctaatgctgttctgttagtattttaggtgcataagagaagcagataatctattacatacaagggatgttcctctatttagaaagcccacttaagaaaggctggtaggttatttaaaaataaaacctagacataaatacatgcctacatgcaatctgtacaaattctacagaaatcattttatatctatttactcttattttcttcccacagaacgtggagcactactatgatttctattcccttgtaattaatttctggttgtcgacttaaactgtgcctttattggcaaagtaaagtgttaaggcaattgaagagacaatgcaggtcaaaaaactgtttatatctctattagaggcaaaagctagacccttagtaaatgtctgttgagtgaagttgaattgaattagtttgagttgaattgaattgaattgctttgagagagcagtagctggagccaattatgactttatcctttggccagtattttcagctgaatgtttcaacaattattcattcaaccaacatttttattgagtgcatacctattatgagccaggcaaaaatgtggttcagggttgtagattcaaagattaaataaacaaggtccctagcttattattactcaagatgtacaaaggaagataatgccatccatgtgtaaaagtaaagagttgtaggcatctctcacaagcataagtaaatgagacaggaaaggcagtgagtgctataggagaaggcattctgaaggactcagcaactgattagagtctcaaggtatgaccttcctaatcagatgaggaaggacgtataattgccatttagtaggcaagagataatgttagtattttctcttaggtgttttttaagcttttaattattttattgaatctttctggaatcactctcttttggcctttggtgttgtggatgtggaaatagggtgttagaaaggaatcctttgtgattttaatgtttggttgggatgttaactgcaaattatgccatcaactctgacagctattttatatatattcattctcactacagtttttaatctctgatctgcagtttaatgtctcttatatcttttattttaagcaacttcatatatttccttcaaatatatatgaaatatatgtatatattttcttcaaatatatatgaaatatatgtatatattttcttcaaatatatatgaaatatatgtatatattttataaatagatatggaggtaaattggtagattgaaaataaaatatatgtattaagttgagaatataccttagaactatactttccttcttttgggaattggctagttgatttttctgatcggtttttttctttagagtatagaatggtggacttggagtttataggtccttagataaaatgtttactttgtgtatagattgcttgagacagattgtgttaagtgtttcttcatcttgaactttttttctgctttctacccatttttatgccagtggatcctgttcattgccaaagtgctcagacacatttaagaactgtatattcctcagtctcaattctagcgagtaaagggaagactctaataattaagtctgtttagttgacactttcataggtttttccctctcttggaatgctttagaagaaaagtttttataaagaaacctactccattagtgtcccttaaaatactgtataataaaataatatctattaagagactcagttatcttaattttcttcttgccatgtgatgaatgacagatttttactgccgtaaatgtgcattttatgtaaagccctttatattgtgaaatttaaaacatataatttcaaataatcaaaccccatatttctaaattcctatattttattccagaaaactagctacttaaaagcaattgaaaaaagaaaaaccctagcataagttctaaaaattttaacatgcaaaagtatcctttctatattgattaaaagatagatatacaaactcactctcaaccattctgatggaaaaaccctggcctgggctctgaagccattttttaaatggaaatcatgaatgattatgattcaggtggcttctagtacacactttgaaaaactctgaagcgtgaagcgtaatcgccaatatctttgaagattcatgacatttatattggcaaggaggaaaggggcacatggtgagctgagggagagttcgtgtagatgtctgggggtaatggcttgcctactttaccagttaaggcatacatcttgaaaataaatcagcattcaatggggtctttgcagtctttgatgtctcagtattaatagatccattcccagcatcaaaattggtactgcattatattttaagcctatgaggggatgccctgcctccagccagagtggttttgcctaccttaccttctaattttttaattccacttcttttcacttatgtttctattgacctccgcaaggtcatagactttctactctttcttaacagtttgttccctttcgccctttatttctttcaccagttctttaaaagcgttcagcattgtagaattttcaggatattcctttattttaaaactgtgttatttggctgggcacggttgctcacgctagtaatcccagccctttgggaggccgaggcaggcggatcacctgaggtgtcaggagatgaagaccaggctggccaacgtggtgaaaccccatctctactgaaaatacaaaaattagccaggcatggcggtgcgtgcctgtaatcccagctacttgggtggctgaggcagaagaattgcttgaacccgggaagtggaggttgcagtgagccaggatcaagccactttactccagcccaggtgaaagagtgagactctgtctcaaaacaacccccccaaaaaaaacctgttttgtttattcatttacttatttgtttgtttactttgtagcaggcccaaacaatgtcttttactcacacttcctattcagaattgtttgccaagataagaaataacaggcagaaagtcatgactcagtacagttaatgatattccaaaagatgctcagctcacatatggtggtggatctcccactggcttggcaggtgcggtaatagcaggctaaagaatgtggaccacggtctggagtctggttctcaagtgggcaatgagttttaaacaggatatgaagccatttctgattgactgatctgattaacatctgcagcagtgtttctccaggtatgattcacagagacgataaagatatactgtatcttcaattctactttttagagagaaaggggccactagctggatgaacactgggacagcaagtgcaaactaggatagtccaggctagactgtggccatggtcaccctgcttctcaactaccatacctagaatcatgggaaatgtttgttaaaattggagatccttaaggattactttaagatgtctgaaattcaaatgggaatctgcagtgcttcctgtttctgggaaattaaaacaaagataacttttatattagagcattaggacattagatgtttcaaagtgtgggctcctgaccaacaaatccacaccacctgataacttgtaagaaatgcagatccctaggcctcaccccagacctactgaactagaagctgggatggggccaggatatctgttttaagactttccaatttattattttgatgcatactgaagtttgagaaccattgttctgttggatctggcaaaccagtgtctttttactttattttatttttttttacttggtatcataataatatgatttttaaaaatctggatgttcttcccactagcatttcctcatgtcagtgatgatcgaattttaaccatcattgaaagaactatagagagatagctataaggagatatgaagatatgaatgttccaccttagcttgaattgtggtcatctgaagtatctgtgttcctctctctttctgtctctgtatgtgtgtgtgtgcgcgcgtgcttgtgtgtgtgtctgtatctgattctaaaatggaggaagaagacaagtctagtggcttggatagctaagggaaaggagtgaaaggaattatggagaagagaagagcaataaaacagagacaaacattgaagcagttgtcttcttagagggcctggttgtgatcctccatttccagtgcccgaggcattcagctctgcagtgaacaccaagatggtcaagttcaccagatctttagctcaacactctgaccattttaaaagcagtgccttttgaaaaaaaatctttgggagtaaattttttagttttagccttaggagtgtcaaaactagtgctagcaaaagcctctggcaataagtaaatgagattaacaaagccaagggaactgcacagaagtgttacaaacctgaagagcagttttctttttcttccataaatattatatttgtaaagatatgcttggcattcagtcatttgtccactgtccagatcactttttttaaaaaattattattatactttaagttttagggtacatgtgcacaacgtgcaggttagttacatatgtataccatgaaactggaaatcatcattctcagtaaactatcgcaaggacaaaaaaaccagatcactttttagtttcataccggcaaaggtacgagctgatggattaagtcacactgacctcagatccattaactgacacaacttgaaaatccctcatatgtctttaaattccaaatgtatgaatgaaattttgtgttgtcatttgtcattgtgtgtctttgtttagatatgaccttaatacatattgtgagcagataatttgtgaattgctcataattctcaagagttccagttcctctcttcacttttaatatgtgcgtgttgtgctaaagcttccaactgatgtcgtgtgagtgtatttgagaatagagacatgtgtttgtctttgaatgatggggtatctatacgttgcaaagctaaacattctgaattttttaatttactcatccattcaacagatgtatatattcacacatatacgtatatatatgtatatacacacgtatgtatatacacacatatttgtgtatgaatgaatatatgtgtgaatatatatacacacatatttgtacatatatattcatacatatataacaaatatattcatacatatataactatatatattttatatatacatatatacatatatctaacatatatgtatatatgtatatatatatacatgtatataacaaaaatatatacatatataaaaagattatatatgtgtttatattttcacacacatatatatttctatatacatatgtgtgtatatgtatatgtgtgtatatatatataaaggttaaatgagtattccatggccctgtatttgattaatggttaattcaggattggaattgatgcattatggtgaggtatatctactgtacattttgggcaccattcacttatatggtcatcagttcatttataaagtgtcactaaagacaaaatgagttgctgcattttaccttcagtaattacaaaataaaagaagtgaaaacatttggaaaaatccgagggagctcctaagaactccattattgggatgagtggactatgatatgcagtaataagcacatgtattaatatgtgattcaaaagtaacattttctatgaaggacaggtatcttatttaagcctcctgcctgtatgatctgattgaatcagcattgcttaccataggacccaagagaaataaaactatatttcccaatattatctgtccccgaaagagactcttgttcatggagaaatattctaacaaagctgaagataaagtataacctttgggggcctcttcttcaacatattctattctgcagagtagcaggtaataaataaggtattagggtagcttttcagttcaaatttaattttgattcctgcagtggattcgactgtggcattcaaacatagatttgcaggtgcagagagagagtgttacttagccctgcagtgtgactaattgctggtaattgtctataggaagggcgttagaaaggcctgtctccagattttcatcatattttacccaaggacactggcaacgtgaggaggcagtctggagcactgtagccattaagctgttggcagtgtgcagtatacaaaatgttggatctaagtttaaagacaagcctgtgtaaaatgaatttttatataaatagaaaactgtgaaaatgtaatcattgaaaaaatgctgtattttcatttctgattaaccttcatttgaaattggctcttagcaacatatacttccttctcatgtcttgcttttttcctctttccagtaactaatattctataactagtatttaatatgctggttagaaaaccaccaggggatttaactggatatgaaacaaaattgatttataatgaaaatatgtgttgaagtaagctttataaaatgggaatttagtatatccttaagtcagatatttctgtaaccttgtgaaaaagcacagttcctatgtcattttggtcacattgtttttctttcctttccctcctgtttctattatgcttttgttaaatcgaggaaggaattcaagtaattagcattttacaattgtctggaactgccaaaaaaatacctaacaaaaaatacacattattatgggaactgtaaagatttaagcagatataactcaagagataaaatgagttattccaaagtgtgaaatgaagaaagtccagatcttggcaaatgagaaaattatcttgctatctgcaaagcattctactaaattttaagatttttttttaatagaatcagaactgcaaggcttgtttgtctttatttattttatcctatgttccttaaatattgaactattgtaatcttgtcgttaacccccatccctaacacacacacattttttttttaattgggagttttgtggatttgtctaaaaaaggaaacactgtgatttaggattttggtaatattcagcataatgattagttttattctattatgtggaccttaagctacttgggtagtttaaatagtgatagatccactagtactatttctttgacagataagatccagaggcttacttctaaatgtgaatcctaaattaccaaacatttttgaaatggttaatgagagtgcatctgtttctttattccaagtttaattttcaactggatatctgcactttgtctctgaagaagtatttcctagaggaggaaaaagccttttgatcctttttaataatttacttatgagaagtaatttacataaaatagtagcttatttatgaaaaatagggagggtgtaaggagggagaggagaagaaaaggtaactattggttactgggcttaatatctgggttatgaagtaatgtatacaacaaacgcccatgacgtgtgtttacctgtgtaacaaaccttcacatgtacctcgaaacctcaaataaaagttaaaaaaaaaaaaaaagaagaaaagtaacttagaattcagagggataagttttaaaggaagccctgtggaagccttgcaggaaaaagttttctttgacaaacctgtcctttcaacataattgatgagttggttccagcctggttccttgtgacccatccagcactgagtaggaaatgacacagaaaatgaatgttgtggtctcatttgtcagccagggccactagtttcttgcaggatacctgaattttcttctgtgcttttctcacatgtgcccatccctccttttctttcagtgcctttctctccctttaaccaccagggcgactgcccttttattagtttcttagcgttagttctaaagagtctgatggcctcttgtaacgtacatattgagcttccatagcaaagaatacaaatcatcacaaatcacaatagtccaataagaaagaatattgatctttccaaagtaatttcagtcatatatgactgagctcaattttaaatatgtatttcagtgtcgacttacccaacacactgaacctgcttctctgatctggtattagacttgtactctgcctacagaccagtgcctaggttagttcatccataaagggaccaaaagcagtgaccactcctcctggggtgaagttcagtgtttctttttttcccatttacttagttaagcagtcagttttaactttactatccagctgattttgtgtataaatggattcatttgtagtttatcttgtttttgctaggctgtgggctaggaaggaccaaatggatttacgtagtttatcggataaaccaattttgagtatcattttgtcaggaaaccctttttaacctcttcctggatagccccagccaccttaatttacactcctctgggagcatttatctttccttcatggcaatgtaattttgtatatatttacatgttctttttaaggcttttcattcagtcttttttgaacaactactttataccaagtcccgttacttcaatgaatataaatggataaaaatctctgccttatgaagcttgtattctagtaaaaaaaaaaaaaaaaagcagaagttaataacatgtaatagaacatcaggtaatgaaaagtgctatgaagataaaacgaggcagagtagaaatagagaatcacctaggagaagaggcagtggcgacattaggtatgctgttccggagagtcctctctgaggaagggatgcagagccaggaactaaatacaaggagatgcttgtcctgggaagatgggcgagaactcttcaggcagaaggggcagccttcttggaagctcatttaccgtattcgagaaagagaaaggcaaccagtgacgctaagagtggtgaatgagggaaagtggcagaaatggcgagtgtagaggctgacagggatcagatcacatagagccttgttgggtgacataagaaattcatatttttttctaatttaagtggaagatcaaagtaggattttaaattgtagctcacctgttagaccatgcctgccatatgaggacagagtctgccattaccactgcagcctagtactgaataaatattggctggctggctggctggctggctggctggtcagacagatgaactaatgtccttccaaccctgttgcttttacttatgtggttttattaaaaacaaagcattttgttggtttgctttgttgctatcagagttacacatattgttattggtattgcatttgtaccccttgacaaaaggaagtttactatttattatcactagataattagaatttcctacctcacatgcctgaaatgccgcatccccccaccccacttcttactatgtaaaaaaaaaaaaaatctatctctctatctatctatctatctatctgattggctcgacagcttgaacgtgattgagtgtccatttaagcctacttgtattttcatctgattactaatcctgaaggataatgttaagccagattctgcagcacagaggtcagaggatcagacatcagctctcctaaaatgatgggatgggatagaaagaatgatgataacccgattaatctccctttagggggactctggagtcaggagatgtgtttgtggccttggtaacagccttcctgctggttagaggaggacctgcatattcttgggattcctctctcataatgggtcacaccacatccaggtattaccacctgggagaagaaaggtgacagctatttttaattctttgataaatctcgaagatagaggtggaaccaaggatgtcatggaacatcatgcaagtgttaactaagtagtcctctttgaaaatatttagatctatagactatcttgccgcttgaaaaacattttatattgctaagtaggaactgtcttcttaattttcttataattctctttgcttgaattatccctaaaaattaaccatagattttcaaataagctcaaagaaaacatggatgttaatgctagattcatcatgtaataattattattatattaatagtaattcacctttgcattttttcatgtcttagtatttaacttctgtttcatgatcctgttcatcctaaagttagcacctttttcttgccatgtatttgccaggcgacatatttgatcggagcttccagaacccatctctctccaccacatcctcttttactgacactccgggatgctgctaatatcaatttgaggttttgcagagatgggggaagcctacattgtctgcatgttctgcccttgtctaggttgtatgattcttgagggtagtgactacatcctattcttttttctgtttcctgtagcacctagcagaaactctactgtatagaaggtattcagctagctgttcaatgactagatggacagatgaatgagtgaatattttatttcctgttctgattttggtaggattcttaagtccataattccctaatctgcccactttgctcagagatacaaatttcaaaattccccttaaccttggagagaccctagggaagggcagcattagcttaagcagtgggagacattttttcagtgtaggatcttttttcctgtgtgttttaacctcttagagagaacgtgggttctttattcctgctgtggcacggtcctgtttttattagcgtacccaactagactgcagcacatatgttacaatgagccatgccacatgcaaagataaacaaatgtgatgttaatgagatttgagtgtagaatctgtttttctcttctatagcctccagagttttagagaattttgtcactgtcccatttaactggcatctttcttaaagggctggctttattcataccaattattttctcattctctccctgattcctttcactcaaattcagtaaactctcatcttccagtacattatcctgcagctcatttataccttcaccctcactccttgaaatgaattcagaatctgatttggagcttgtctctctaagtgtaaaacacctcctgctataaataaacacactcggtttacttaggtttgatacttagatgagttgcatcagcatatgttctacttcacgttatcagcgtcttctgagttgaattctcatcatttttttgccttaaaaatgacagtgctaaatatgtcctgagggactaaggcaggttgagaaaacctctctgcagtattggagaaagccaagttaaatccagcctgctagcctaatgtaaacaatataatcgttcttcccttatttactttatttgtgaggatcatatactagtaaactggggtagagtagatgagcaaaaaataactaggggaagaacaacatgaacggcaaagttgcttatgcaacaaaagacatgtcatattttatctttcaatttaagaaaaaattatgggagtttcatatgcttgacactatcattattcctctactaactgccttctattataatgagtcttctttttttctcccagtcaacacattacatatacctctatttaacatttatttcttgattagttgttcataggtgtatcttttcccagtaccccacctccctccatacaaggagcctaagcatattgccatgaatgtaacagattccaagtacatgcctgttgtgttgaaacattgctcaccaatcacaaattttggcacattctaattatctaatgtctttaagagttagtgttgtaataaagacttaataattatttgtctatcaatcattaagttgatatcagtgtaccaggaatagtaactcctcaaaaaaagccagtgtttatgattaacttctaacatttaaatatgctatgtctatatttataatatattttatgtgcttgtttattctctgtatccactattataatgttcataagagcaatttctttttctacgtagcaagacctgtaagaatataggagagatactgtatttatatatgtatgtatatattcaataaatttattcaaaaatatgtgttgagtacagatatatgtacatattctgaatgaatatattaaaaatgtatataccttatatgttcatatactcagtatgaatattcaatacattatacatatctatactcaatacatatttttgagtgaattaattgagtacttcttatgtgttgggttctgttaataagtacttcaaatgcattatctctttcaatccctcaagattccagttaagtgtagatactattattatcctaattttaaggatgaggaaatgtaggtttggcattggtaagtggttttctgaaagatattcaattcataaaaaagatagaatcaagccttaggtccaggcctgtctaacacaaaagcaaatgcccttagctactgtgatatacttctcctacagtaattaactgagagaaaattttgtgtgaaaatatggaaataattgtgcctggtgggatcatggacactaacaggataagatcatcaaatagtcctgtggtcccctatgatgaggtgagcgtagccaagcccagagcaggcagcgaagcctggtgggggaaaagctgtggggcacgcaagagaaagaggtcacaagcctggggcagagaatgtagtgtccagttggaagcatcatgaatcagaatctgggtgatctgtgattctggaactagagtgttgccttaaaagcaagtatattcacctctcaagaagaaaaaagcaaatgagaataaagatggaatggaagatctatcaagtcattgggacactattctcgactgttggagtgatagggagttgtgtgcagtgattgggcttctcaaatgcaagtggtgaaaactcaactcaaatgaacttgagaattgtcctctttctccccaggatctaaattgaacactcgaaagctatcggaaggttggtcgagggcatgaagtagtactctgccaaggcttttttattaacagctcccttttctgcatattcccatggagccagaggaagtgattctctgaatggatatattctgctagtaacatatcgtggcagctgtatccgttatccatttaacaattattactgagtacaggacaatatagagaatatgttacttcctctgttaactctgccctggttgtccagcagcccaggtgtcctcacctgttaactgagagtgagcaagtctaatttgtgtttggtaggcagattaagtaaaaatgtataggaaagcatcgtgtgaatgatgaggtaccatatcaatatgaggtactattttatcatcagtaccaagccatgtaaggctacctttctatctccagaggcttttactttaaatctccaacctagcccatgtaacttttttttattattacactaatttccacttccataaaaaaggtcacagttttcagagagtgcatattacttatataactgtttaatcaaaggatcatgctaagatataaggaaaacctagaatctttatacattttcccaagctagggtgatgtttggagcatgttggatttaaaagacagaaaaataatagagaaaagctttgctattttcgagatcattatttgaaagatagtttcatcaaccactgataggtaagtcatctattaatgggcatttgggttgttttcagctattgactattgtgaataatactgcaataaacttaagaatgcagacagatagggctgggcgtggtgactcacacctgtaatcccagcactttgggaggctgaggtgggtgcgtcacctgaagtcaggagttcgataccagcctggccaacatggcaaaaccccgtctctactaaaaatacaaaaattagccgggcgtggtgatgcacccctgttatcccagctactagggaggttgaggcaagtgaactgcttgaacccaggaggcggaggttgcagtgatctgagatcatgccactgcactccagcctgggtgacagagcaagactccatctcaaaaaaaaaaaaaaaaaaaatgcagactgctagctctttgagatcctgatttcaattcttttggacatatatccagaagtggtattgctggatcaaatggtagcttttaaaaatgtggtatatttatgcaatggaatatcgttctgtcttaaaaaataatgaaatcttgctatttatgacaacatggatgaacttggaggacattatgctaagtaaaataagccagacacaggagtccaaatactatatgatttcacttatttgtgttatctaaaatagttacactcacagaagcagggaatgggatgcagttgctagagaatggagggaggaggaaatgggaattgttgttcaatgggtatagactgtcagtcaggcaagatgaaaaaattccacagatctgttgtacaacatagtgcttatagttaacagtactgtattgtcactttattttttgttaagagggtagaagctgggtgtggtggcttacacctataatcccagcactttggaaggccaagatgggtggatcacttgagcccaggaatttgagaccctcctggcaatatgacaaaaatccaatctctacaaaaaatacagaaattagctggtcatgctggcacatacctgtagtcccagctacttgggaggctgaggcaggaggatcacttgagcctgggaggtcaaggctgcagtgagctgagatcacaccactgcactccagcctgggtgaaggagtgagactctgtctcaaaataaataaataaataaataaataaataaaataaaaaagatgccagtcaggtgtgtgtataggagctaggagatagaagagatgtgtttgtatgttttcttgtttaaagatttttgaaggctatgatgattctcaatattgcactttgcaatggtagtttggtgacaggtttagcatagctatttggcagtgggattccttggaggtgtaaaggttttatcagtgtcactttgtctcctgtccaggtttttaccggttaaaaaaaaagaactaaggagccaaatgccactcaaggttttattaatagagactgaataactcccaatacaggctccttgctaaaatgcaactagtgaatttggcttggaccaaagcccccactttgaattaagataacttgtccccaagaagagtcaacctgactcaaccaaacaagttacaggcaaataaattggaataaagaaagaaaatacctggctgggcctgaaaaggcagaccctgtcctctctgcttaccataggcaggcaagaaccaagctgagctcaccactcacattgttaaaggaaaagatcacagcagatattacagagaccttcctttccctagggaacaagtgaggaagggtgaaggggggccaagagtggtattaactttgccccctgaggtgggaagactactcaattacttttctatgacctaaaagaagaatgtagagatagaagggaaggtatttggttttctccttcatgattaatcaattttatttatgagaatagagaagaaatattcctaagtaaggaagtaagagtgaccttgaaactaggtatattattatccagatatggttatagtctgaatttaatttttattaatgtaataatagcttacatgggccttatggcgacattactagcactctaaaatttaattagatttttagagcttctattaatgtcttttgtaggattatacaatctggggcatcaccagcaagcttcatacattttattttcattatgatttgaaatgagaggaatatggtattttgtgaattaaaatagtttagactggggaggtcttaaaaaaaaaaaaagaaaagacaaccccagagggttgaaatcagttttttttgtactaaactggttatatgtatttttatatagatcttaaatatatttattcaccaatattaaggaattaccagttttttatttttatcaaatttttaataaatattagttgactgtaaccatataaatgtagttatcctcacgatagtttaaaaataatcattttcatgcaacatattttctttagtgtgtatatttcttgagttttttgcgctgatgaagtaagtattccattttcatggtcccttcattattgtatcctgattatatatgtaatatgccttcccaggttcagtaaatcctttaaattaatagaaaaatctgttcagccttgttgagagtcactgcatcaatgtactggttacttttgtaaattttaacccatttatctctttccctcacattccaaaaacaagaactcagggcacacattaaatctctattttacataaagcgtgctcttgaaaaggagatagatactatagattcttagtgacattctttgagttttcaccattcaaactcttaatttagagtagcctgcaaatcaggtacatgcctaggtgacattcacagagaatggaaaagaataaccctatccagaattgacataaagtgttagcattgtatacagagcaggaaaaatgggaacaggaatcagaagctcatttatagactctgctatctactgctatttgatccagaaaagtcattttacttgccctggcctgagttttcttctctgcaaaattaggccgttgggaaggaaggtctctgcatcccatctgagccccagcaatatataaagttgattactgcaggagcaccaagtgttagttgctttgtgcatgcatcatgcgaattcaccgaggctttgtgcagccatgctctgctgcagtagttctgtccttacatgccttctggtggctttagagagagattctatttgggaagggacttagtctggcatgattagagcctagtaattacaaaagtgccaagtgatcctcatctataattacagtgctagtttgttactcattgtccccgaggccataacattaggtggaggagggcatgcgcacggttcctgaaacttaaatgcatccatacttttagtgctgtattttttgctgaattggtatttatctttaatgaatgccaggcttctaccctttcggaatcaatcacttctgtttatgagttggaaaaagacagggaccagagcatgtaggagtatatgagagacagtgtcttattactcagcttatttcctaatcctcgtatgaagataagatcataaaaaatacaaaacaatgtcagggaaagggaatatcaaagcccagcttgttaaagagtcatgaccccagagaagcctagacccctcttctccatgaactctaaaaaatcacctttttttgtgtttttgttgtaatactggccttcattattgcaaatcttcctggttgtactttacaatgattttaattttgtttcctgattagatctttgcaattattcgtaatgttcatctgagtgaaataaaatgatatacactgaagcagtgttaacagattgtaagatttgatatgttttgaaaagaaatggtaatgataaatgacagtgacctaatttgtggaacaatcttcttgtacaaaataatctagtggttggtaattatgtgattaactcaccaagaaaaaaaaaagtcaatcaagtcagaatcatcaagttatagaatcaaaaaaaatgtctggaatgttcccagttaattcattacctacagtgaacttttcatgtgaatgccaaaacataaatactattttaaaaacatttaggggaaagatgtacatttattaaccctaaaactcaaaagacaatcaagaaggaaaaacagcgaaaatctcgaaaagcagtaatgatagctgcttgttgttagtacttatgaggcactttcaccaacataaaacctcatctcaaaataaatgagtgaaggagtaaggcacaatataaccaagtccattttcaacatgaggaacttgaggctcagtgggattcaatgccgtgttcatgatcatgtagcttttcagaggcacggcttcaaaatttgttacctacttcatgctcttttaactatgtgctgttaagaaaataaaagtgaaatatctatgggatatcaattctgaaaaaatattagcacatttgattaggaactgcatcattgagaattcagttaagactttatttataatgcacaaaagcaatagatatgtataacttgaaggtcagtgttataaacatagcccaaactacaagtcaacagagtgaattatagtttggttaatatgcaaaatcattaagatggtttgacttgaaaccagcaaatcatatgaaactgtatttataaaactacaattacaatttagaagttattttgaaaagaaaatcacactttcatgatgggaatatgaaaaatattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaacggctgaatacctgaatgtgtgaatatttttaaaaactttttcgatcacatttatcctggagtgagatgaaaatatagctgttgcatttaagaatgtaagtagtgggtgagtaatttagagatatcataataagcgttttggaagtagagctaaaagataaaagagtctttgattataaataactaaaaggagcagccaaatcactaaataccaggcatacttcatctgttagtggccttagggacaaaaataaaaccagtaaatatggtgtggaagcaactaatcatcgctggattgctcaagagaggatatgtgtgagacccacataaaggtagggatggacttatgagttcttccagtaaagggctgccattgaacacagcaagggctgtggcagacagatatgcaggaagcaataggcaaatttaatatcagtaaggaagaatcatcaagctgtgtttggcttaataataaccattattcttcatttggggttattgattgttctgaaggctacgacaagtgtaatgaactgttaccaccactttgggtgaatgttggccctcaaatgatcattatccagagaggacaatataaataaagtgctgaaagtacagcaaaaagaagagagttagaaaagggagaaagtgggtcttgcttccttccctagtcttttttcttttttttaaggggagacacctttgcttctatactttacttcccattaccggaaatctcttcagcgatccgttttaactgccctggtagtggatcagaagaaggaggacatttttactgttaaggttttactgttttgtcagtgatggaggaagggcgcctccaaaaaatatgcaaagttaaattcagtgtttcaataaattgtttgtttagccagacgtgtctgagtttcttgcctcttcgggtagtcattcctgaagtgtgtcttattgagcagagataacattattgtgtagtccctgaaagagaattggaaccaagttttgggggaaagcttttgtgcacaggtcagcaaagttaactgttgtattagtggagactaaacctggacactagatattcaaaacttgcctctcttctctctgtcagttctctcaaaatcagggttaatattcaaatatattaaattcaaattgaatttgttcctagtaagcacttactatgtgggaatattttgctaggcacagtagattatttaatccatactgtagacaggtcacataggcatttataatctctgttgtactatcatgaattgaggtgaagagagattgggtcacctgctatctgcacagctaagagcaggtagagctgggaactgagttcaagccttcctgaatctgaatctcatgatcttttaccatacaaacttgcctgaatgtgaattgactggccttatgagggagtaatttccccatcactgtgataagagtagcagtcttcctcctcctctcccttcttttcctactcctaataaagcaacacctgcctctattattatgaatgttatctcaaattgtatatatttatttctattgagttgaaattcacataacatagaactagccattttaaaataaacaattcagtggcatttagtacgcttacaccgatgtgcagccatcatctctattagtcctaaaatattttcatcaccttcaaataaaaccccattcccgttaaggagttactcagcattcctcttcctcactccacttccaaccctagcaaacaccaatctgctttccgtctctttggatttacctattctggatatttcgtataaatagaaccatacaatatgtaaccttctgtgtctagcttttttcatttagcatgatatgtctgagactcatccacatcgtagcacctgtcagtatttccttcttttttatgtacaaataatattccactgtgtatatataccgcattttgtttatccattcgtctatctatggacgcttgagttgtttccaccttttggctattgtgaaaagtgctgctgtgaacattcatacacaagtatttgcttgaggaactgttttccattctttgggagctacatctgtttttggcatttactttgtgctagtcaatgaactgagtgctttgtaccaggaactctttagattctcagaaccctatgaggtgaatactattattatctctgttttacgaatgaggaaatggattcacagagaggttaaagtacctcatattgggtcacgctgagattaaacccaatgagccaggttcctgagtctgtactctatactctttctttcttttgttgcgtcagcttcagacttgacacctagagctgcttctgctgttccctccccaataccaagcttgcctgcttttcccgggcatactttcaattgttgtgtttcctcttaaaattcagaatccaatgttgcatacaatattccaaaagtaatttttataattattaccatcattgccattgttgatattttgataacatttgaaaggcactttgatgtttttcaaaacaatatgtattagttttcttccttaataatgaaaattatataacaaacaacaaaaaacaagccccaagcttcatagcacagagtatgcctgttggcattaaaaaataaagtcacggtatatatacagggttaaaaatccaaacagtaaagaaatatgtaaaatgtttattaggatttttttctggaaaagtaaattatgaatattcccaaatgcttgttccagatgtgttctgacaatggttgggcgcagattcccatttatgtcctcaatcagctcattttaagctcattcagcaggtgtataacaaaccaggggagactaaaactcccaggtccttttctcgtgatctgctactgagtcatagcccctgtctgccatattgggcttatgcagttgattttctcaacctaaatgcagaaatttccatgtccctgtgtaattcattaagcatgttttagcccaatgcccttctcaaggtacgtttacatcccaagtgtgagatcctgtctgttaactgtctttctcagttgagaaagcacagataactctgccacttggccatgctgagggctcatgaattacattattagtagaaatgagattttgaccacctcaggattcacttagaagcgtgttggaaagattcctgctcagaccaaacatctcccaccttccattttcagagtaatgtgttccgtctgtggaaccacagcttcatttgcatggaagtgatagggagccattctctacagcattgcaaactatggagactgtatacaagtctcagttgcagtactgaattgcacactctcctgctcagtataatttattagctggagatgtgcctacattaatagtatttgaccacattttaatttaactgtgctacaatgaattaaaccaaatagtaaagttacaatgtatgagtccatttttataccattagaagttaatattaacctataaagtgaattgtgtttaaaaaatgaacgatgttttatctaaccctgacatacatatctttcttgtgtataacagtcctatagggtaagttgagctaagcttttacttgtatctttttaaataaactatctttgttagaatggaaatctctaatgatcagatatgtataattgagttttcatatcttcattaagtttaaagatattaattaagcattatctatctatttattccctcttatgagatgttgatagagatcatttgggagcggacaatacttgttaaaactatgtgcagttttctaatgagcctttcaagaatgtgcgatttttttttccccacgaagttagtacccatgaattttgtgatttcttttcttaaggataaagacaagccaaatggttgtcttgcttttttaaggttgttttatataactagagattcttcttggcttcctttttaaatggattttttgataggaagaaaatgcaaatgaagtaacagtggagctcataaatttctagcctggtgactataatgcagggtattggctttgctatcaaacttccccaagcacatttgctttgtattagtgacttatgcaatattggatctttcgtctgtacattagactgtacaattcttcctttccgcctagcatgctttgcattccactctttagacagatgtgtgtgaatgtagcattctttctcagctgaagctaacaagtgtcagcatcagatttcccctatatattccaaatctgataaaaggataccctgtggttatgaaaattatagacacttaatacctaaggcaagtggcttgcagtctcagcagattcctaaatgatgatctgccccatggtgatgcaaaagtgatgttaacactttcctaggaagatcttcaatggggaatgttcctttggcaatttgaatgcatcactatacttttccagccttttttcttcacctcacctaattttatgagttgtatgcatatctaaaataaaatgtgcatttagaattggccacatgtggacacatgccatgatatctcagaagacagtaaaaacgaacttgaaaaccagaaaaatgcacaggtcatatagggatcacttataattgcccctgcttttcccatggcattttcagtcccatcattattccatctacagcgcatctccaaagcaaaatatattatgaaaaagtcatgtatggtatttcaaattaaacaataacattttctaggtgcagagcaactctcgtgatatggccagttagacttttcatcttggtcttgccctttagatatactttgtgatgctggtggccaggtggcaagcagagaaggaggggcattctagaggcggtactaaagacagctcaaagctctagaaagtgtttaagtcttttattagaccactatggctgcaacaaaaggctaacctggttcctgtcctttctagctaaataagcccaaccaatgtgtccacagggcaaccagtgatataagaggatgatctgatttttatggtattacttccatttctgagccaagcatagcaaatatatagtttaactgttgtcagtcttcttcccttgtatttatggaagttatcattaattttatattgtagtcttttctgctaaacccaggcattgcttcataatctttcacaagatagcgcatgagagagctattgctgctgggtcagagttgttacatgagttgcatcttatctggccatctatctctgggctgagttacggtcacatttccctctgatagatctctaatatagcaggtgtagagttaaaggtctttcactttttctgggaggtcaccctgacaatagaagaacctggatttcttatcctatgtatagtttatcaccacggttgctcggcatgctcttttctggtatccctagctcaaccctaactttggtcatcattgtttttcaggttttcaatcaccttaaagttgccactgttccaaaagtcatttggtgagccattctgactgtttccactttgagaatctcgtgccaggtcactagagataaatatgcttattctggaactcccagacattaatctcagggtcaattcatggttctgtgaatgcttgataccaccatcagcactgtgaggcctggaactttgccatgactgctacctcctttgggctcaaatattaaggagataggggcagatactgggcctttgattaatatttctcctctgacgtacatgacccctttatcctcttcacttccttgatgttcctgggtgttgacatagatgaagatgatggttttccctatcttaagtgaaaaacaattcatgtttcgctttgggtagactgaatggcctttaaggattacagttgaagatagttttatccaaaaggtctcaacgcaaatcttttcttatagattagtctattaaatgtgaggggcatctctaccagagattctggcagggatggcaactttggttttaaatttgttagtcaataaatatttgagtaactactgtgtgtgtggtgccatgataatcactggaaatagtagcagtagctgaaagagtgagagttctcatgtagcttccagttatggaagacgataagctaagctgagaattctgctcctttatggccccttactaggaaataaattcgtgtgatctaggaagcccctgtccttctgggtgatgagtggaattcatctacacagtcttaccagtcttacaaatgtctgtcctaaaagactagtaacccaccttacccatattccaaggaaccttgaggcccatatttattatacatggccattatttgtatccatgattatataaacacagatgaattggtcatttcccctgtctgtgttctctactcttaaataacttagttctcctcccttgtacagatatgtgtatttttaaatctagaaatgttagtagttatagaaaaagctactaactgttttcactcttcttcccttttatttatggaagttatcattaattattaattattaattaattagttaacattaattaatgagataatctacattatctcagtgaattttcacactaaccctgtggagttatggttttaatatccaggtattatggtttcagaaaacaaagttatgcaagctcagtgatctctcccaggctggccagctactaagcggtagatccagggctcccacccacgtggtctgattctagaacctgagctcttaaccgctgtaccgacttgtatcactagccaacatctgggctgctctctgctttatcaatgagtaaactgaagcccaggctcttaagtgacttgtcaagttaacagactattcagcaacagatttgaattttcgtattaatatagtgtaaataacaacagttaaatcatttatagtgcttattatatgccagccactcttctaagtgctttttatattggctcatttacttaataactactggttattgtccccatttcacttagaggcaaactgatgctttctgagaccaagttgcttagggtcacacagctgccaagctaagcagctaagattctaactcagcctgtctagtgccagactttgtgttcggatttggtgattctcaaagagaagaagctttcttctcccactccaggagcatgtgcaatgcctggagacatttttggttatcacaactttgggggaggggagacctttatataatctagtggacagaggccaggtatgctgctgaccatcctcaagtacacaagatagacccttacaataaataattatttgtcctcaagtgtcaacagtgttataaccacctttctatggttataacacaccatcagtggcatccagcaaaagatttccaaatcaggaaagcagagagtagcctccagtgtccatgcttagtttagtgtgtcttttatcatgactgcaattctgggctggaatgttactgtttagtatgtacctcataaggataaagactagcattgtgcccagcaagagccaatgggggctcattaattattacaatggaagcacaaattggtgtgtttagatataggatgaaagaatgggaactcagttggagaaaatcataaaagtagcactctgatgactagtggtgatgattttggcttcagtaaagagaagtggccacattgttattcaaaaacatgatattttggataggaagaaagctgatgtttcaggcgttttctttttgtttaaacaaacctattttgcagattttgtatgccttttatcagtcatgcagctcaattacagtctgggcagcaagtttggacaaaaataaaaagaggaataaaaatatttttatacctacattgtatatttctcacaagagtttccaagtataattatccatgaatttcatccaaaaatcttcaactgtgtgaatcttacatttggttacttactggctaatcaggattgggcctaaatccagtgtatacattacataaagaggtgaggacagataatccaagcaaaagaaatttccttataaaattcctaaaatagtatcatttcagtatgggaccgatataaaaattattaatgggatattttacattttttctttgctgtctttgaacttggtatgtatttcacacttccagcacatctcattttggaaaagctataacaatgtttctgagacttaccatatttgagaaccatttccttagtctgtgcttttaaggaatgaagttgttggacgcggtgtctttttacctttatttgttgtcatagatgatgatgactaaaagtgtcttgtccaaatacaaatgtgaaaaggctgaagaccaagatataaatgaaatagaaggctgttatctactaaatgggctttttaaaaaaaaaaaacacttgactttaagactactaataaaactgtaaaataagagcatacttttgaaataagaacacatcaaacaaagtaaaactaaagtttagctcctttgtgtcccaggctgaaataaaagcatgtgggaggacctaccaatttatattatcaaagttaaatggacacaggtcatctttagcatacaggataaggttttagcatgaggaacactttatataaaaatatactgttttttggttcatgtgaaagatattattggccaggtgcggtggcccacgcctgtaatcccagcactttgggaggctgaggcggatggatcacctgaggtcaggagttcgagaccagcctgggcaacatggtgaaaccccatctctactaaaatacaaaaatcagctgggtgtggtggcgagcacctataatcccagctacttgggaagctgaggcaggagaattggttgaaccttggggatgaaggttgcagtgagccaagatcgtgcgaattcactccagcctgtgcaacagagcaaaactccgtctcaaaaaaaataaataaaataaaaataaggaaacgtattattaaaataggaatgacttactttttgtctcaccctgcttctttgtgtctggtactacggtatgatatgtcatgcatcttactagaggaagatgctgcctttatatgtgaagtggattcttatgacctagaaccagaacaagtgtgttaggcttcattttccaagcctcataatgaaatgccttgaagtattcattttcctgtccaatcttctttaaaaacaatatttgcacccctaaccgtaggcagtaattttgtacttctcagaccattgcaccaagtttgatttctacatgaagtttactattgtttgtgtatatggaatggcttatgacaacttcatttgtcctctgctctatctatcctaggtactagaatacctagggtcctagcagtccaatatgcctggattatgccaaacataacacactactggagatatgtatttgatgaacattccgtattcttttttggccagcttggcaagcaggagaatccgcagttagctcttcctttgaccagttatttctaagtgttgttgcaggaagtggcgcattaggaactagtctttttggtttgttgtgcaactagcacttgtgtaactccctctacctgaaccattgcctctcccatcagccagggtagcttaaaggaatgttgaggaaataaaaagtaggcataaaggtattgtgcatagtagtggggatatagatggggaaacagagggaggaagaggagtgactaaagagaaagctacatgtagtcaagtgttgtttatcagactctggtgtggatcacaatcgcctggggacgaattaaaatgatacattattgggattttacattcttcccaaagaggctttgatttactgggtttcaggttggaacaaaatgcattttatcaaggactacagttgagacactctgctgtagaggaaaggcaaactctgccctagaggaaaatgaggtatcctaaattccattttctggttcttcttcaaggcagaaggccaggactgaggttattttgtggcaaccacatttattgaatctccttccctggcatgtagctcatctggaaatgactttcctgtggaggctttgataaccttataggctcttaatttggattctggaacaggttgggataagaagaaaaatttctttcttgtgtttctagaaatgtataaactatatactaagcacagagtttctgttgggaatgatgaaaaaggtctgaagatggatggtggtgatggttgcacagcagtgtgaatgtacttatgccactgtattgtacatttgaaaagtaaatggtatttatgtatattttactgctatattatatattctatgtatactacaataataactttattaactcactacaacttttgagattattttagtaatctgtgggcatgattcctgatgaggacttcagtgaggcagacaaccatgaagactaactaactgttcatcaatttagaaaaaataagtttttgcagttgatttctctcttttaaaacttttaaatttcagcaaagatctgaaaaatgtgagtgatgccttcttcggtctcttaaaaaataaaaataatgtccgggcgtggtggctcacgcctgtaatcccagcactttgggaggccgagatagacggattgcctgagctcaggagttcgtgaccagcctgggcaacacggtgaaaccccgtctctcctaaaatataaaaaattaaccgggtgtggcagcgtgcgcctgtagtcccagctactcaggaggctgaggcaggagaattgcttgaacccgggaggcagaggttgcagtgagccgagattgcgccacttcactccagcctaggcgacacagcgagactccatctcaaaaaaataaaaaattcaaataaaaaaataaaataaaaataattaggatagcaaagcaggtgttcaacttgaaacctctctgtgttttcttgaagcttgaaacctctcagtttctgccttggatcagatgatatctttgttggtccttttctgacatgaggtgctataggtctacagtttactgagataatttacataacattttgatatggaatattttacctaaaatggagtgtgcaattcataattggaaggtatagggaggagtgtttaattgacttgatgcattcatgtgtcatgctcaaggtcaaaagcctcaagtatgtgagtactttgtaactggctgtctgtcaaagataccagggaattcaatctattacatgcacttcactgcactaaaccaacactacatgaagccatcagaacataggatggcctcactaatctcgctgcaataattactgcaggtgtctcctgatcatttaaaacaggcatttatattaggatgcattattctgttcaaatattagggccattagaattttaagagaatttcactttgaatatttgatacaaaagatgaaatgcttgtcaaactaatatatcctgcacgttctcagcccctaaacctaagactgttttcttggtacgaaagtatgcatatgtgaaacaaaacgtaagtgtttgtcgctgctcttaacttgtatctttcaccaacatctacaggagttgtgtagaataataagattagaacccttcaaagctttaaaaaccaaatctgggatttcaaaataaaagaaattttcatgggagagaggggagggcagtaattttgtaaagtacatttttaaaaggactggaatgattcattctttcagcgtgtgattgtgagtttgctggtgtggcagaaagactcttgttgctatggtatccctggacaatgttttgggcattggctgtcatagctgtaactggtcattttaagggggtgtcatacatgcattttgactattgttttcatgatgaagctggattgttttgatatatattctatttcaaattaaattatttaatacaaaaccctcttaaaaatgagcataataagtgaacaaaatagctcttttatggtaatggtaattttttaataacaggaagtgttaactattttcattccaactgttatttaatcattgtagaaagtagagaaagtagagggtcctttgttcttttagcaagaccttaatcttcatttcttcgttaaattagtttttttctttctttctttctttctttctttttttttttttttttgcatttccagctgccaaagtgctgtcactgatctaattttagtattcacacatatggagtagatgccagtcttgccttatttaaaaaaagtcttccagtatcgctaatacatatttttcccattggatgatatgcaaaattatgggtttttttttttttttttgagaagagaaatcctggtcaggacctggcttcccaaaatacccaagggtatgaatattgatgagattcctaaattggtgcacttttgctaatacatttactttctgaattctaaatttagtttctagctagagtccccattagtcctttctatagtttggcctctcagtgcaaggactgggaaactgtaaatgttaattatatttgcccttggacagttattaactctacttcccaactatcttcaacatattttttggtaagtcacagcaaaattgagttacatgtgtgaaatgcatcttaacataatagcaagagaatggttttcattgtagaatagacatgagcctgtatctcagcctttctccttatgtttgtatgacaattgggaatttatttaatgtctctgagccactgttccctcaaatgcgaatagtaatatctgccttgtgatgattacataaaacaatatatgtaaaggtccaggtagaatgccctataaacagtagttatgcactaattaataacttattattatcagtaattaattaattaaaaatctcttagatataggtgtaaattacaacagaagataataatcttttaaaatcaagaccaaatgtgacagagacagacctgaacttggccttgcagtgtcctggtccctcctgagtgcagagactattcctgctaatgcgaattccacctttcttttgccattcatgcagcattcacacatcacctcatacttttcaaaagagtttgatgaagtgggtatctttatctatattttatagccgacaaacctgaagcccaaagagaacttcgtcattctataagtggggacaaagttatacccagacccaggctctcctgattcctagtttagtgatattttactcgaccatgctgctcctagtgaattgagtcccttctttgttaagaaaccagagcacaaagagtcctattcataagactgaatttgacatttaaatttttggacatttttggcattttaattttcttattaaatgtaattaaccaaaatagaaaaactaagaataaagaaataacaaacaattttaatgcaagatggtcccctctgaagaccatatagggtgttcatggaggattttcaggaatttcctcgagacccatgaaattgcgtgttccatgttgtatgctaccagtgtatttctagggcagtgggcatatcagattttgggtctgtgactgcttctctaaacatataacaagaaaagataccatcaagcatatgagataagcagattgttagaacaagatactaagttgtcattttaagggtatcatatattattacatttcagaaatgcagagtcttacggtaggctgttgtgtctgggatctacagagaagactacatcagtcagaatgtgttaggctgcagaatacctaccttaaataatattttatgctatattactattacagtttttaattggaggcctgtagattaggtagttctaggactatctcagaggttcattcatgtcagcagtgacctaggttaattttttttttctttcttctctatgcttctaagtatcttcgcctttagttctcatgcatctcaaggtatggtctcaaaatgccatcattctatcagaatcacatcagggttgaaagtaaggaaaaatgggggaaagggatgcaccattaggcttctcttattcctgacacttttataaagaagggaaagttttcccagaaatcctcttccatgtaagactttccttgtagctcattggtcattcctagctttaaggtgtcaaagtacataagcatctggcaaggagaaataagattgctataattggcctagtccagtcaaaatccgtcactgtggtcgagctcattgctacttagatgagaagtggtgttctgttgtctcagaaaaaggagaaactggtagttagctaaccactatctctctttactgtgataattttgcacaaaccaagatgaattgactaagtttcgctctttactagattgagaaatacgtttcattcctaaaatatccaaatgtactaagacataaccatttacttaattctttgcctcttaagtatggcaattatttctaatattctacttttaaagttgaagctattcagactaagaaaacagtgagagattcattaagtaagtaacaaagttaaacctgcaactgatcatttgattttctagcaggtgctcattctgtcccatgttaattctaacagaggtcatagctgaacatgatgccttatttcttctttaatctatatacagttttatggactttgagtcttttatagccctaaatttttagaataactcttaaaaggaaaaatgcgccagattttcagatgtaggtttctcatacaattagaggaatattctaacactgggtcaacttaaagcctcattttgggatttatcagaatatgcaatctgctgtttggagggaatggccattttgcaaccagtttttcacctagtttatagaagctagaggtacattgtgtcagtacaaaaacaggccttccattctcttgatccattgtttcatatatatgggtgatgggctcagtataaaaatctaatgtttgaatttctgacatgtgttattagaatctactccctaaggtcttagtgaaaaacgtaaataacttttcactgtctaatttaactcatctgaagtctgcttatgaattttgcaggaggaggcacaagactgtattagtgtttatatgtgagataaaattgttgactaaaaatcttttaaagaaatggttttttacattaatttgctaatataagtatataccatgggactgacattgcttttcaaggttctataacatttctttgatgactaggtatatgttgctttcttttttttttttggagacagggtctcgctctctcgcccaggctggagtgcagtggcagaatctcagctcactgcaacctctgcctcccaggttcaagcgaggttcaagcaattcttctgcctcagcatcctgagtagctgagattacaggcacatgccaccacgcctggctaattttttgtatttttagtagagacggggtttcaccgtgttagcccagtggtctcgatctcctgacctcatgattcacccatgttggcctcccaaagtgctgggattacgggtgtgagccaccgcgcctggccatgttgcttatttttataaaacagggttattggatagttttacgcttctcaacagtgtaatttttctattgataaaattgtacaacttactctttttttgcttccttatcgcatcttgagactcttgtgcattctggagcaaggttgtagatgtatctcttaacttcacatatagtctcatttctgctcctgtcttaatattgtgacctttttcccacagtcttgtctgccaccatgagaggccaacagacacttacacccccacaatgtatttctctctcatattcttttgaaagactctaatagtctctaacccataagaacgaatgttacttcttacccacttgagatagtgataaaattagacctggcctgcctctcgttttaggaatatagcatacttagagttatgcctgtttgcacagcctctgaagctgaactgaggaaagtttaataaatccaatggtcaatcaatagacaactatgtttgagacgtctggtatatgtaaggtttgggactggatgcttcgagagatgaaaaaaggacaaaatacagcctttacccttaagatgctgtcacatttccaagggaaaagatggcacatgttcatgaaaaattaactgttacataagactctgtatacattattggttgaattaattttgttgaatgaatacagctccagtaagaacacctataggaattcataggagggaccaatcattgtgagtcaaagaaactaaaaaaatcacagcacatttgatttggaagaggttatcgagttccccatcacccagatatgtaaagagacttctcaaactaagtcccagagagtgactgtgattttcaaagagctacaagcttttattgacagaaccagtatttatttggagagactgatagacttgatttattcaggaaggaatggagaaaaatcctaggtggaaaagaatatgtttatttgacagatgtatttggaaaaaaataagcatttatctatggaaaggagagagttaaaaaatatggttaagggctagccttctgcttcttgccttttattttccctaaaatgatagcatgttctagaactaatggaataattttttttccttagaagtgagtggcatctgtgttttctctttttaatggggaaaaattattatttcccttccgaaatagttaattcaaggaatagtgcccttttaatcttatgattgtcctccataaatgttaaacttgtaaatcatctggctttgttgaattggaggccatctgtccctccagaggtgcattggttcacagtattccaaaatgaggtgatcatggcatgtgccaacgggaaattaaaaaagctctcctctaaatgttctaagcatcaggttatggtgtcaaaatcatttgccaatgaacttttcattaaccttgcctgaatcttgtattagaatcatgggtcttagcttctgagcacatttataaatgccttattttcgtcaaagctgtatacaatacacattgtaaaacctagataaaatgctcagatgtggcacaaaatgtgatctgagtaattttgacatcaagaatcccatagatgtgaagtatttctcaagctacctagaattgtaaacaagagaaggactcttgagtttaaaaatgttctccccgaaaccccatctctactaaaaatacaaaattagccgggggtggtggtgcacgcctgtaatcccagctactcagaaggctgaggcaggagaattgcaacaagagcgaaattccatctcaaaaaaaaaaaaaaaaaagttctccccagctctccacctgataaatcaaagacaagtgcttttcttttgttgttgttgttgttgtttgttcattcatttgtttttgagacagagtcttgttctgccacccaggctgtagtgcaatggccccatcttggctcactgcaacttccacctcccgggttcaagcgattgtcctccttcagcttcccgagtaactggattacatgcatgcatcactgcacccagctaagttttgtatttttagtagatatgggttttgtcaagttggccaggctggtctcaaatttctggcctcatgtgatccacctgcctcggcgtcccaaagtgctgggattactggcatgagtcactgcacctggcctcaaggacaaattttacttacatggtaagcaagattattttggaaatgatagaatgcaataaaggtgatagataaccttagagaaaaagttgaaaaaggaaagaggcagaggcaatgtagggccttgacaatagaagcaataaataaactagaaatgaatccttaagcaggctccattgcagaagaaatgcaagatttctcccagaaaaacatttgacattagattcctctaattccaacataaggaagaagttgtagagagaaccatagaattttataggtgaactaaaagtataagattgtctatttttattctttcagcttctcctgatttttcttgtaatgtgtgcatgaggggtaggagtgtggtgagtcaataagtgattaaattgaattgaaagactagcatagtcggcagggcgtggtggctcatgcctgtaatcccagtactttgggaggccgaagcaggtggatcacctgaggtcaggagtttgagaccagcctggccaacctggtgaaattccatctctactaaacaaaaaattagctgggcgtggtggtggacacctgtaatcccaggtactcaggaggctgaggcaggagaatcgcttgaacccaaaaggtggaggttgcagtgagccaaaatcgtgccactgtgctccagcctgggcaacaagagcaaaactccatctcaaaaaaaaaaaaaaaaaaaaacacctgccagcattactctcctgctgtactacgatagcatcttcactagtctccctgtctctaactggcttcctcaattccacctggactctacctcactccttgccactttccttcttctctactattccataccttttatactagccattgtaaagttaatttatttgccccaaagcagtgtactccaataatgtagctgctagccacctgtgtctgtttacatttaaattaattaaaatcagataaaattaaaatttcagttcgtaaattatactacccttatttcagattctcaatggccacttgtagctgatggttaacatattgaattgcaccaattttagaacatacctatcaacatgcctgtcattgcagaaagttcagctgggcagtgatgcttcaaagattagtggtctcccttgcattcttctcataagccagaaagttactggggtaacagtatacaacatttgccggccaggcgcggtggctcatgactgtaatcccagcactttgggaggccgaggtgggcggatcacttgaggtctggagttccagagcagcctgaccaatacggagaaaccctgtctctactaaaaatacaaaattagccaggtgtggtggtgcatgcctgtaatctcagctactcgggaggctgaggcaggagaatcacttgaactcgggggaggcgaaggttgtggtgagccaagatcacgccactgcactccagcctgggcgacaaaagcaaaactcggtctcaaaaaaaaaaaaaatattgccaagtcttcctcatttcccttctggtttcatatgctaaggttccttctgggactgtctgccggggtgtcatctcctttttcttgccacctcactagcctgccttaactttgtttagataccctttctatgctgttctttttacatagggcttcccttagcacagcatttcatcacatatatcgtaattgtttggtttttagtctctaccctccaccaaactctaaagcagtatttcttgctcttgctcttgctcacgttcatgcttggggcatgcagcttaatgcctagcacttcttgaacactcaataaacttttgattaattagtgaattacttaaaatgtttattcagaataaacaggcacacctaatagaattaatgcatttataatttatatgaacttaagccttttaaaacatttcgctttcattataaaactagaaattaatttcttcagacattgcccttaagaaaattactctaaggaatgtgtaagttatgtaaaatatatttaaccctaaaccacacaatgatgatgaaggtggtggttgtagtagtaataatgataataggaaatgtaaggaaaaataaggcagtctcacaccctattaagaaggaaacaacatttagaataagcctactttgtgtcaagccatgttagaaacccattatttaatataattagtacaaatcaactgttttcttttttctatgttgcctccaacccttgagtacatgaatgcataattttccacttgaatccatatctcaggtagtttatatttgtagttttagaattaatatttcattgtaggtatccaacatagtataattatttttaatgactgcatgatattctttctgtgaagacagtatcatttacttagaaactctctgattaccttttagacagctaaattgtttttaatctttcatattttaaatagcaatgcattcaatattttcatgtaaacagtttttcttaatgagaaggaggtattttaccttaagctgaattgctttggtttaaaaatatgtgagtttattgaaacattttgccaaatatttcttcatactgttgtaggcattgtcatcattttaaattctttgttaatttgacaggtacgaaatggacaaaaaggattttaaagttgtatctggggtgggaaatatgtctcaaaacacttggagataactgctatcatgttgaggaagaagtccgttcaaagaagaaaaggatgccatttgttttacttagttctttaaactaaagcactaacctcttttacaccaaagttaatatcccctttataaactctgagttcttaggtgttcttactcaagagggtaaggatatgacattagtgtcacatcactctatgtggagtaggatccagtgagcttaggaacccagaagaaacatgtattcacagcttggctttgatagaagcaatagactgattttcatttgctctaagggtgttttacaatatgtttcatttcaaaatgtaacaaatgatagtgcacagatgtttaaatcttcctgtatacattcccttctgccaatctcccatgtcagttcctttttattgatgcttatttttgtttgactgtttaattgccatgatttaagctattggtggttcaggatgcacttgcctgccctatattaacaacagtaatgcaaaaataacaacaataataataatgcctgtttattgagttttctcaaagatgagaaaactgagtcacagatgaagtaacttgtccaaaattgcactgctattcaaacataggcagtctagtctgaatttccagctcttaactcatatgctctacacagtggatcagggttcttttgtttagtatttcaggtagttataggtgaaattctgaaatactgtctgcaaaatgtataaaaggtgttcttgaggactggtttgtagttgtagtttgggaatacttgccaaatgctcacaaaatctgggtttgaaaagcatatggtctgagaagcagtctaaattcactccaaataagtcacaaaaaattaatatccctttttgttcatgactggtgggccagaggactcctttagggtgggactgctggccttcagcaagatatgcagcagcaactttaatggtatccttgtggaaattgtggatgacaatgagtagttcaggtgattttgtgggcttgcactttctgatgaaaccagaggcagagtaggttaagtacatggaagtggagtgagccaatgtcagttaagattttggcgtttccactgcaggatcttgagtacatttttgtttctctaaaagtttcacattcttcctctctgctctagggatgctaatgtgcagcattcaccacctgatagctgtaaacataaaaatggggtcatgtatgtactatgtttgcatggcacatccatacaatgttatactgttcagcaataaaaggaacaaagcactgctacctcttacggcaagagtgaactcagaaacattttgctaagtcaatgaaaccagatgcgttgtatgattccatttatatatgtccaggaaaggccaatatagagagacaggaagtagaatagtagttgcctgggactatagatgtgcgtggaggattgactgcagagggtcctgagggatctccttggggtaatagaaatattctaaaattggattgtgattatgattgtgctattctttaaatattctaaaaactccttgaattatacacttataacaggtgaatttttatactctgtaaagtataccttagcaaacataaaaaaagtagtcaataattgttggtatcattttattttttattattagtctttattgttcatataactgagagattctggggatgtgctataggaccctgtatttgaacttcatcaggattttagctactttttggatgacaacatgctttcacatttgagaatgacacagctggaagggataactaatggcttagaacccctaaccaagattggaattgttttgacagcctaaaaagctggttgaagcccataagatgaaattgaacaaaaataaatgtaaaatctggcacaggctgggttcctcaggcaagcaaaagaggtttaagcagctggcttctaaagtagctcttgttcttataagaaatgtttgtgcctctcagaaagggagtggcagaaaacctgggacaggattcaggccaaaactgaaggctccaactataaatgacatctgaggtttttgttagatgctggaagagttacttagttggacattccatgttttatgttcatatactaataatagtaattattattatatttataatgataaaactccatgcttcccatgacataagctctgtggtaaatgctttatatacattatctcattcaacaattataacaaccttacaaacagaatatttttatcctatttacatatgcagaactgagtcttagtgagcctttagtcaaacagctagtgaatggcagcccagttagaaagcacctagtcaggattgagggcccatattttcaactcttaagctctatcttctacccttagaatttcttattcacagaatatagttcttgaaatctagcaaagtgaaaattcaaaagcaaagaagtacatagtctatgcattttgcggggagaacacagatgattttaccaataccaagattggtttattttcgctctaatcctttgggagggactaatttccatcactgagttctaaactgctacgtctaatgagctgtgcgaaaatgctgaggtattgcaggctgtggccattcaagcaagaaggcagtaagctcagtaggaacagctgcttaataaaaggctattagtaggccagaaaacaaacaggagattttgctgaaacatataatctatttttaaattactttgaaatagtcacttgggcattgatacagaggaggattatcaacagtcggatggtttatagaaaataccttgaaatagacttttagatatttcctattttatcttcaataatctaaggagggggaaagggcagtcaccatgtatttatgaaaaataaaatagatgatgcgttgacttgaaaccttttcattttaaagaaggaaaatgcattctacaaagtcagaaaagtacatttttgatgttttcttatttcagagtgtcgcataatgcatatctttgtctgagatgtgctatagatccaaggatcgagggctagaagtctaccttctggctcttttatagtgtgtatgaataccatagaaatgctctttaattactttttaaaataataaatgaaatatgtgagttccgtgatacatagttgtcttttctttatctgtttgttttttttttttatttccaacttttattttaagttcagaggtacatgtgtgggatgtgtaggtttgttacataggtaaacatgtgccatgatggtttactgcacagatcatctcattacccagatactaagcccggcatcagttagctattcttcctgatcctctccctccgcccacacccgtccctctgacaggctccagtttgtgttgttccccaccatgtgtccctttgttctcatcatttagctcccacttataagtgagaacatgcactatttggttttctgttcctgcgttagtttgctaaggataatggtctccagctccatccatgtccctgcaaaggacatgatctcattcttttttatggctgaatagtattccatggtgtatatataccacattttctttctctagtctgtcactgatggacatttaggttgattccatgtccttgctattgtgaatagtgctgcaatgaacatatttagccctaattatattatatttatactttaatttttactatataatatcttgatcacagctttggcaaaaggctttttttccttttcacaccaatgagagaagcttatcttaactgcatattctcttatttaagctttttccttttcccagcaggactttcatctttgctcattctttccatctttctgtcactttggcacagtctatgactagaaagcatcaaccatttcaataatatttgttttgtttctccctttaaatatcaaaaaacctatataggtttgcttttttaagagaaaaaaataataactttatctgttgttaccatttctatagccttttatctttttgacccaggaaacaagttacttgtaaaccttttttcacttaactaaacaaatgaacatttttaaaatttaaatttagctcctactgtgagaaaaccttttaaatggcttattttcaaggcataagtctaagccctggcagccagcctgcgaatgtaacaaaccacacaactcatgcgccttgaaggtcaccataagtgaacagaatgtagaggaagggtcagcccataaaagggaagaaagtttcgttattgggaaattgaaacttaagcggggaagggaaccagggtataaccttataagggggataatgaaacttacgcgatgcccgggaagattgtaaccccatagtactcaaccagtgaggaactgggggagggacttgcatgctaggagataaattacctgctgtagcttccctgggtgtgcctgtctatcagacaccagatcttgcaatactgccattaaaagtcttgcttccgctgttcttcatggctctgagtccattctttggatttggacgggtgagcgtgtttctcacactaccaaaattagacaaacacattacaagaaaataaaactacaaacagaaatttctcatgaatgtagaagcaaaatcctctacaaaatcttagcaaattgaatcaataatgtataaaaataattatacaccaccaccaccaagtgggattcacatcaggtatccaagggtggttcaacattcaaatatcaattaatgtaattcatcacatcagtaggctaaagaagaaaaattagacagttatatcactagatgcagaaaagcatttgacagattcaacactcattcatgataagaactctctgcaaactaagaatagagaagcgcttcctcaactttgataaagaatatctaaaaaaaaccctacagttaacatcatacttaatggtgagaatctcaaagttttcctaccaggatcagaaacaaagcaaggataacttctaccactgcttttcagcatcatactagatgtttttagctaatgcaacaagacaagaaaaagtaaaagtatacagattggaaaggaagaaattaaactgccttttcttgtagatgacatgactacctatgtagaaaattccagaaaatcaacataaaatctcctggatgtaataaataattgtaaccgagatgcaggatatcattgttaacatagaccagtaaatgactgactttcctgtatatcaacaatgaccaactggaacttgaaaataaaaacataataccatttatgttagcacgccaaaaatgatatactttgatataaatttcacaaaatatgtacgaggtctatgtgaagaaaactagaaaactctgataaaagaactaaataagtggaaatatatttcatgtttatacataggaagactccatattgtgaggaggtcagtttttcccaacttgatctatagattcgatgcagtcccaatcaaaatcccagaaaggtattttgtggatatgtacttattgagtctaaagtttatatgatccaaaatagccaattcagtatggaaggagaagaacaaagtagtcaattgaatgactctactcaacttcaagaaatgctgtatagctacagaaatcaagacagtgtggtattgttgaaagaacagacaaatagatcagaacagagagcccagaaatatatccacatcaatatagttagctaatctttgacaaaggagtaaaggcaataaaatgaagaaaagatagtttttttaattctttctttctttcttttctttttcttttctttctttctttctttctttctttctctctttctctctttctctctttctctctttctttctttctttctctctttctctctttctccctctttctttctctctttctttctttgtttttttgaaacagagtctcgctctgtcacccaggctggagtgcagtggggcgatcttggctcactgcaacctccacctcccaggttcaaatgattttcctacctcagcctcctgagcagctaggattacaggtgcacgccaccatgtccagctaatttttgtatttttagtagagatgtggtttcaccatgtttgccagactgatctcaaacttctgacctcaagtgatccacccgcctcgacctcccaaagtgctgggattacaggtgtgagccactgtgcccagccaagatagtcttttcaataaatggtcctggaacaactgaacatcaacatgtaagacaaaaacaaatcaaaaaaagaatctagtcactgacttaaaccccgcgcaaaaaaattaacccaaaatggatcaaagaccgacatgtaaaatttaaaactgtaaaacctcttgaagataacaaggagaaaatctatgatatggtttggctgtatccctacccaaatctcatcttgaattgtaatcacataatccctatgtgttgtgggggggaccttgtgggaggtaattaaatcatgggggtggttctcctatgctgttctcatgttagtgagttctcaaaagatctgatggttttataagcaactggcatttcccctagagagaatgctagcactcattctctctcctgccgccctgtgaagaggggcctccatgcctcatgccatgattgtaagtttcatgagatctcccctgccatgtggaactgtgagtcaattaaacttcttttctttataaaatactcagtctctgcatagcagtgtgagaacagactaatacagtaaattggtactgcagagagtggggtgctgctataaagatagacgaaaatgtgaaagcgattttgtaagtgggtaacagaggttgaaacagtttggagggctcagaagacaggaagatacgagaaaatttggaacttcctagagacttgttgaatggttttgaccaaaatgctgatagtgatatggacaatgaagtccagtctgaggtcatctcagatggagatgaagaacttcttgggaactggagcagaggtgacttgctatgatttagcaaagagactggcagcattttgcccctgccctagagatctgtggaactttgaactttagagagctgatttagggtacctgacagaagcaatttctaagtaacaaagggttcaagagaaagcagatcataaaagtttggaaaatttgcagcctgatgatgtgatagaaaaaaaaaaaccattttctggggagaaattcaagccagctgcagaaaattccataagtaataaggagctgaatatatcaccatgacaatggggaaactgtccccagggtatgtcacagaccttcaggacaggccctcccatgacaggcccagaggcctagaagggaaatatggtttccttgaatgggcccagggaacccctgctttatgcagcttagggacatggtgccctgcatcccagccactccggccgtggctaaaaggggccaaggtacacacagggcatggcttcagagggtgcaagcctcaagcctaggcagcttccacatggtgttggtcctctgtatacacagaagtcaagaattgaggtttgagaacctccacttagatttcagagggtatatggaaatgcctggatgttcaggcaaaagtttgctgcagggacaaagccctcatggagaacctttgctagggtagtgtgaaagggaaatgtggggttggaggccccacactgagtccccactgtggcactgcctagtggagctatgagaagaaggccaccatcctccagaccccagaatggtagatccacctacagcttgtactgtgcacctggaaaagccacagacactcaatgccagcctgtgaaagcagccaggaggggtgctataccctgcaaagccataggggtagagctgcccaaggctgtgggagcccacctgttgcatcagtttgacctggatgtgagacatgggagttaaaggagatcattttggagctttaaggtttactgactgtcctattacattttagacttgcctggggcctgcagccgctttgttttggccaatgtcttccatttggaatgggcgtatttacccaatatctgtacccccattgtatctaggaagtaactaacttgctttcgattttaccacctcataggcagaagggacttgtcttctctcagatgacattttggacttggatttttgggttaatgctggaatgagctaagactaggggctattggaaaggtatgattgtgttttgaaacaagatttgggaggggtcaggggcagaatgatatggttttgctgtgtttccacccaaacttcatcttgagttgtaatcccataattcccatgtgttgtggaagggaccccttgggaggtaattgattcatgggggccatttccccaatgctgttctcatgatagtgagtgagttctcatgagatctgatggttttataagtggcatttcccctgctggcatgcattttctctcctgccaccctgtgaagaggtgccttctaccatgattgtaagtttcctgaggcctccccaaccatgtggaactgtaagtcaattaaactttttttctttataaaatacccagtctcaggtatttcttcatagcagcgtgagaacagactaatactgtctagatgactttggatttggctatgatattttggatatgacatcaaaggcaagatctatgaaagaaagaattgataggctggacattattaaaattaaaaatattttatctgcaaaaagatactgtcaagagaatgaaaagaacaaccacaaactgggagaaaacattggcaaagacatacctgataaaggactgttagcaaaatctacaaagaactttcttaaaactcaacaatcaggaaacaaacaacaaattttaaaaatctgttacattaacagatattttattgaaaaaaatacacagacagcaaataattatatgaaaagatgctacacaccatatgtcatcagagaaatgaaaataactatgagatactactacatgcttattagaacaataagccaatcttggaacacagacaacctgctaacctgataagacagtaagtccaattctattgctagacaacattgctcaatgtaaaaataactcatggtttgttaattgcatcggcatgaagaggaactgcaaatggcctatgaatactagattgtgatgtgatgctttgggcttccctggcatgcagtgactcttataactgtgtattccatgtgaggaccctggaagcaatttatatggaattgctaaaggaaatactggctcctataggggatgaggcttgtaaaccagggtgacttcagcacaggaccaatgtgactcttgtctccttgtatctgaactgtcacccagaaggctgtgtcaacggctacaaggacatccacagtgaggaactgctgctatcctgctgacatgctgtgctcttgaactgtatttttctgtgtatcctgagcctattgagaggtgacagcgtgctggcagccctcacagcccttgctcgctctccgcacctcctcagcctctgcgcccactctggccatgctcgaggagcccttcagcctgccactgtgctgtgggggcccctctctgggctggccgaggctgagccagctccctctgcttgcgggaaggtgtgcgagaggcacgggcgggagccagggctgcaccctgcgctcaccggccagcgcgagttccaggtggccgtgggctcggcggcccgcactcagagcagcgggctggtgccactggccccgggcagtgagtggcttagcaccctggccagcagctgcagagggtgcgccgggtcccccagcagtgccggccggccagtgctgcgctcgaattcccgccaggcctcagctgcctccccgtggggcagggcttgggacctgcagcctgccatgcagagcctctccccctgtggctgtgggctccagcgcggccggagcctccgcagacagcacctccccctgctccgcggtgcccggtcccatcgactgcccaagggctgaggagggcgggcacgcggtggcacgggactggtggccaactccgcctgtggccccagtgcaggatccactaggtgaagccagctgggctcctgagtctagtggggacttggagaacctttatgtctagctaagggattgtaaatacaccaagcagcactctgtgtctagctcaaggtttgtaaatgcaccaattagcattctgtatctagctgatctggtggggacttggagaatctttttgtctagcttagggattgtaaatacacccatcggcactctgtgtctagttcaaggtttgtaaatgcaccaatcagcactctgtatctaggtaatctgggggggacttggagaatctttgtctagctaagggattgtaaatacaccaatcagcactctctgtctagctcaaggtttgtaaacacaccaatcagcatcctgtgtgtagctcaaggtttgtaaatgcaccaatcagtgctctgtgtctagctaatctagtgggtacttggagaacttttgtgtctagctcagggattataaacgcaccagtcagcaccctgtcaaaacggatcgatcagctctctgtaaaatggaccaatcagcaggaagtgggtggggccagataagggaataaaagcaggctgcctgagccagcagtggcaacccgcgcaggtgcccttccacactgtggaagctttgttctttcgctctttgcaataaatcttgctgctgctcactctttgggtccacactgcctttgagctgtaacattcatctcgaaggtctgcagcttctctcctgaggccagccagaccacgaacccactgggaggaacaacaactccagacaccctaccttaagagctgtaacactcactgcgaaggtctgcagtttcactcctgaagcccgcgagatcaggaacccaccagaaggaagaaactcggaacacagctgaacatcaggagggacaaaccctggacacaccagctttaagaactgtaacactcacccaccgtaagggtccgcggcttcattctggaagtcagtgagaccaagaacccaccaattccagatacactatgatagtcttatgtttagctgaatcaagaggaacttctagaaggtagtaaacatctgactagaacattatgatcaaaatagtgaaatgtttggatttttgaatgattttaatatgatagtgaaaaacagttgttcactaaagaccagataatttaacttgattcttatagaaaaatataatatttattgaagtctactgtgttaccccccggattcatagctggatacatttttaaaaaaattataagacactaaaaacccaacttaaaaatgaaaatttatacctgacaagtatttgttttgtcagaataccagcttggctgagtatttttgttactgtctccataaattttatatattttctgaataacatttatttgggtacaactgtaaaggaatggattagccttcatgtttgataattggagaatattgggtagattggtcatgttaccagaatgggcaaaaatggaccatttagagtgttgaatttaaagttagggtcctagttttctccaaactgttttttattaacttcaagattatataaaacaacatatttatgttatcttatgtatttgtgttcttttttaaaaaaaataagttaggcgatcctttctttatataaatcacatagaaatttatagcctagttgaaatgggccaccaaattcctgctaccttctccccactttttttctcatctagcagcttttgaggcatcactagggatccacaaagggcagtttgtaagaacactgctaaacataattattgtggtttcacacggtgtattttgccattggtagccaatttgttggtaaaattactaatgtaaaaataatttttagtgtatataaacatatcatttctgaccttgattcttttctctgcttatgtataagcatgcttatctttactgcaatatatttgctcttacaactattaccaattcgtagtatggagggttattgtttaaacttaatttaagaaagtaacaagaaggaaagccaccttttgtccagcaaccaaacttcccttccctccctttctaccatccaaccaatttaccagccaagcatttatccttccatccaccccacaacaattatttgttgccaggggatttagagataaatacataatcgttgccttcaaaaagccctagtcaattatattccttaggatactaccagcatttccaaatactctttagcacagattatttccttcaaattaaaataaaatgtgtgcatgactctttttttgtttgttttgttttgttttgtatgagagattgtgacttcaagaaagtttaaaagcctttggctagatactacattgatattgatctctttcttcttatacctttgtaatttttgaaatacatgagaaactgtcgtttacgctttcctttcattttccaatctcctattgtatttggcacatagagttgaaaggaaacaatattagcatttagtagcaaattaattttcgcagtaacaaatgacatgtaccaataagttatatttgttcatgaaaatacatttagagagttatattatgacttggtgaattttaagaccgaaaataaagagccaacttagcaaacctgtggctgatcaacacagattaagacacttctagtttctccctctttccattggtgtgtaccttaccaatcaacaccctcaaagcaattaaactatatatagttatccctaatacacatttacttccttgggcattagccagaatgcacattttatgatcacttatccttcaaatacaactactggtaattatctaagatgtttagatgcagaggtttgacaattagcaatcaaagttcatgtttgctaggaaaatgtacagcaagtcctcaaataacatccttttgctcaatgtcatttccttataagtttgaggggaaaaaatccattcctagctggagccattgtctgtatggagttcacacattctccccatgtcttgggttgtctctgggtactccagtttcctcccacatcccaaatatgtgtatgtttggtaaattggtgtgtctacattgttccagtgtgagtgagtgttggggggtgtgtgtgccctgtgtgagatgtcctcctctccagggttggttcctgctggtgccctgagctactgggataggctccagccacctgtgaccctgaactggaggaactgggtaaatcatttgttttgattaatctttcttaaatgtaagtatagcttacattcatctcaatgtttaatattaaatcttgtttatataaattagcctatgataaaattggtttttatatgtcatttcacttaaagtcagtttccaaggacctatcaacaacatgaaaagaggacttactgtgaacacatctgaactttcaaagcttgtgtagtagcattcaacggaaatgcataaacttctctatgcattagtacattaacattccctttaattgaaatgaatgcttacaagtgtgaaaagcaactaatgtagtgttatttaaattgaatgtaggctccatttttaataatagatagtctagaatcatagataaaaaggaatgataaataatacaatagagtccaaatcattcatctctgcatcactctacagaaacatgctgctttccatcagatattttttctggcatcaaacctctgtttttgcaaattacttttttttctgtgagtttttaatgttgaaatattttccacattagcatgtattgactcagtttactttttggtgcactattgaaatcactcaattgaacgggaacttatgccagtcctgagaggataagaaacttgttgaaaattatttttgccctctcaacaaaagacattagatttttaagtatcctagaattatcatgttatgtctaatagcagtcatcatagtgattaaggcttcccaggcctcaccaagatttgggtaacaaatgaagcaatgtagtagcttcgttcacccattttacttatttgaatgaaactggagaaaggctgggctaaaggaaagaagccctcactcccacacttaccctcttttttctcattcccttatgctatatttgtcttctttgccatattaaaccagaagcctcagccaaaatgaagagaaacacagaaggtatttcttagtttccaaagtacaatgttctgaggaattaagagagtttgaagagtaacttcctatgttcaatttggggagagttatgtagtaattttataacctccccactccaaaataatgctagtcataccagtatctgtcactcatagaaatgccttttctgcatgttaagtttaaaaaatgtttctatagggtgtgatgcttctgcttagaataagccacatatttagctgtgtgaaaagatgatggaatttagtctttttcttcttcccttcctttctttctactttcctcccttccaacattctctgttttattcaatttctctaaagaatgctggggagagcccagcctatcttgcctatttgacctttactctgaaaaggatgtatgtatgtctcgtataaaacatacagtctattctgccattttatatttttctacaaccactaataaccaaattgtaaataggggaatgtgaaagtcatatgaagtcatatattatcctatacagaggtttctgaaatagcaggattagaattattatctctaccaggaaaggaaaaaaaaaaaaacctctcaagtaacagccatatagacaagagaattttcaagtctgcttacaaaaaggaaaaaagaaaacaagcaaacaagcaaacgtgaacatctgcaccaggggcttttccccttgaaaggcacacgctcatctgagcatggctttctgccggtgtaggctgcactttctcaaagcctactgctttctgcaagaaactgtcacgcccactctcatggttttgtgtactttgaagtaccacctagttagtctccaactatgctcagctgcctacctaggttatccaagataatttcttagggggcactaataattgtctttggtaatgttcttgttatggagctgtaagagtttttagtggcctaccaaaaatttgtttttcctcataagccatattttggggatataattttacaaagagtaaagttgttcaaaaatgcatgtctccgggtatggtggaaatgcctattttatcctcctttatgctaatgcagaactcttttacagttttatatttgtgcactaagcaacattttgcaaacatggaaaatagcttgaacactggaatatatgttgcattataagtaattttgtctactttgtatgtattattaaatttatcttataggaaaaatctcaccctgaaatatggtcatgaattaaaggcaatcaactttcaaatcacgcccaccctttattttctcattcccgtatgctatacttctcttccttgctggatgaaatgagaaacttcagctgaaatgaaaagaaacacagaaattatttcttagtttccaaagtactatgtttagcgaccaagatgctgttattcaggcctcccagttgacagaatgacctagatctagagatcaagataccaccttctttagtgtatacaaatttccaaataaagaaagaataggggggaaaaatcagtctttccaggagggtagaatcttctacatgaaagcaacaaatatacttcttcagagcctaaatcaatctggaaaaccaatagaacaagacatttaaaagtgtatattgtgcctaatatatctcttttctcctccatatcacccagcacatagtacgtactcagaaatgtctgtaggaaacagcttattgtgaacaaattcacccccaaatgtatgaatttatgattatcaatagaaataaagatagttgtaagaattgaagaactgaattacacaagagtaatagattgaaaatttttatatgagcacagtctccttaccagatgccttacgctctaatgggtcaacaattgacatgaaaagaaaaaatacacgtgtatagatagatatatgtgtatgataaaatgtcaactgctattgaatctaaattttgggtgtattggtgattattatacttaaaaaatatttttctgaacgtgtaagcactttcacaagaaactaggagaagaagtattgttgcataataagagatgtctaataaaagagatattactgtgaaatcttttataggccctcacaggctgcaaaaatcattttcaaacttgtattatttagtttcaactatcctatccaacctgtattttcgtgtgtagttcaaatctctttaattatagttttcatatttatggcctttgatattcagtatggtagaaatgcccttaaagacatatatagtctcctaatttaaatccttcagtaaaactagaaatcgacattttctcgaatcttccgtcaaggagcagactgcctgccgtggttttattgcagtctggtgctttacaccactttcttctctgtgattatttgtgagtcattttgtaagtttttactttgtttcataaatctatactgtaaactttttaggcaatgattatcttaagtctttgtttttttttagttacctgtgaatcagaaaatgagggaatttagactatatcacattgttttgattttgatttatttaaaaaaaatctatgcacctttctgcatttattcaataataactcgaaataataataataacttgaaatctccctgaaggcaggaaatgttgcctcctgcgtttctagcacagtggcttttatacaatggctgcttagtaaatactgttgaattttgatgtaaaaggtggcacatgtaccttgcagatattttgtactcttttattatagcgcctgttttatagcatttgtgagcccttccttctaaacgtgtcccaaatttcagagagattggagtttgcgatagtgggtcagatttttgggcttagtcctgcaggcttatcatggatctggggcagtaatctaaagacattggaactgagatgtcatacccggttgacaactggggctctaattcaggtctgcgaggcctcattctctcattgacagaacgagagagcagattctacttttaggtatattgttttggagatccaagagctgggagcagccatttcttctcatcttccttttccatatttacagatacgtaggtgaccatgttatctgtaatagatattttttactctttgttgaaataattgggaagaaaattcttagttgtttggcttattatcaaattttcttagttttttatttaatctatttttatgacactttggatccttctgtttaagagactgcaataaatgaaggagaggaatgaagcaaataaacttggattagctgtctttgttgatatcgtttaggaagaaccgcatgccagtaccctaattaacaaatacatggtgtgatagtttatagttcaaacagtattgtctaaagtcgttttaatctatcaggtttttataggaagataccacaaagacttgatggtacagttacacagatttaattctatgaacataaaaaaattgattttcctgggggcattaagaactgtttttattgattgaatattttacttgcataaatggtagttcttaaaaacagctgcacattttactgttagtatctgaaagttcttaaattgtaggcgtaaatgtttcattttaattgtgcatttccatccttcaacccaagtaacaagaagataatatagagagtgtgtcatactttttctgggtacaaagatgataaagttgctgtccatactctcaaaataacttctttcttattccttttgtttctacctgctctaagataattgactcaatgggactaccctaatactcttgcagaatctaaactagattatactggacattggaagagtttacgtatcagaaaatgccattcctccggacataaggtagtgagataatattttagcttcttcaggaaaactttcctgaaacctcaaagctgaaggatgtcttggaagcattcgcatttctggcctccctcattttacagggctggagatgcaaaccacacacggatctagttggtgtcttctcatgaactagaaatcttatttttagaatattcttccagtgatttctgccactatagttttattgttggtttgagcagttagtattgaggattcattttggaaggaactgctagctgccaaccaatatcctttatttctttgtactttaataatagaacaccaattttattttgggcaaccatgtgcccagataaaatactgtaattgctaacacattcacaactaatacggtcatgtggctaaattttgtccactaaccagaactattatggggagacttcagagatgtttctggggaaatgattcggctgggaattgtgctgtcatcctcttgttccttctttttgctgcctggaatacagacttgatgactggagctttagtggctatcttggaccaagtgatgatcttgaagatgaaaatgctattctagaatagtggcagagtgagatagaagaagcctaaatctttaattgatgactatagaactgttataccagtcctggattgtttattaggattttttttttttcctgtagtcagaaatgaacttctcttttatttgagctattattattttcctcttacatgttattgaaccaattattgatgaaagagagtcaaactctgtaaaatattggaaaggatttatgtttagccaaatataagtgaccaaggcctaaggcacagtctcaagagttccggagaacacatgcccaaggtggttgggttacagaccaattttatacattttaggggacagaagttacaggcagacatcaatcaatacatgtaaggtatactttggttttgtccagaaaggtggtagaacctgaagcatgtggcagggggcttacaggtaatgggtagatttaaagatttgctgattggcagtcctttgacagggttaagctctgactgaagagatgaggtcagcagaaggaaatatttgtagttaagataaggggccttgttgaagccaaggttcttgttatgtagatgaagcttccaggtagcaagctgcagacagaatagctggtaaatgtctcttatcagaccttaagaggtaccagactcttagttaaatctctcctggatcagggaaagtcctggcaggggaaggagattcactacagaatgtagcttttccccacaagaaacagcttttcggggtcatttcaaaatatgtcaaagaaatatatttcagggtaaaatactttgatttctttcagagcctgctgtctgttgtgtgatgctataccagagtctggttgtaatagtctgtgtggtcagtcttaagatctctgtgttaatgctggccagttgtgcctgaattccaaagggaggagagtaaaaaatactgtatgtatgtacaatatgttttccattaataatagtccttgttctatatcagggtttctcaacccaaagttcatgaatttcttgaggtattatgaaaaactatacttgtatatacattttttttcctacaaaggtagtccattaagtcctcgagagatctggatatcagagacagtgctcaaaataggaagatgatatttatctagagaagggcttcatctattgcagagcagctaaagtagaagattatttgaaatgccgccttcaacatcataatcaatatttaatagcaatctctgaatgtctaaaatgacaggccttcaagttcttatttcaaatacctcttcctctccaaaatatttttcaaattgccaagtaggaaataatatttcccttttctaatttcccataatactttaatacatactctcttaaaatacttacctgtgtgttttgaacttcttcaagttccttgaaagccaatatcacatctagaccaccattaaatccccagccatttacaaatatgacttattcaataaatccttgttggatgaataaattcctgaatccattggcttattttggtggacacactacacttttaatatggctcttgtttggtccccaatccccaggccatggacaggttacctgtctgtggcctgttaggaacctggctgcacagcaggagatgagcagcaggcgagcgagcattacctcctgagctctgcctcctatcaggtcagtggcagcattagattctcatgggagtgcgaaccctattgtgaactgcatacgagggatctaggttgcaccctccttatgagaatcttactaatgcctgatgacctgagggggaacagtttcatcttgaagccatactccccttgcctggtccgtggaaaaattgtcttccatgaaaccagtccctgctgccaaaaaggttggggaccactggttgaaaacataggaaacttcagcctcaaaagtaatttaataggaaggctccaaattggatccaggtttcagccactagaacatagcacagagaaggcacagatggcagtccacagcacctggctgaaacacagattggcctcttgtcttctgtccctaaccatccagatgatagatttatgcacaagcgggctcagaaaaattagacttaagaagatataaaccattttctacctgggagatatcagttgtcagcattctattttctgtgtagtagttataaaacaaaagaaagttaatcaaatgtttcctctggatacaaattctgatttgtcatgtcattccaaaatgtagtggcactgtaaaattctaccagtaggaaagccatttactcttgatgacgtccgatgtgcttacagtcgatattgatttaattctgcttggttgttgtttattagctcatttcatttttactggggtattggacatttttagatatgtcaggaaaatattgttttaggattttagggagcttaaaaacaatgcctctctttctccacaaagttcagaagcaatggggaaacatatgtaacagtctgatacaaataaaaatataacatttattatcgatgaagtgaaaaatatgacatagatttgttgaccagtagagtgctaataattcacccctgaattaagtggatttacctacccagttactttcacgcttggacaatttcagtctcctggagataggctctgtgatgggtggttggaaagcagaacagaaggcaccatttttgaaggtaagggtttcagaaaaaagaatagaagaagagctgagatgcctatgttcagttcccttttccaaagtcactaaggaaggtccaggaatgttgtcctaccattgtttttccaaatggaaatatgtgatatgggtaataagtgttcccttgtgttaaggctctccagagaaacagacccaatatattaagaggtcatttattgtgggaattggctctcacaattatggagactgaaggcctaagaactggggacttctcatagaagtcctggagtctgaaggcttgagaatctggagctctgatatctaaaggcagacaaagatggatgtcccagctccagaagagagcaaaattgcccttcttcagcctttttgttctgtctgggctatcaaggacccaggtgatgcctgcccacattgatgagggcagattatctgtactttggaaacaacgtcacagagacacccaaaaatgttttactagctatgtaggaattccttaacccacttcagttgacatattaatttaactatcacttccttcttctttcatatgtatttcactgtgttcctctgacactgtttgaaattttaagtgatgtcatcattttcttctcactacaacctttaatggacactcttcccctattgaatcacatataaagtccttggcacctaagattactgtgaactggcccccagtatctaaaatcaatacctgtagttcacatccctatagcattttcaccctcaaatgacttagctcattatgtagtttttggaaaatccagaatgtggtacattttcacacctactgttagtagttctcaccttgacttgtataatgaaccatttaatgtcctgtgctcatgagtggcaacctagggagacctaagcgatcttcagtaagaagaggtttgaggatttaggggtgggagttaagtctcataagatccaggtgaagttatataagcattgtggcatatgaaatttcatatattttgtattaatattgctgattggtgatgtgaacttatttaatgtcattttcctgttcttgcctacccgattgaatactaaagagctaaaatttttattctctcttatgacttttgaatcccttatagagcacttaacagaatctataactattgaatttacttatcaattacttatctgttatctttctccctccacgggatataaacctcataattgtcatgtttgtctagctcttcaatatgatcggcaccacatagaccataaatatgagttgagtgaatcctctcagttatttacttgctcacttctactctttttctctacctttccacccacccataatcaactattactaaaattagaaacaaatgaagtaatttcaaatgccttatagaaatatagtaagtcaatggtagtaaaaagttgtttatatcatgatataatatatggccaattcattgaatattactacttaatttcatctttatgtatttttgcaaatatatatgaatacttatggagtttgaatatatatgaggaatatatatggagtatgaatatatatggattttgaatatatatgaatacttatggagtaaatactgattgcatttatggcaacatattcattaataactgaaacctaacatgagcactgctgctaggttgtgtggtaattacagttcagttattttagaaattgctgaaatgttttccagagtgtctctatcattttacattcctcctagcaatgtatgagtgatgcagtttctccacatcttccctagcaagcaatattttcgctaatttttgtttgtttgttttagccattctttttgttgttgtcgttgttgttgttggagacaggatctcgctttgtcacccaggctggagtgcatgcagtggcatgatcatggctcactgcagccttggcctcccaggctcaaatgaccctcccacctcagcctccagaggagctggaactacaagcgcatgccaccacgcccagctaatttttgtatttttttgtagacacggggtcttaccatgtttctcaggctgatactgaactcttggactcaagagatccacctgccttggcctcccaaagggctggtattacatgtgtgagccactgcaatttttcctcttattgatggtgcttttttttttgagatgaagtcttgctctgttgcccaggtaggagtgcagtggtgtgatctcggctcactgcaacctccacctcccaggttcaagtgattctcctgcctcagcttcccaagtagctgggactacaggcgtgcaccaccacaccaggctaatttttgtatttttagtagagatagggtttcaacatgttggccaggctgatctcgaactcctgacctcaagtgtttgcccgcctcagcttcccaaagtgctgggattacaggcgtaagccactacacctggcttgatggtgcttttggtatcaagtctgagaactcgttgcctaaccctagatcttgaagattttctcttgcatcctctaaaatagttttatattttatatttaagtccatgatctattttgaattaatgcttgtagtgtgagatttaggttgatattcatttgtctctggatatccagttgctccaacaccatttgctgaaaagcctatccttctgctattatattgcttttgtacctttctcaaaaattagtttgactactaatggatatagagtttattttggaggatatgaaaatattcctgattaaataataatgatggttgtacaactccattaacatactaaacagaatctataattattgaatttactaaattgtatatctaaagaggtgaaaattatggggtgtgaattacataccaataaaactgttatttttttaaaacttgggtggatttgtattgggtctatttctgggttccctacttgtattcattgatctatgtgtctgtctctctgccagtatcacactgtcatgattaaggtagctatatgtttaagccttattactgggtaaattgatttctctcatattcttcttttttatctagattgctttattctagggtgcttatctttctatataaattttaaagtaagttttaaaatgtctactaaaaccttacagggagtttgataagaattttattaagcccatatatttctttggggaaaattgacatcttttttacattgacccttccagttcatgaacctggtatgtctctctgtttacttagttcttcttttatttcttccattgtcatttagttattttcaatatgcagatcccatgcaagttttgtgaattttgtactgaagtatttcatttcctttggaatgattttaaatggtattatgtttttaattttgccttttaatatccatttttaatgtatacaaatacaatagattcttgtgtgtttatcttatgtcaacatcctacagtatcttgcaatattgctgaactcaacctttaaatttttaaggtttatgaatattggactttaaaagttttatattaattagtatttttatcttcccctgaataataccaggagtttaaaatgctaacttgaatcaccttctttctgaggcccattaattgcagcctagtattttagatttgccttcttttcacccttaaaaatccttattataagtgttctttttgttgcttttttagtcagtaattgtgtagatttctcaaagtgttattttagcttctaagatcatcattctttaattaacgtttacccagataaaagtataaaattatattttgacacttattttttcttaagtgtttgaaaatagtattattccattgtgttcttgcccctcctttctaatgagaattctgcatacaatctaattgttatttctttgtaaatacttgctttttgtttctggttgctttttaagatttttctctccatcttgggtatccactggtacactaatatgattggttactttaggctttgtttttattaaaccttttcaatgttcagtatgtttcttttttttctgaagacaacttttgatataattcattcttaaacagaatctatttgatatttaattgtcctttgagtttttttcttaattttttctattgaagtataaattccacatactgaaatacatagtcattaagtgtgcaggctaatgagtctttgcaaatgaacatttacctgtgcaagcatcgtatttgtcaagataaggaacattttcttccctgcagaaagttcctcatgtcccactttttcaagtcctcttttttcccccccgcacaatgtatagattgttaaaattgtactctctgctcttagatttttataatgaatttaaatatgtattttatatctttcaggttcttccattatttttaggtttttgcatgccagttaatacttgaaacttctgtttgctcctgatgatggttgtcattgcatggtgtatttttagcagatttttttgttaactgtgggagacccatatgctcaggaggatagacatgtccctatatagaaagtccattcatttttgtgaggtttcaaatggatttgtaggagtttgtctagtttttgtgttaacatttcaattccggattactagaccaccactaggaagtgtaaatttgggctttatatctgttcagattgaagttacatttgttaacagattttaccctctgtatccattttctattgctgttgtaacaaattattaatatcacaaatttcatggcttaaaacaatacaaagttgttctctgactattctgcaggccagaagtctaaagtgagcctatagggctgagttccttcaggaggttctaggggaaaattgttttcttacctttatcaacttctagaggccacctgcattccacagcttgtggcctgttcatataaaaagctagcagtgtaccatcttcaaatgtcactccccaccctcacttccgttgtcatattaccttctgtacctgtgtatttgatcctctcatatccctctcataaggacccctgtgattatattgggcccacccatataatctaggataacatcccatgttaagatctttcagttaaatcaatctttaaagtccctttcactgtgtaaagtacaggcggagcattcccaaatcctcccaaatctgaaactttttgagcctcgacataacacctagattccaccatttaagcaaccacgcattgtccacatgggtgcatgagatcctgacacctttgctttctgatggttcagtgtacacaaacttcatttcatgcagaaaattatttaaaatattgcatggaattaccttcagactttgtgtataaagtacatataaaacaaaaattaatttcctatttatacgtggatccaatctctaagatatcccattatgtatatgcaaatattccaaaatccaaaaatttttgaaatttgaaacacctctggccccaagcattttggataacagatactcaatgtataatatattcatagattctggggattaggacttgaacatttagtggggagcattatttagcctccaaggcctcctttctccaaattttagagatactccacttctttaacacttcatgtgctaagggtggagttttactatccacgtgtctcatggtgcattcctctagtatcccagttttaaaccagggttttaaagtttttgcttcatgtctcatctgtctctgcagtatattcaaattcacttgcagcccccagaggtactttcttgcacaattccaggaagtacatttacattagatagtacatgaatggcacctcctacagttgtgtagcctgacactagagccagcaatcagggctcctgtctctatgccttccatccaccatcagtggatggaaccttactactctggcttagcacttttgtttttcaagctcagctgtaaacatgtgaacaggtgttcacacataattttgttatttttctttccttttgtttaaccagcattttcgtggctgtaaagagagaaggcttagtccaccatattgttggaactttaccttcattttacagaggaagaaagggctttccatatgagtgaactgacttatctgaggacacgactaataaattaccgaatcacagctagaactttggtgtcctgactctgacacaaaagttcttttataaatcttagtaacagtgcttttattatgattattcctgttatcactgatactcattactaacttcccaaattacacaagaacctgatgaaaactatactgttgtatgtccttgtgaaccgcaacacatatacaataaaaattcatttattactgaaacatttttggagatatatcattaagctaggtgataggtatacaaaactgaatgagacatgatatctgccatcagggtgtcatagtctaatagaagaaataggtgcataaacagatagttacaatgcattgtgcccaagtatcatttgaactcaagatatagttaagctgttggggaaagtgggattgattagatggggaggagagagaatgggttcaggatgtttaatcttcaaatagttattaccagatagatggctggataggattgagggatgcatagatggatagttatatgacaaagcaggcatagtaagatattagttgtagaatctagaaaggagatacacagttgctcactgtatcagtctttcaacgtttgtctatgttcgaaaattttataataaatggttggggaagtatcgtcttcatctttattatagctatcattcattgagtgcttagtgtgccaggcgtctttaagagctttacatgatttagctcatttaattcccatatcatctgcaagataagtactatcattatccccattttacagaaagttgggcatagagaagttaagtaacttgttcaggctcacacagttagtaagtggacaacccatgataccaggctgtctgactctagaattttcactcttaactttgacagagctatctctaaaagattgagaggatttttttttaataaagtgggtagggatgaggaagcattacaggcaaaggagagaatatatttacatagataggaaaaatagcatggatttttcaaggcaaacataatcctgggtggtgaatggaatataaagcataaatcattgagcaaaggaggttactggggggttgggaggactctgtaagaactggccatatttggctttaccaggtagctgagagggatccactgaaggatttttaataggaggactgtgtgtttagatctctattttgaaatgggagctctgatgtcagtgtggagaatggatttcaactaaagcttttctttttttttttatttccaggtgaaaaatgctagaacaaaatagaacagtttagagatcaataaatggtacaagtaaagtgtctggaaggagctctctgcttccttaatagagagtgcattctgcagaagttgaaagtgaccctaatctgagaagtgtagtatttttagcactagtagatatgaagagggatgtctcgttttcagtttaaggcattattaagaagaagactgatttccaggtttatcctgacaatttccctcttcctttcaagaagaagtgaagttcacatttttctaccatcttcatgttttctggatcatatagcttttgtgaataggttgattagttgatatcggcttctgtttctgagaaaacttcagaagcctagtatttcctcaatggcatctgttgccaccacttctcattttgtgtgagagggttgagtgagtgggtgggaccctttaagaaaataaattgagagatgagttaattatacagattatcaatatacgggtattttctaaccattcttataacaaatgactcaatccgcattcctcaatgtatgctaaaactactgagtgaaatgctattggagaaaactatatgtaatctcaaagttgcttccaaatattattgacaagttacaaaagtaaaataatacctttacatttaaataacagagaaatattgtgatcaaacaacaacaggacaaattgaccataccttcctcctctatgtagtattcttcaaaacatttgaattaatcacaaaaaagcaaccagaaaaattcaaattgaattacattctgtaaaataatggggataggctctttaaaaatgtcaatgtaataagagacaataaaaggttgggggactgttctctataaaaggaaggtatgaccacaaaaagcactgtgtgatccttgattagatcttgggtcacagaaacaggaaacaaacaaaaagaagaacccacccagctataaaggatgttattggatcgatttggaaaatttgagtatagaccatgtggtaaatagtagttttgtggcattgctgcatttcttgaattggttcattgtattgtggttgtggagatgaatgttgtggtctttctggagaagctttatttggtgtattcttaggagaattatttactgacaaagtgtcatgatgtctgctattttcactcaaatgactttctaaaaatgagtatgacagagagagaaggaaggagggaagatcggaggcagagagtaaaaacagaaagcagacatcagaatgtttatattggttctaggtcaaaggcatatgtgtattcattgtgccatcttttcaacttttgtgtaagtttgaaatttttaaaaaaatattgaggggaaatgggaattcagatgatcaagttcaaatggaatgttctatagtcctatccaaacttaattacattttatgtgttattttagaccaatcctgcccaacagtttcaaagtttatacatttgctttatttttataccagcctgttgtgaatttgcaaactgtttaaaaattgcaaagacctacataaatatatcccttagcataagggtggccatgcactttaaaattacatatgattatgtggctgtgtcaccaagattacattaatttcatattctcagaattaaaggttgatttccctatatttgacatttgcttgcaatgttactacatcatatagataaaagaaggtagaaaggtgtgaatttaggcagaggtttccctgaaaagagcttttaaaatatctacttaaagagaaacttgaactctgctttacgctctgatttacgtgtgttctaaaattaagcctttcctctgtatctgggaatcagttggggagaaaacattaaaccattttctgaaagcatggaggaagaaaagcaggcatcttattcctcttttcactccataaaatatatataaggacaggttttgcccattttaaacagacactcgcttttttttttctaatgtaacactatggtaatcttaacaaatatagaacattttagatttagctttgtttctgccggttttcctcatgtggacgccttccttctcattttgttccatctgcaccggatctaaggagagacactttccctttaagaaacaaaggttagctgtgactcctgtcatgtaaaagcctaaagaaggcttttcatagttgatggaagtgatgccaaagaataaaatgaaaagcctctgctatctacctagcgcctacacgccctggagccgacaaaagagctcagtaccagagccgaagagtccgtggagcaccacgttagtgaaaaagccgattataaataataatgaccttagtggatgctgagaactgcactaaagtttttctgagccagacagaatgatgtaggggataccatataaatgcatagaagtctataagggaagaagatgctgagagattcaatttcttcctccaataatttaaattgatggtgagttagtaggtgctcaataaatatttgttgaatgagtaaacaaaagcagtctaacaacggatttcctaatgaaagttcatgaattgaagcatgtttgcattgcatcccaactctgtattaaaactgtatctatttcaggagtaagatcagaatcctgatagaggaacatgcaaaatgttgcccatctatttagggacaatcatagagatagaaagaaaaaagatatttggaagtacatggagctcactttgcctatgagttgtgtgcatttcgaggtgggagacgggagagggagtgcaagagaggctggaatgagatttttttttgtagtgatacttggttttctgaggcataatctagtgaggagagagggccttgacgtttttatttagcgatcatgcctccagtcatgtgttctgaggctcatgttcggttttgcattgatagacttggaattataggacattcttggcttttgaactagctcattgtgctgaatgtggtaatttttgtgaaagcatactgaaacgtctaaaataacttccaaggcaaaacagtttagtacagctactgcagctatatgtagagcaccaacatttatacttagtcgggttttaatctcagcactcagttcttcggtattccaactataagaaccccatcatgcttcccttgggccagggtatcttaaacatattgaggttaacatattgagccagataattcgttgctgtggggggctgtcctgtgcttggtaggatgataacagccagtagcacccctaccccaagtggtaacaaccaaaaatcagggttttttttaaactgtctttgttggaaggaaaatcagaatcttctgaggaaaaggatttttgttctcttcttggatgttaagaaaattggcttgtgttggctgggtgcggtggctcatgactgtaatcccagcactctggtaggcccgatcactctgggaggtgatcttgtgggcagatcacaagatcaggagttcaagaccaacctggccaacatagtgaaaccccgtctctactaaaaatacaaaaaattagccaggcatagtggcaggcgcctgtaatcccagctactcgggaggctgaggcaggagaatcacttgaacccaggaggcggaggttgcagtgagccgagattgcaccactgcactccagtctgggccacagtgagagactttgtctcaaaaaaaaaaaaaaaagaaagaaagaaaaaagaaaattggctttttttttttagccattaaaataaggataagtcagttctcccccaaaaattaaatgagaagtaacactcataaaacaatttgttctctctctcttttcttctccctctccacacacacaccccctcaaattttttgctaatagtgactacaaatttctgagcagttagtggtagatgaatatcaaggcatattgcacccttttatctagctcataggtcaatttgatgtcacattgacataattatttaaatgggctattttctccacagactgttttaatttcatgaccctggtctctgggtcattgttattagaatctgattatctcatggaaaattaatatggccacatattttcttatgtgcgtccatacttttggcttacttcttgaatattttattactggctccattgcttttggttggaaaagaaggttcaatcattgctgcatagattatcattccagtaggtgccctgggcagcaatttctgaaccatcccttttgaaattttgttcccagctggagaaatgtcacagttgtctcagcttttgactctgacttttagtgagagatgcaaggaataggaaaacactttcaagaagaagcaatgagcagttgtatgcacatctggtgacttattgctgaagattctaaagcatttaaaaatattgattaagcctcaaactgttgggaaattgttcccataactttcattctgcccctagatttgctgaggttttgagctgtatttagcttggtgaatcttgtgtaatggccagaaagagacctcaggagccccatcccccaggttcttattagccttgacaagagtgttgttaaaattgcagactcttcacagttccaaagagatgccgtttcttgctgtttcaataccaagtctaaaacaatctctgtatacattttggcttctaaaatatattctgaggtaaaatagcaggttctactgtctttgagaagaccatttcttttgtttgtggtaactagtcatgttggtctcttttttccttctctttgttatatttatttggactttaatgttggctatgccctttaatgaaaaaaaatcaggcatttcccagatttagatttttattataaacacttcatattttaagtggtatatctctagggagaaatgtatgaagaattgatggaagttggaaattttttagttagtaattaacacctaccattaaaaacaagtgcaaatcacatgatggcaaagtgaatctattacatatcataatcaaagattaatcaaagtaattaccaggcaaacagggattgaatagaacttaaaaccaattaaactatttcggctgtaccactgaataaacactttggtattttaatttctcctctcttcatttgcttcagcaatatgtttgctaatatgactgaggtgcacaattgctatttaattaacctatttttgtcagaacctcacacgagctgcgtggagtagatctgctaaagtctcaataataatgagcctgataaaaaataaccaacatgaaattcgtgccagtcattttacaagttatgccaaatgtaataatatctgaagaaaaaaagaaactggttaccttacagaaattggattgaaagtacttaaaaaacatgttgaaccaacacaaaattactcaaaagtttagtaaaatttcaaaaatgtataattgccttgtttctttgtaccccactttgcatatcattaccattaactattggtaataaatctattcgagggcatggatctgttttggggatacttgagttgataatgggcacagaagggtttggtagtggacatcttttacccaatcatgtatcctttgggagagaatacttttctagctattgagtaaggcatcacgaaagtgttgatccattttgcttttattccctaagacaatcaaaacgctaacacagtttgggtggtcttggcctcaatgatacacattttttcacaaaagataacataactaaccatgtgaagaaagcctcacctttctctacctttggatagtagggatgaaagaaagtaagatggagaaatccacattaaatataaagactctttccccacaaaatcccagagctcttctgattggcaccatgaagacaaaacattctgattggatttttggttcttcacccaggtgttttactatcaggtagacacagtttgtgtacaactaaataagaccatttcctgcccaagctgtcttttttccccacacatttaaaatttactcacacttactgagcatgatgtttcaagttttctgaaacagctggttagtagccagttgatcactggcccctaaaggtaacaaagaccctccatccccaaatttttgccagtcaaaaaagcatgactttatttcactcccgtcaccccagtgctattacgaggtgtaagcacctttctagtgaaggtctattttctagatcttaggacaagaatagaatgtcacattgtaagcgttctcagaggtctgcagcaaagcccttattgtacagaaaagaaaactaagactcacaaaggtgtagatcacctgtttgtttgtttggggtttttttttgttgtttatttgtttgtttttgcagcaagatgaggattagaactcagatttctgactccctcaatgttctcccttctttatcatacaggctccttaactactggctgctttgcgtgtggtggactttaaatgatcacacgggtgccttaatcacagcctttttatgagtgacacaggcgctgagtctccctttttctaaaatggaatgttttatatccataacccagacttgcttaactaaggtcaaatttacataaacaaatgtcttccggggccagcaggtagcatgtctgggcaaaagcgtgtgtggcaaggttttgataaagcgcagaacacatgttctgtttaaaaatgttcacattcagattctcaaatctctctcttgccagaccaagcatgtccacaggctactggtttataacccctgactgcatcacgatgcagacagagtaaggaggagtgttcttacagttatgcaaatggaatccatatcaccagttccttttagaatactagatgtcccaagtgtgccatgccaaacccttttgctttgaatgccctggacttctagtattcaatgaagaggcacgacttggggaacatgaaacacccccataaacaccagctttagttcagccagtgtccccaaagactgactctgaaaagaacatacacgtgtatgtcgcataaaatccgtagaagagatgatgctgctacccacaaccttcttgggagctgctgagaatccctaacagacaaaccgaatcatagggcaaacccaccctatgtaccaaacaaccagtgtaattatattctgtagttgaggaattacataaattgcccattgggaaagaagccttaatctccatccctcccccgaaatctatcaacagctgtgtgagcctctgtgtatttttgaaaggttgaacacatttgatcggagaacaaacttgatttcctaatcaggttcgatgcgaggagagccagttagagatgtgtgtgattctcccagtgtgcgtctttgattcgtgtgctaattatgtcgatcctttggggaacacagccaggaagctgggtcctccttgatgaatgctggcggagagccatgcagcgcgcagcggagagcagttcagcatctctagtcccagctgagaatatggtcccattatctcccagctgcctaagcaatccataagggcctgttctgcgtggatgatcagtgtagtggaagcagggacttgctgagagctgaaatctctgtttgatttgctgtaacatgtaaagcgaaactgggacattttactttacagtctgtaagtaccaggttttacccccctctttctccctacagctccatgtgaatgtgactttgcaagctgcatttgattttctgttccattgctctttgttgaatcaagctggtgaggtagagtgtgatctgtttagagcttgctgtttctgttaaatctcttatataattgattcatacaaggaaataggagcctttcagaatgcttttatagaaattagaaattattggctttgtttttaatttgggagtgtggttgcattatctttggtgccaggatgattagagcatatatttatcttcttctgtacctctggccattgcaagaaaaatgtaagtaaaactaatatatatataaagagataatctttatatgcatgcctgtataaaagaagtgcctgtatttccagaatttaaatttaacatagtttattttgctgttctctgctgctactaagaaaggcagaaacagaaaagtttctcttgtttttcagttgcatgctgtttagaaactttgccatggaggtgggcaggataactgtttggaatatttgcaaatataaactgtatatctccttttttatgagacagtacataaaataagagtctgtgtttagccccttattgcttttgaatgcaccacttcttaagaagtaatgtgaattaaaaaaacaaaaaaaatcactttaaatttggttcatttatctttttatgtatcctcaaatgccatctatcaaattaatatttattattcatgcaagattcattgtaaaaatgctattagaatttaatattgttaataatgtttgcatgatgtctttcacatgatcaatgccttagtgaaattaaagattgttatcactgtggaaagggatttgtggatttttctgtttccctaacctaaacataaatcacacctgtctttttttattaaaagtggaataattgagctgttgtaaaaattgaatttgaataaaagtggcttgaacagcatgaaccaatggccagggctaatgtgaaccaaagtgaacttaaaatcatgaatacctgaaaaggggaattgaagtttccacactgagcttgagaccatggagcctgatggtcccataatttccagagtgggaaatacagtttccctgagtaggcagtaagtctcaaggcagagaaaaaccacagactgtgaagtacagaagcatcttactggtgaggacagagtatgttctcattagatttggtggagaggaactgtgcaagagagagaagactcaaaatagatggttgtctacatgagcacaggcattttcagagcttgagatttggagggaaaatgatcacaaaacagtacagaatgcttaacatctggtaagatgaagcaaaagacggactctggtacctctgagtagcaaacagtcccagggctgtccttgccaagtaatcagttctctggaaaaaagtaagtgtgcaaaaaggcctgctaatgaaatctgaagtaacggcaagtggttttgatggctatatggtccctaaacaaaaggctggcctcatgccttcttacaaaactgaactgacctttgtgagtgatgattcctggtgaacccttagctatatttttaaataactgttagtgtttttctgactactgcaagtatatgatcttgtgcaagatgtgatcttgttttaagagggatttatggatttttctgttcagaaataggattagttaaggtccagtgattttttttaaacaaatgcttaatttgtatctacttggttgagtaaatagtgttcttttgagtttcgatttctttttttttcagggtcccgaacccctttatttgtacttagcagaaacgattgccttctgtagaggagtatcttcccaatgtagttaaatttgatttttattttccattcaaatatttagaaatttcaacttataccttacaatattaaacatttttgtagtcagtcaccacaaatctcagagaggtatttgcaagatttgtagtttgcttctattactttcggaatgtttagataattttataaaattgggacactgtcttcctagttgtttgcttaatctgcaggaaagtggattgaactctccaggggtcagtttagggtatgtggtctcttgacagatcgggaagccagatataccttgtaagaggtacttctaaagccataacaatttggtcttcaaaataaatttaaagtgctatgaaagagaataaaggaaaagtcttgaattgtatatgtaaagatagtgcatctctgtacgtgtttgcatgcatacaaatctacccaacaacattgtggacaatttctgtgctacccaagtacactagctctttagttcctagaaagccctggggttgagccaagtggaaagaattttgtaaattgggatacagcagcagagagttaaatctccttgcattctttgttttggaccctcggcagactgttttgtttgaccccagagctgccggcttaagcacaaagaggactttataacgtcctcagcggcatttggaagcaggacctctgcacacaaatcataccctaaccctccttaacagcttagggcagccactgtgaagcaaggaatgcagttctgtgaactgtctctatgatgacaagttaaagagtgaatatgagctgggtgtggtggcacaggcctgtagtcccagctaccagggaggctgaggtgggaggataggtcgagcctaggagtttgaggccagcctgggtaacttagtgaaactctgtctttaaaaaaaaaaaaatgaatatgactgaatgaaaaataattaatttagtaactgtaatacttttggatgattttaaatgttatcaagccttaactgtgcattgtcaaagtatacactccattggttatctctagtaacagtgaaagattgagttaacctcctgtaagatgctgtgcaactctaacaagctgctttacctctctgtgcctcaatagcccccagtaaaatgaagtatgatttctgtgatccttccgaggttaagaaagttacgaactcatgacatcttattctaactgggcattcatgcctggaacggccttcaaattgcctagggacagggtgacatgtgacttagctgtcattttaaacaatatttcactaggatgctttcattttttcttctttcatttctctttctttcttcctccctttttcttccttcccttccctccatcttctgctaccccctccctctctctctttctacccttctccttctccctgtctgtcccgttccctgttctcctctccctctgcctccctctctctctttttcatcagttaattgtcctcaagtcaagtgtgactttagaaacgaggttcggattgtctgctcatttgcataacctgtttgcggctttctcttatgatagttcattgaagtatcaatgacttactgatatactgctctgttatatattagaattacttagctttaggcatgtatgtgcagcagggacccagaaagttatgctgcatatgtaagtgtgtatagattgcccatgttaatttttaaaataagagtgttgttaatcttatactctaaattgaagatgattaaggtgaaggatttatcttaatgtattaagctaacaatatttactttaaaaataaaacaagtgcacaaacaatagcccatttcaaggtagcaggatattaaagagcttgatttttaaaaagagaaaatatgttcatcgaatgatttgatttttctgtaagaaattgtcttgccaaacagtatggaaaaataaaaggcatacatcattttattaacaaatagatacccgtccacataatgaagtaagcaactttgtgaaacatgagataggaaaaatattttatggaaagtttttttaatgatacacttcttgtaatcttaggattgcttatcactagataagtcctcttagttgaaaacagcagatgaagaagttactaaatccatcactaatgagtgcttcttgatatactcgaaccaacttgtgaatacacttcatttgagaatctttactgcagatactggaaaaagctaaattaatttcataatttatacttgtaggacatggattgtagtgctttttgtttcttccactgttaaatggaatagatggaatggcacaaaaatttacggactaatattttactgtacagttgactatatatatatacacacacacttataaatattttttaacatcaagtgtactccaagatggatgataagtggccatttgatgacagtaatagcttggatgggctcatcttatttcagatcagggtagtgttatgacagcttttaaatgttagttgaaatactcatttttctctccatttttattattgggaggtctctatatgtgtcttactattctggagtttgaatattaatgttattccttattgaacttgtaggctatatttgatgcatatatatatatatttttgatgcagagtataaaattaattttccaaatctcataaaactgagtagatatcctggctttttaggcagcaggcctgttgtaagtagaatccgtaatgtgaaataatttgttttatcgtcgtgcatccatctatgaccaaaatgattttgtacttaggaactatttcaatgcaaactagattatactgacagataatgtttgataatttgtggctctcaaatccttgattataaagttaccaagcagcttcagggacattgcttttggttttaatctagtacctctgttgacttgagatgttcaattcaatattacttagttaatagctccaatggcttatccgactgttttattgtatagttaaaaaggtaaagtaaattggacatagacatgactctagggcttgtacatggcttcatgtcttcacctctattccaaagtaagaagggaagtccttctgcatttttgcatgaaatttctctatgttttaagggaggaatggggtgatttaaaattgagaggaacacatcagaaggagctgcaaaggaataaagtgtttcttatggttagatataaaatgcagggctatacattctgaagatatggcagaatttagagaagctgactatgccaggcatttggcacaggggactaaaggagacagatttaatgcttgccagaaggaaaccctatatcagtggatagaaatttgagtgccctgcaagcaagcaataacaaaagaaagaaagaaaaaaaaatgtaaataaggaagtagaggaatgactgtattgtggttggaagagatgtggtttcattctgcaaaggaaaattgtgagtgaatgaaatatatcaagtgtaaggacattgggactaattcaaaaatattttgcataggtattgctaagttactgtgaaataattaagacatttggatcagtgaagagatacagagaaaaaggagtgctgttggatttgactgtactggctgacacactttaacaatgtaattatcttaaatgaagtgggtattgtgacaccgtagtcagtctgtcttatttcagtgagtgtttctggagtagttaatggggatattccatctagttcagtagatattgataaatatgtatttatggaaactatatagcagtttttacaggctgccagtaaattaccttgatccttctaccaatgtctgtgtttctgatcccccactcctccctccaatgatctgtattaccccaaatagtcctaggagatggtgtgagaagactgagtttgaggaggttgattttattaaatcacttcaacctttcagagagtaaataagttcttacggtagggcgtaatgccatgcaatactgaatgacttcttgaaatcctttcacttcacttttcctttaccaagcactttgtccagagtaatatgtttaggtcttccaagcatttagataaataaccttgtctgctggacatggactcaatgagtcataccactaattaaacacggtcatttgcaagaactttgcctcctcgctggttagaattcattgtatatgtgtgtgcctttcagataggtaaagctgctcacacacaggcataatgcttgactccaggggtgaaaacaaccaccatctctcagaagagaacaaatcatgtgttcaaacatggtctctggcatctttttgatgtgtgtgttaagtgtgaatctggtaatttaaggtgtgtgactcctactcccatccagctgtctggctttgtgcttagagagaagaatagcaacagatttagactgacacaatccttccctagagtccccctcccctacctctccctgcaggaatccacaagggtattcggttgattgctgttgttaacctctcttgtagtattatatttcttgttgaaagtaccttttgtggcatgtgagtacatttaagagatgtgaaaggctttaaaaatggctttacttttaaactttcttacctaaattattaggaggaaaacagtttcttaggttaatatgtgtgtgtgtgtgtgtgtgcacacacgcacatgcacgcatctaggctaagatctttgcaaacctttaatgttcatcaagggctgtgtctaaatgatacgttgattataataggattttttttccaaatcattttcgtaatacatgaataatactcagaatgttcatgtaaagtgatagactgaactatttcacttgagaaacattcttgatgttgtacatgacagtcttcggtcgcaaaataatctagaaaattaggaacatgtctgcaagtctggttaaggctctgacagttcttctaatatatctgttttggtgaactttgagcatcacagagttttctcaaggtatgaaataaatacctctggtagaatgtttgataatctcagagtactcaggaatttttaatagatatgttaaagataaaaaatatataactagtaaataaaacatatagttttacagatagaattgtttagcccatggctaaatggataaacctaaaagttttgataagcaattttggaagcgattcttgaatgtagcagaacttgtgatgatgatgtggaagtatagggaaggtagaactttgcctgtgggcctgagacttaaatctacacaaaacagactaatagaagaaaatcatacagatttttcacatttacatgggagccgccacaggaaaatgaagacccaaagaagtggcaaaacctaagtgcttctatattaggttgaacaaagagaggcaattgtaggaaaataactaaaatatatggggcaactaaagaaaaatatgagttattttaacaagatctgtttgtacagaatacccttggttttgactccctgtctctagtgataagaatgtttcttttctcctggtttagggaagacatctttcacataggagttttatctcctgatgtgacaatgaaaagggaagatcggcttgccctccttgtaccaactgtgtttcaagtgtctttagctcaaaataatccttttgccaaagtggcatattctgataagggctcttctgccatccctcacaagtgaccttgccataagttatttcttgtgtgtctaaggatgacaccctagccaacaaggaaaatggtgacattcaattatggaattttaggcctggacatgatctacagattgtcttgtctgttcctctaccagtaggtccagaggcttatccaagacagaatggtcttcttgtagtctgtctagggatagaatctagaatttccagagccccatatgggttcccttctctggcaagaaagtcattcttgcatttcttttcacattctgtaccacgaagctagaactctattggcagccagataacccagaaccaaagacctgcagaaaccaggctgaacacacgaagtgtgaggtggaccagttgtcaggcaatagggagtccacagggtctgtaaagaacggtgcatcagggttcctcctaagtgttgtggccatgttggattgtggggccagtgttgctgtatctcaaaaattttaaatattgctgtttatttttaaaatgtgtgaaagctaaacgcatctatcgaattcataacatccagttttcaacttctatggtaagttatttgaggcatctctcattggttgcgggaaaaatatgcggattcacatcatgaagtggcatatactctacctaagagagggaacctgtgttaatgatccatcttgggtacttctagggaggaacctaagagaatgaggtaaagcatgtaaggattcctacaaggctttttttaaaccctaatatgtttcattcattgtcagtttataaggatcagatttaagaaatcatattacaggtatgagtctgaagttaatgacacagaattcaataaatatattttgctatgcctaagtaattcaggtcaatagactatattgtagttactgattttactaacatatttaatatttttatttctactggggtgctaaagttgccagtcatgatttacattaccatagaaaaagataggttggtgattgcttcctttttttttttttttttttttttttttttttgagattgagtttcactctgtagcccaggctggagtgcagtggcacaatcttggttcactgcaacattcaccatctgggctcaagtgattcttgtgcctcagcctcctgggtagctgggattataagcacctgctaccacacgctgctaattgttgtatttttagtagagacgggggtttcacaatgttggccaggctggtctcgaactcctgacctctggtgatccacctacctctgcctcccaaaatgctaagattacaggcatgagtcaccacatccagcccttttttccttttttaaaaaaacttttgatactcactgattaattgggcaaatagaggaaatctgcaaatgagagggatagaaaaatggtctaatttacacttttttttaaaccacaagatagagcctaaattccatttaattttccactagacattttagacattctatctgataaaggaacagagaacacagtgctgggctgtttaagcacagtcatttttcttgcgtacctgtgcagatgacagaatcaccaggtggtcccatcttgaggaccactggcctatatttattaattcatttaacttattattaattaaattcctgccatttacctcatactgtttgttctagagttcagagatagaaaatgaacaatatgaacaaacaaacaaaattactacccttacgaaagtacgtgcattctagtatggtgacaaaaaggaaaggcagtgttctccaagccaccctttggatctgaggcgccttgtccctattttcactacttcttcttgctctgttggctgttttgcccagctgaacatacttctgtggtatttaagttgatctcatataggccatatgaagtggatgaacaaaagtttttcagatatttttgtgaactcaaaattatgtgggcctagaatagctgagtaattgaggcaaactcttatttgtttgaagataggattttgtaatcaggccatccagctactgaagcaggcctctgcttcattttgtttctgtgaacaagggtggacctctacccatcccccccaccccccgcaataagtcactcatttctcaggtgtttttgtttctgcctgccttaaatggtggagttgaccaaattgactattttgaaacctatttataacttctagataagggtacagccatccctccctaggacatggttttaagtagagttgaatgaatatgtgaggaaggaagcattttgagcttttttgaacaagttttacaactgcaaagtgctattactattaaagataataatttagaagtaaatattatagcaactaagtgcaaaagagctcttagtgcactattttcatttcaccgtataaaaagaaaattggtagtaaaatatatagtgtttatctactttgtaatttctttcccccaagtctattgacttttctctcccttcggacttccctttggtaactcagaagcttacctaagttttgaagtagccagctagaaggagttacagagtagatgacagctttgtctttttttctactatcagagggctcaacactgtggagtgatttgtgggggcatctgacatcatcagaggcgcaaaagtaatcgtgcttatcactaaagagagttggctctaagctttggtaaagtggtcctgatcccgtgtgatcctaaaaaaagatgagaggaatgatcattactgtttggagcctacaggctcaataaccttctaactctgctttttaattaaacacagagcacttaggggtttatttatccattatcaggcaggcaaatcctctactgacatcattagattttatggcatgtggcctgcctaagcagtttgtgtgtgtgtgtgtgtgtgtgtgtgtgtgtgtgtgtgtgtgaataattaatatgaaagatattacattactaccagtacaatatgctttacttccatagtctagaaacatgcctttttatgcaaagttgcaacatgattcaaattgatgtagtattttaaagttaaagctctatactcagtattaacaaggtggttgcattttccacagagactctaacaaacgatgtagtcttaaatatcaattgatttacaatatctcttagcctgacatcaatattaaggctttaggatagctctcacatgagaaatctgatattttgaactttggatcataattaatttcacaatacagtattgttatcttgtattacatattttttctcatgttaatttgacttactggctattaataataagaaacgcactatttcaatgaccgaagagtgcaaacattaggtagtgatgctagtagaaaaacagtttggacagtgcttcttaaacattagtgtgtggaaatgcagattctgattcagttagactgactgggactcaagactctgaatttttaattagctcccatatgatgtcagtcttggtggtccacagataacacttgagtaataaggataaagaccatgtggaattccctgttcagcccacatgagatttcccaactgaggaattctttcttgagtgtctttttctttcatctttgtctcactgtattgttatttgaaatcagaaaataaaaagtactagattgatagctctgtccacctgtcaagtgaaaagtttgcatctcattttgtattacactattttatgccctaaatctttgctttctgtcctaaattgatctggtacatctttgcctgacatctgagtcttgtagatagttatttaaagatatgtgaagtaaaagattgtgaatgtcatggctagaatagatgctatctccagagtctaggaattgaggtatgtactggagacaaaacagacctgttctatatggaatgttctggagtattatgaaagacactcttgtttgtttctttatttttcaccctgtggcttatgaaagtgaaatgtgggcttttctaatatatgcattctctagtttcctatacactgttgatttccccttagtaacattgcatattatgttgctcctagtggtgacaaatctcaggaaagcaagagaccttaaaaaaaaaaaaaaaacaaaacttttttctatttgtgacatgatgacagctgtcatgggaatggggaaagatagaacagtttttcagaatccatcaagtgaaggtacattcaatgctgtaacttaatgaaagttgctttattgtgacatgagtcagagtctttggtgatgcaagtgtggaaggatcttttctgaaagatttatgcctcaagtctggatttgagctgaagggacatgaccttggctttgaacttgaaaaaggttaccctctgtaagaaagtccagagtcagtatgaagaggttttcagatcaggacggcaacagagagtaaacaacactgcagagtctctctgaaatgtgcaaatatcatgacaaggagaggtctccttagctttatttacccagaatcctcacgtaagaggtagtcatctgggtgcttagaaatcaaaatgaatgactcactttttcaattttcatcaaaataacccttgttttgtaaatatacacaaaaaaactacccatcatttgaaatttctattgtaaaccccattgtgaatgtattattgaaaagattggaaaaccttaagggaaattctcaaccaaatctttttctgaacagcttttttgagtggaataattatggtataattcttatgtcatacaactaacacatttaaattgtacaattcagtgtttttagtgtattcacagaattgtataaccatcagcattatcaattttagaatatatttgtcatcccaaaatgaaaccccacctgttcacagtcgcttcccatttctcctcaatccctccctagaccaacaataatctctttctctgtgcctcgtctggatgttttatataaatggaatcatacaatatgtggtctcttgtgactggcttatcttgcttggcatcctattttcaaagtttagccatattgtcgtgtgcatcagtacttcattcctttttatggccaaataatatttcatcattttagatatactacattttatttatccattctttagttgatggacatttaggttgtctaaatattttgactgttgtgaacagtgaccctatgaataatctggaatcgtttttgtgtggacatacacctaggagtggaattgatgagtcagaaccgaagattttaaccaatatgtttaaattttagcaacactgaaatacagtggatgtaactaaagagaatatggaaatggctataaacgaaaatgcttctcaatgaagagttttactcatttgaacaaaggaactatccctcttatttttttagtctctataaagtaaatgttcccaacactttttgtccatctcctctgtcttcagtagtggcacactgtccatgaattaaggatatgaatactaggcaggaagttaaattctgttctgcaaaaaaagagtatgtcatttctgcttattaagaccatgataaatgcaacttgaataagaagaataattgtttagttaacacaataggaaaaaaaagtttaatagaataccagctcagccttttggaggcttagcatatttgaatggcaacatagaacactgtagggaaactctcaacctgtctctaaaatccagagtttgaagatgcagtaaggttttgagcttgtattttctcatccctgaaagtgccaattaagataataaaatttagagcctatccaagttggaattagatcttcactgtgtgtgtcactgaatatgacgacctggatgagaacacctattagaggggaggctcatttaatgcactggagatagctatggtgttcatgcagcatgcactgtggaaggctgtttggattgcatttgattaccactgctgtgtgtttgatgttttgcaagtattctatggggactgccttttctttttccaattgaaaataggctagaaaagggatataaacatgttagtgctctgagaaaaaataaagatattaatatatttctgcaaaaattgtctttcttgacctgaatcataaaaggtattgtgaacataacaactgactggatattgtttatattgtcggtaaatttcagtcagttgaaaatattttaaagtccatatatatctgtgaaaggcatagatgtaagctgcatttaatgtgctccaaaatcaaacaagcaagtattttacttaaaatgtaggttattggcatacctttgtgtgtatgttacttcaatgttgaacacaaggtgtaaaaatacagtattttacatttctgcagaatcttgtcactacagttttctttcatttgaacttaacagatgccaagattttccatttagtaagtattattactagcaaatatattatctggaacacaatcagtatcaaattctggctttctaagaatattgaaaatgtatatgtagaggtgaatattgcagataaactgagtactgaaggaaatggttgattaaatattattcagtttgctttgtagtatgatgaaacattttatatatacatatgtgctagcacacacatgcacaaacacatgcttacattgtcacagggaaacaaatacacattatacctccacccccattgctactacaaataaaggtcttaacaaggtaggtttcttatcacacatcttacagtacatcagttaagactgaatcagggacagcacaagacaaaacagaatcaaaaaggtagtgtgactgcagtatatactgtacatttagtgagtttctatttataatcccgcccaccctcctaacacattttacccatccctggcactatggtcctccctatgactcagctcccaggcccttcatgcgccccacaatcttttttctctccaccttctcatttctctgtctagatttattcttagtaaaaactgagaatactctgtttcagaagttgttagaattatcaaagttaaaagaaggaaaagaagctggtatttctgcagtgtatcaggtagtttcacctacattttatggcatatttaaaggacaaattcttccctatgactaaaattctcctgcttggaaaacaaataccaaaatcatagccattcctagtatctgtaattgctaaaaatcaaagttgtcaaagttgaagtttatgaatgaaggaaatatagttgtataaaagcaaaaaatgtgaaaacttacatagtaactaggataaaataatccaagaataaatttattccagtctaagaaaaaacttgatttaccaaaatacgtatgggatttagggtaactattacatgtaaaccaatcatgtacttttttgaaatggtgactgttgcacactttacattctttctcttatattcatgaaatataccactaatattttgatataaaaatatcttccctgaggtttttttacttaatatttgcataaataggcatacatccatgcttgggaggcaggttgagaaagaagattatattttactgaaaaaaattgtgggaatcatagtcttacaagtttactggagctgctaacagagcagcatatgtgcaatgagaaccatccttgataactggtttgcttagccactgcccaaatctctagatctgaatcttgttttcattgctgactttctttatgaactcagacacataccattaacctctctggactttggatactttctcagaaaacgtagaagacagattgattcttcttaagccttgttcctgtcctggcattccttaagaatgaggttgcatccagctgcagtgtgggtgcacttgggcttagtgctttttctgagacactgtgttgagcagagatcttagccatgcactgttggtgtgaactctggattccttctggtcattacatgtcctctggcactgttttccagctgagggctgtgacctcagagccttggccctgtttcatctttttatgtggatgtcctctgaagttttaattgcttacactgtcttcctttttgctccctgttctgtcaccttagaagtggtcgttaaaagctgccattttactcttgaggactggcacaccaaatgagggaacaatgtatgctgctgctgctgctgctgctgctgttgctgttattgttgctgcggttgttgtggttgtgtgagtttaggtggctgtggagaaacgtctttcaagatttagcatctgaaacgagaagtgtgttgaggagatgggattttcatatcgcctgttctatctttgcatgcggtgtaaaaggtcaaagccttgcttcatccgtaaagcaccttctttacataatagcgagcattgactctgggcatagcttatgtcccatcccctcttttcctgaggattactttaaatagaaatacctgtctattatttaaatataattttgtcctctttgtgtcttctgagagctagttgcccctagatgtctttcagccttgctcttcaacaaaaatagaacaagtttattggtagcccttatgacacatcccccacagttggatacttgatcctcccccttttaaatctgccctcaattctttctaaagccatctctttctaaagcaagagttctgctttccttttgttttcagatatatgtcccttcccgatgtctcccttcatttctaggtttcagttttcaatgttctttcatttggtcatagactttttctgtgttctttctaaaacaatcagtgtactttcaagttgtcacttttcattctcagctatggggtgaggtaagtaggtgttcagatttttattgatgtcaaggcctcctcttgtcgctgaattggttgcatcttgttcacagtactgagtaattattaatatatcaaatccaagctcatatgttgattggactgcctcctttccccatggatgttgtagtcttgattctttgttgtatttcagaaaggaaacctctaaaattttattattttacatttgaaattgttatttctattttattggaattggattttgattgtgtattatctcatatgtggagaaatcaggaatatcaaccatgttatgctacactgatgatcagtcaatgcattggcccataaaatgaacacagttatacaccagagatcaaatcattcccattaaaacaactagatgctaaaatagcactgatattaggaaaaccatgctatgacattaaaataattcaatccaaggtgaaaccgaaactgatttgtctgagattgtactactttactgacccattttattaaacgtaattttttaaaagcacttttaggaggtagatagtatagtgcattattgagattataggtggtggctaaagccctgtaagtatattactgaaacaaattttttcaattctctggtagaatatgaaccaaggtttttttcaatattagcctttaaaaaactcttaatactccataattagcctacaatataataatttgtttccacctttagtatgacaagctatttcttgatttttttcactgagacataattatatatatttatgaagtacatagtattgtctcaatgcatccaatatatagtgattaagttaggttaatgagcatatcctgtcacctcaacattcatcatttctttgtgttgagaacattcaaaatcctctcttctagctttctgaaaatatataataaattattgttagctatggtactcgtacagtgctatggaacagtacaactgatttatcctatctgcctagaattttgtatcctttaatgaatttctccctatctttgctctccccactcttcccagcctctaaaagccactactctactctctacttctaggagatcaacttttcttagcttctacacaggagtgagaagatgaaatatttatcattctgtgcctggcttatttgacttaacataaagtcctctggagtcatccatgttgccccacgtgagaggatattactattttttatggctgaatagtattccattatgtatatatacgtattttcttcatccattcatctgttgatggatacttacattgattccataccttggctattgtgaatattgctgcaacaaatatggtagtgcagacatctctttataatactgatttactttccttcagatatatacccagtcatggtattgctagataatgtttattgactttcatatttgtatggagtagaaaatgtataatatgtattatgatttgtaatacatgtattacttactatatacaaacaacagagccaataaaatgacatagcctatctgtcaagaaatcaacatgagaggagacattgttggtttcaagggatatgccttttttcacaggtaggttgatctttgcataggctaaactattcacactctgtttagctgccttgatcgtctttactcttgtttgagtaacttggtaatggtgaccaccatatgatgaggaggaggaggaggaggagaaggaagaggaggattatattattgaccaagatgatgacatcactgacaatagataataccagaatatcttgaaatcctaatcctttaacagctgctggtttgattccagttaggcttctattttcttggccctagtgcagtagatgagctccttgcacttgatatattttcatcaatgaaaataaaaaagtgaaaatgctgtgctttttagatttccctcatgtgatgcttgggctatatcatcacacttcctccctggcagtggaatcattaccttctgctgttactagtatagattttcagaaatcttgtaataaatccactgatttgagagcagtaggagcttttctttctaggttgcctctccaacattttcatcttgatatgcattacttagaattcagccaaaataaataaaatccagctctgtcactgcttgacaaatataatacattgtcagtgtacctgtttatttcactaatatactctattttcttcttctttctcctcttcttttttttttttttttttgtgactgagtctcactctgtcaccaggctggagtgcagtggcacgatctcagctcactgcaacctccacctcctgggttcaagcgattctcgtgccttaggctcccggatagctgggattacagatgcgcgccaccatgcccagctaatttttgtatttttagtagagacaggggtttcaccatgttggccaggatggtccccatctcctgacctcgtgatctgcctgcctcagcctcccaaagtgctgggattacaagcgtaagccaccgcacctggcctctattttcttcttaaaaccacgttgattgggactatggcctctaattttctcataatttagctgttgtatgttagcattgtcttttaggtgctatttgcattttccttttattatttagagaacacttatgtagccagatttttttaccttgagaaaatgttcttaaaagtgtaactcccgtgatctaagaaatgtcattcagccaagaagttactctaagctttattgtctgaaataatttggaaataattctctttaaatttcaggaaaaagaggacataaaccactgttatagtttcagttgtttttaactatgtgttgaagctttcccagtctcttaccttgtttattcagttgtgttaatttggcagttaaaagaattgtgccatcttcatagatgactcatgtggaagtatactatctctactaacagaagtgactacagacatccaaaaatgaatgctaagcctggggaaagaacctcctaaaaaagagtcaatatgtttgatgacattaaactgcacactatcatttgtgagtattttcacttgtcaactggaaaacaacggcaggtcttgagatctacctcatcctcctctgttagccaggaaaggagacaaggtgttgtcttcagggtgttttcccttcatcatgggccacttggagccaaaaacatcaagggaaaggaaggagcttgggcgggtaggcctgggtacgggagatacatttttgcttagttttcctcagggatagtcaggactctataattagcagtctagtcaaagagaagtttggaggaacaaatgagggaccttctccatctccattgtctctctatgccttcaaccagggaggcagtgagtctttagggatccaagctgttacccctagcttgttaacatttaataactacatgacctaaataatgttgttctcttttcacaattctcagttgcaaatgggagagtagtataatgattgccattggatgtccatttactctttcagccattgaccgcccttattccattaaacagaaagtagtgactctttcctgactctcttaacgagatttctgaccttttcccctgctttatattgtctttagaagtaaagattccatttgatgagtggaattatctcccccatattaatggtgatgaatgctcttgagaggctaatgcatgcaatttaacaaattcaaactcgagtcaaaatctgtcttaatattcataataagaacttatgtgatgtccctgacatccagcagaaataacctgtggcagtgttcgctctaatacttgatcttgtaagagaaaatttcaaccttatacacattttagaattacaactgagccagcattacagtgctaaagaatgagaaactgttgtgttgcctgtttttgaaatgtaacaaaagccatgttttgagagtaattgacttcttaactcacactggacttttcatgtcttgagttccctcaacctgtattcttgtggctgattttgctaaatatatgtacttataaatctcctgcttattggaagattatacatttcaagttcaaagatgtaaaatagactagtatttctctattttgtgagatagtttttcctaggtcttatggcaggatttggggttttgttttttgtttttttgagagacagcatctcaccctgtcaccctgggctggactgcagtggtgcaatcatggctaactacagccttaatctccctgggctcaggtggacctcctccctcagcctcctaagtagctgggaccacaggcatgcaccaccacatccatctaacttatgacaggttaaagggagaattctttcttttgaccaaaatgtttgtactaggaacaaaaaataaaaatagtagccatccctagactctgtatttttgaaaatcaaaattgtaagtagaagttgactaacgaaggaaatatagttctatgaaagcaaccactttttaaacttcctgctttgcacatagttaactggaagaaaaggaaaccaaaaacaaatatattctactctcaaaaagcttaatttaccaattattagtgaaaactattgtaaatattcatttaaaaacaagagttgtttacattcttaaaaaagtaactatagcagtcttcatactctttcgtgtcatacagtaataagattatattttgatagaaaaaagtcatatcttccctgaagtttttttatttaatatttacataaatagacatatatccatgcttgggaggcagggtgggaaaagagattatattttactgaaaaacactgtagaactcatagccttacgagtttactggggctgctaacagagcagcataagaaatgagaaccatccttgatcattggtttgcttagtcaccgcccaaatctctagatgtgaatcttgttttcattattgactttctttatgaattcagacatgtgacattaacctctctggactttggctactttctcggaaaatgtagaagacagattgattcttcttttttttttttttaattatactttaagttctagggtacatgtgcacaacaggcaggtttgtttcatatgtatacatgtgccatgttggtgtgctgcacccattaactcatcatttagcattaggtatatctcctaatgctttccctccccctccctccaccccacaacaggccctggtgtgtgatgttccttttcccgtgtccaagtgttctcattattcaattccgacctatgagtgagaacatgcagtgtttgattttttgtccttgcgatagtttgctgagaatgatggtttccagcatcatccatgtccctacaaaggacatgaactcatccttttttatggctgcatagtattccatagggtgtatatgtaccacattttcttaatccagtctatcattgatggacatttgggttggttccaagtctttgctattgtgaatagtgccacaataaacatatgtgtgcatgtatctttatagcagcatgatttataatcctttgggtatatacccagtaatgggatggctgggtcaaatggtatttctagttctagatccttgaggaatcaccacaatgtcttccacaatggttgaactagctgttcctatttctccacatcctctccagcacctgttgtttcctgactctttaatgattgccattctaactggtgtgagatggtgtctcattgtggttttgatttgcatttctttgatgaccagtgatgatgagcattttttcatgtgtctgttggctgcacaaatgtcttcttttgagaagtgtctgttcatatcctttgcccactttttgatggtttttttttttcttgtaaatttgtttgagttctttgtagattctggatattagccctttgtcagatgagtagattgcaaaaattttctcccatgctgtaggttgcctgttcactctgatggttgtttcttttgttgtgcagaagctctttagtttaattagatcccatttgccaattttggcttttgttgccattgcttttggtgttttaaacatgaagtccttgcccatgcctatgtcctgaatggtattgcctaggttttcttctagggtttttatggttttaggtctaacatgtaagtcttcaatccatcttgaattaatttttgtataagttgtaaggaagggatccagtttcagctttctacatatggctagccagttttcccagcaccatttattaaatagggaatcctttccccatttcttgtttttgtcaggtttgtcaaagatgtgtggtattatttctgagggctctgttctattccattagtctatatctttcttaagccttgttcctgtcctggcattccttaagaatggaggttgcatccagctgcagtgtgggtgcacttgggcttagtgctttttctgagacactgtgttgagcggagatcttagccatgtactgttggtgtgaactctggattccttctggtcattacgtgtcctctggcactgttttccagctgagggctgtgacttcagagccttggccctgtttcatctttttatgtggatgtcctctgaagttttaattgcttacactgtcttcctttttgctccctgttctgtcaccttagaagtggtcgttaaaagctgccattttactcttgaggactggcacaccaaatgagggaacaatgtatgctgctgctgctgctgttgctgttattgttgctgcggttgttgtggttgtgtgagtttaggtggctgtggagaaacgtctttcaagatttagcatctgaaacgagaagtgtgttgaggagatgggattttcatatcgcctgttctatctttgcatgcagtgtaaaaggtcaaagccttgcttcagctctaaaggaccttctttacataatagcaagaattgactctgggcatagcttatgtcccattcccacttttcttgaggattactttaaataggaatacctgtctattatttaaaggtaattttgtcctctttgcgtcttctgagagctagttgcccgtaagatgcctttcaaccttgtacttcaacaaaaatagagcaagtttattggtagtctttatgacacatcccccatggttggatacttgatcctcccccttttaaatctgtcctcaattctttctaaagctatgactttctgatgcaagagttctgctttccctttgtttccaaatatgtatctcttactgatatctgtcttcacttctaagtttcagttttcaattctctttcatttgatcataggcttcttctgtgttttttctaatactatcagtgtactttcaaattttcacttttctccttcaaccatcatgtgaggtaggtagctgttgagattttcattgacgtcaaggccctccacttgcctctttagagacttgcttgctttttgttcacagtacttggtaattatatcacatcccagttcatatgctgcttggactagccctttcatgatagagattcctatgttctaatctattcctaagtgctaagaggacccctgtttctttatgttaaaccttaaaaagcatctctgttggatttggtagttgtatattttgatgttatttctactattatgtttttgaacattttaacaagaagagaaaacctttttttgtccatgcatgtttaagagaccccctcaaaatagactgagtcaaaaatatccctttcagtagtacactttcaaaatgtttgagatgtctctgtgaaagggctaatctggaagtctttgacagtttggaagcctgaagaaatcccccattttcccaaagctgtgtttttgaagactgttcttcaaagagcaagcccaccgttttgctattagtgccaagaaagaacaatgagtagattttctgtgtcacaaagaaaagtagtagacggaagatctgattgccaccatgttgcatttaaaacctcattttctttagagaactgtccacaggactctccaataggcagggatttaagggtgaaacagttcagaaccacatctcccaccatataactcaaagatgacgtttatatatctgggaaccttttaaaaaccatctagatctatgggtaaatttcaaatccacaaagttcaactggatggaaagtttactcaaatgcattctttcgtcccagtttttaagcctaatcctactgcttttaggctgactgaaatttatagaactgaaatcatcattgtatctccccagtgactggtggtgatatttgacttcatatactgagaccaatttttatttaattcacatttttggaagagcttgacctgaaagtcattgccctatgctgaaaagattgaattggttttctcaagtatatatcataaaaacagttgatcctatcgaggtgaggtcatatcaaagtagtacactgaaattgagccctgaagaaaatattttttaaataattttttttttttttttggtagagactggatcttactttatttcctaggctggtcttgaactcctggcttcaagtcatcctcctgctttggcctcccaaaatggtgggattacaggcatgagccacaagccacccctaaaaaatgaatatatttttcagatatcaaggcctagcaattttcctaggtcagcaaatatagtctcttctttctgtacttcacaatgcaacatttgatattgagtagatgttgtagaacattacgttgaagagcccaggttctagaataccaccatatagtttagatcttggctttggtgctcgatcattgtgactttgagaatattgcttaaaattttctttcctcagcttgtctcatttataaaataatataaaagccactctctaccatgtagtgtttttgtgcctaatatatgagtagtatggaattgaatcttaacccactagcatctgtagtatgtgctactgcagtatacgaaaagatgcagtagatttctaaattttggggggaatattgtgttttatgcacatgcgttctataagggaaatttaggaaaccatgtagtgcatgttttcatacactatatttgtactggtatgaagtcacacagacagttggaatactgtcccgaagatatataattgtttgagtcacagaggttcctacgactccattaagacagaaggtatagcctagagttggtgggtctgagacagtgtctccaaagtctgaaggataataactgaatatagactccaaaatttaaggcttcagcatcctcagagtccttgcatttgtgagagctatgtctgtgatgttgccgtttgtcaccaggatactttatgttgtcttttaagtgttaggtgtccagatgcagatcacctgcatcttgcctcatatgtctctctgaatgtaaagattttgcctacatctgatgaaaactgtccactgttcacattatttgtcatatgtatctgcttggagcagagtaagacacttctaagggaacttgacatttcatgacccaggatatcagattcatccttaccactagctactctctgaaatttgggaatttcgttggtcttatggaccacgatcatgagactttttagaaagatgaactaaaaaatcgctattcatgcatccatttattcattcatccacatatccacccatcataaacatttacttcagttacttatccttctgcagaagggagcaagctgaaaacaaagtaattgggggtacatctccaataaccctccttctggaagtggaatgaaactccctccttcccgtcaagtctctttacataagtaaattgtatagaatgaattgtgctcctccccctacccccaaaattcatctgttttgaaggcataacccccctgtacacctgattgtgaccttatttgtaaataaggatattgcagatgtaattacttaaggtgatatcatatagaagtatggtggatccctaatgtcatatgactggtgtccttataaaagggggaaatttggacacaaatagacacacagggaaaacaccatgtgaagactggagttattctgcacaagccaggaaaccaccagaagctaaatagaaggagaccttttcctagtgccttcagagggaacatggccccactgacactttgatctcagacttctagtcttcagaactttgacacaatacatttctcttgtttaactcagtttacgttactgtgttacagcagccctaacaaagtcatggagtaaactctgggattaatccctttccccaacatttcataaactattctttatctacttagcaatgcattttggatattcttctgtgtcagtaaatatgtttctatgttatttctaatagttttaatatatatagttatttcccaaattaaaaaaagttaatccgttcactttgatatacattaatatactaacttgtctctaatttgtattaatagttaaaaattctgcagagtggtggtgtaatctggtttacatttgaagctattgattgtacttgttaactttcataactgctattttatatacttatatttcatgttattataaagttcttaaattggctaatttttaaaaacaggaatgaataacaaagaaataaaatataatcattcctaatggcagttatttttcttatgtattcatgcctagttttcaccaatgtgcatgtattttatctatttctaatatacatatatatgcacacacagacacacacccacaatgttctttaatttgatttattacttaatatattataaatatatttgcttttatagtacctttatggaatatttggaatccccatacaattttccatcaaatatatatgctcaaaatattattgatgtaactactccccattattgaacatttagtttctttttagctttaagctattggaatttgtgctgtagaacctataactatcctaaccataagaaggataggtcaaaggttatgaaactttgttgatcttctgtaattattttcataaggattttccataagcaagatgatagtgaaattgactaatttaggttgacaatttattcttgaaattagcataaaccagcagtatacaaaacagtaatgtagggataagattcaatttaatgctacattttagtaatcagaattctgattttctgaatatattgtgtcctttatcaggtgaatgctttcgctgttgatatgaacctcatctttccccattcctgcaacctaatgctttgtctttaaattctctgtcaattggcactaatttcttttgagacgtgttttggaaacaaataagatttttcttagtttaccaacttaactattttttccttaatctccacttatgataataatcttgagaacaaaagtatttagaaatgccctaggtataaatcccgaagagattgagtataataagccgtccatggtatttacacttggaaagcaaactttgactctttgccctttaccacgtagacttgatgcaaaaatcaatgagatgttctaggtttatgaatttgatttctttttatctttttcacaatgaaggaaaacaaatcaaattaatgttacaagtaaacagatttccgagctttgctacctaatgctgaacatctacgtacttcaaagacaatatagaatctttgagataaaatggcatttttttcccttatgataactgatattcaggattggaaacagtttgcctcaagaaaatgctgctttgcatactataaaatgccggtgattactcaactcttgcagtgttagatctaggagggaactcaagagttattccaatttttttccatgcagactcaataatgacattgagagaataacttttaataatacaggtatctattattaaaatgaaaatggcagaggacaagataatatgccataatctgcttcatcagtgttgtgtgtgtgtgtgtgtgtgtgtgtgtatcagcaaatattttttcagctaactaataggtgatataaaaaattggggttgtaagacctatccatagaaacaatcataaattactagccatagaatttatttgcctccctttggaagtttatttccttttgtgattaataacaaacttgagggtaggtgtatgtggttgaatggtaacaggcacccaaggtttggttacgtgggattgcatcatgttgcttggcaccacccagctgagtctccaaacagctagtttggaggcatgtgtctcgtgggcatggagtgttaatttctcttgcagcaaaacagaaagcggccgactgagagagtggaggcatgggtgtggttgaagagcacacaggagaaaagacggtgggggaatatcatttttttggttctgcttctactccagtactggatgccataagatattgcctactgctatggacattttattttaaaaagtagtaggagtttcagtatgatttattcattgtctatagaaatcctaatgtggattatgttcatacacaatatacagaagtatagatattaaatagtcaatttcataaacataatctttaagtaattgtgagtcaaaaatattcagggtccaattacaaggaaaagtacaattttttaacaatgctttatgtattttatttgtcttgatccaaggtttataaagtagtttaaatcctgtgcttacttaacttttctgtttatttgccaattaatagagaggagataaatgaaaaggatcagataggaagaagggaagcagccaatattgtcaaactaacaatggaaccaattgtacctgtgatgttatattggcgagtacagaaatattgaaaaacatattaggatttcaaagcatctgttttgcatatgagtaaacggagggttatgagatttcttcactcattacatagctggaacttatacccaagtccttatctccaagtctaatctcctatctttcttcagctatcttctgggtcttggggccagatttagggtgtttgaagaattatttgtttgcacccttaaactcatttgaattttgtaaactcttaagtatagtaacttcacattaggtgttgcacttgcacagggcaactttggctaatggttattggaaatgtggagtatgggccttctagggcactttccttagtttttttctttttctggagtgaggtgaggctataaaaaatagacaatattaaagcatatagtcgtttatgtattcaatacttttctatgccaacagatcctctcagtgtactattatgcaccttattttgcaaataagtcaagagaaaaaccgttttttccatattaaggaatcatataggacaggcagggtttatataaaattctgatagcacttagtaaagcttcgttctccctaaagtgggtacaatagaaggtaagctttggaattttaagagtattcactgttcatgacactgtttatcctacatttgtcacatatcattttctcaggatatctgacataacctctccaagatatttggtttaaaattaattggcagtcaatggcaaagggtagagtcacttaaatttgctgaagcaagcacagtagcatctaccagagtatatgtcagattgttctcagaccgccaagggcaaaaatatgtgctgagggaggctgtactggtgccactgtgttggaggccttcttcaactcttaattagcttgctatgagtggagatgccatcttgactggctctctgggaaccattaggcagggccactgaccttggcaactctaatatttatctctgtggaactgagttgtgaaactaaaaggcactgcacaggtgtttccaaatattttaaaccagcaatggagagactattaatttaggccattaaaactaactaccaatgtatagagtgacctggtacaggacactctgcaggtatcaatctacctttgggtcagtagcacagtgccccttgccttctgccaccacattagaggcatcatttttatttttagcctggacataacagctggttaaattatgtgaggagtagctcttcttgataagatcagcaaagatgctagaagtaagactgactgtgaaatagctgcagccaactggcctctcagccatcattcttatctcctggataaataagaagcctgcaattacattttgaaaatctctaatagtcagataggcaaaacaggacttccatggactcaggttgaaaggtttgattgtgagttgtgatttaaggccaaaggaagagaaatagccaagagagaacagtatagataggagacagaatctcagtaatgaactagcaccagaaaatcttctgcaaagaatatacacaagaaataatctccaagacacaggatttaagcttctgcattttctttctattcctaacagtgtgcctagcaaccgctgatatagtacaaattttgctgaatgtcagatcgagagctctggaaggtttatatctgcaggagattaaggtacaaatatttccagattcgtttcagggtggcaagatcaactcacagcatgaggcttctgtcatcatagagatgctttgtggtactttctcttctttcgtaaatgaactggcaaaattgccacttgagtcaaatggaagaaggcaaaatgttgtgttagctgttctggggagtgagtggcatgtttcctgggccagatagtggatccatattcagtaaggggactgactcagtgctctttgtggaactagaagatcagaaaacaactgatcatgcttacgttgtattcatgatggccttgaaaagaaacatttccacccattatgttaccactatattgaacatgcactaatagaatagaagtggaaatcatcagcattaacacagattaattttatgaaaggtcacagccagattgtatacatggacatgccataggatggaccaagataaatctttaccatttatttagttcttcattgctctgggaaacctatattttgtcagttacaggaaatatatagctcaatggctaccattagtttgaaaaataacagaggatatattttggcctgaaaggaacagaggtctaatgttattgcagctgtaataaagaactaagcgcctgaccttatgcttgaaagagttaccaggtgaagacagagctgttcacttaaagcactcagattcagaagcaatccttaaaaacaaaacccagaggaaaaccatttaataaacaaataataaggcatgctggagaggcagttgtgggagtctaagtgtagtcaagtgtttccgtcttagtgcttgttccacttagccagagctctgggtcacctgggatttgggccctgggaggggataacagtgtgtacgggtttagcactggactctgctgtgcattcaacttggagataccataggccaactggagctcacaggcttcacagcttcatcgatttttagcttcagtgaggataatagggagccaaaacaagacaatttcattgctccatctctgctacctcatttctttttcctcagtatgcatttagacgttgcagagagttcatgggacagacaaagaaaaccctttgctgtgttcacaaatggtccaagactgaattaagaatcacaatgatattttctctattagttaatacattatttaactttatattatacattgagtatttaagttgttttaagtgctgttttacttgcatatattaagacaaatattacctggttgatttccacacagtggacttttaaaaaatcattcaatcaagagctatcttggtatgaaggtaaggaagcgacaagcctctgtggtagacattgaacttttcatattttggatatatctgtcctcttttttcctttgagaacacacaagagaatccttattattaatttgttaattcagaaacctttcttgagtaagctacatatttttataaattcacacttacaaatcaagaacctgatactacctgtaatcctaacaaataaaattaaatctttctcagaccccacgtgccaatattcatgattgtcccatgacagcgagtggtgcctttatcttttacaattattcacgcatcaagcttaagtattttggtaaatgatggagacacgctcctcagtgccttagtcctccttggagaacatgggaagaaagattgttcttctgcaatcataagcagactgtggccatccaagaatccaagtatattcttaaacaagcttggtctcaccaaaaatagttgaatagaatattgcccagtcatcaagaaatcagcaaacattttaagcacctttaaagtatgctgtgctaggcattctgatgggatacaaaaaatgtgaggatacattttaattaaataaaaacaatatgagtttctgtcctcaagaaacttataattgggaaaagaaaacaaagtacagtattcaatttcttcctggttcagttttgggagattgtgtgtccggggttttatccatttcttctagattttctagtttgtgtgcattgaagtgttcatggtagtccctgagggttttttgtatttctgtggggtcagtggtaatgtcccctttgtcgtttctaaatgtgtttacttggatctctgctctttttttttttaattagtctagccactagtctatttatcttcttaatattttcaaagaaccaattcctggattcattgatcttttgtgtggtttttcacatctcaatttccttcagttcagctctgattttggttatttcttgtcttctgctagctttgtggttagtttgttctttgttctctatttccagtggttgtgatgttaggttgttaatttgagatctttctgaatttttgatgtgggtgtttagtgctgtaaacttttctcttaacactctcttagctgtgtgccagagattgcgttatgttgtatctttgttcttattagtttcaaagaatttcttgatttctgccttaatttcattatctacccaaaagtcttttaagagcatgttgtttaatttgcaggtaattgtatgggtttgagagattttcttaggattgatttctatttttgttgtgctatagctgttgctacaattttgagttttttgcatttgcctgaggattgttttatgtccaattgtgtggtcaaatttagagtatgtgtcatgtggagatgggaatatgtactctgttgttttgggttggagagttctgtagatgtcttttgggtccatttggtcaagtgttgggatcaggtcctgaatatttttgttaattttctaccgcaattatctgtctaatgctgtcagtcgggtgttgaagtctcccactattattgtgtgtaaatataagtctcttcataggtctctgagaacttgctttatgaatctagctgcccttgtcttggttgcatatatatttagggtagttagcttcacttattgaattgaaccctttactgttatgtaatgcctttttttttttttatccttttcatctttgctggtataaagtctgttttgtctgaaatcacgatagcaacttctccttttttttctgttttccatttgcttggtagatattcttccattcctttatcttgagcctgtgagtgttatcgcatgtgaggtaggcctctcttgaagacagcatatcattgggtcttgctttgttatccaccttgccactctgtgccttttaattccaaggacatgaacagacacttttcaaaagaagacatacagtatgcagctaacaaccttatgaaaaaatgctcaacatcactaatcattagattaatgcaaatcaaaaccacaatgagataccatctcacaccactcaaaatagctattatgaaaaagtcaaaaaataacagatgctagcaaggttgcaggaaaaaagggaatgcttatacactgctggtgggaatgtaaagtagttcagccattatggaaagcaatgtggtgatttgtcaaagaacttaaaacagaattagcatttgactcagcagtcccattacaggttatatacccaaatgaatataaatcattctgccctaaatacacattcactgcagcactattcacaatagcaaagatgtagaatcaacctaaatgcctatcaacagtagactggataaagaaagtttggtacatatatacaatagaatactatgcagccaaaaaaaaaaaaagaacaagataatgtcctttgcagcaacatggatggagctggaggccatcatcctaatcaaactaattgcaggaacagaaaactgagtactgcatattgttacttataagtgaacacatggacacaaagaggggaagaataggcactggggcctccttgagggtggcgagtgtgacgaggtggaaaatcagaaaaaatatttggtactttcttattatatgcatgatgaaataatctgtacaccaaacctccatgacacacagtttacctatgtaacatgtttgttaacctgcacatgtactcctgaaccaaaaatgaaaatttaaaaaaaacaaaatatgaacaaagtcccaatgtaagagacaaatatcagttcaattaagtacagatattgattaaattggtagcaggaataataaatacttcagcagagtagaagaagaagaaatggccatgggctatcctggcctttaagataaatggaagaaaatgaatatgagcagtatcctgaaggattggtaagatttacaccaatttcattccgagcggatgttctagcatgcacaaaagtaaaagcaggaaaatgtaaaatcattaggtatgatgatgatagtagttaacttttattgagtacttgagagatcccacgtaatattgattaatctgcaccagaacatctaagacaaatttaagacatgccagtggaaaagcttagccacagattcgatgtaggtgataaaaataaagggaatgagaaagctaaacattgggagaaattagcaaaaactccaggtcttcaagactgggtagctggaagaacatggtatagatctactaatacgagtgtcttttgacagacctggtttacagagaagagatcagggttttgtatgatatttatttatttatttatttatttatttatttatttatttatttattttgagatgggatctcattcttgtctctcaggctggagtgcaatggcacgatctctgcacactgcaacctctgtcccctgcattcaagcgattctttggccacagcctccctctagtagctgggattataagtgctcaccaccatgcccagctaatttttgtatttttagtaaagatggggtttcgccatgttggccagtctggtctcaaactcctgacctcaggtgatctgcctacctcggccttccaaatactggaattgcaggcgtgagccatcatgcctggccatgagataatttttaatgaatttaatggaatgattcaagaagaaatattcagtaaacatttagaaagttgggaactgggattccagagaggctcaactggaaaaacacttaatagtcaaatgcctagggaaggtagcttcattcaccagaatgaaaccaaaaattgtgaacctcctttagaagttttacatctagagaaccatgaaacaaagtgaattttcatttatctttaagtccaaagagaacttaataaccctcatgtttctcatgatactgtccaaaatccacagatccccaggaaattatttcttgttttcacagagacatgcgtattaaagctaactgaagaaggcaaaaaggaaaacaaaatgactgtgaacagactaggtgtatctgttctgttcatatcctttgcccactttttgatgaggttgtttgttttattcttgtaaatttgtttaagttcctggtagattctggatattatccctttctcagatagattattagccctttgtcagatggatagattgcaaaaaattttctcccattctgtaggttgcctgttcaccttgatgatagtttcattgctgtgcggaagctctttactgtaattagatcccatttgtctattttggcttttgttgccattgcttttggtgttttagtcatgaagtgtttgcccatgcctatctcctcaatggtattgcctaggttttcttctagggtttttatggttttaggtcttacatttaagtctttaatttatctcaagttaatttttgtataaggtataaggaaagggtccagtttcagttttctgcatatggctagccagttttcccaataccatttattaaatagggaatcctttccccattggttgtttttgtcaggttcttcaaagatcacatggttgtagatgtgtggtattatttctgaggcctctgttccattccattggtctatatatcctttttgttaccagtaccatgctgttttgtttactgtagacttgtagtatactttgaagtcaggtagcatgatacctccagctttgttcattttgcttaggattgtcttggttatatgggctctttttttggttccatatgaaatttgaagtagttttttctaattttgtgaagaaagtcaatggtagcttgatggggatagcattgagtctataaattactttgggcagtatggccattttcatgatattgattcttcctatccatgagcatggaatgtttttccttttgtttgcgtcgtctcttatttctttgagcagcggtttgtagttctccttgaagaggtcctttgcatcccttgtaaggtgtattcctaggtattttattctcttcgtagccattgtgaatgggagttaactcatgatttggctctctgtttgtctatttttggtgtttaggaatgcttgtgattttgcacatcgattttgtatcctgtgactttgctgaagttgctgatcagcttaaggagatttggagctgagacgttggggtttctaaatatacaatcatgtcgggttttctaaatatacaatcatgtcatctgcaaacagagacaatttgacttcctgtcttcctatttgaatactctttatttctttctcttgcctgattgccctggccagaacttccaataccatgttgaataggagtggtaagagaggcatccttgtcttgtgctggttttcaaagggaatgcttccagcttttgcccattcagtatggtattgcctgtgggtttgtcataaatagctcttattattttgagatatgttccatcaatacctactttattgagagtttttagcatgaagaggtgttgaattttatcgagaacttttctgcatctattgagataatcaggtggtttttgtctttgcttctgtttaagtggtggattacattgattgattagcatatgttgaaccaaccttgcatcccaaggatgaagccgacttgatcatggtggataagctttttgatgtactgctgaattccttttgccagtattttattgaggattttcacatcggtgttcagcagggatattggcctgaaattttcttttttgtgtttgtctctgccaggttttggtatcaggatgatgcaggcctcataaaatgagttagggaggagtccttctttttctgttgtttggaatagtttcagaaagaatggtactagctcctctttgtacctctggtagaattcagctgtgaatccatctggtcctgggcttcttttggttggtaggctattaattactgcttcaatttcagaacttgttattggtctactcagggattcaacttcttcctggtttagtcttgggagggtgtatgtatccagcaattcatccatttcttctagattttccagtttatttgcgtagaggtgtttatactattctctaatggtagtttatatttctgcggtgtcagtgtttacatccccttggtcattttttattgtgcctatttgattcttctctcttttcttcttattagtctggctagtagtttatctattttgtcaatcttttcaaaaaaccagttcctggagtcattgattttttgaagggtttttcatgtatctatctttttcagttctgctctgatcttaggtataccttgtcttctgctagcttttgaatttgtttgctcttgcttctctagttcttttaattttgatattaggtgaacagacacttctcaaaaggagacatttatgcggccaacaaacatatgaaaaaaatctcatcatcactggtcattagagaaatgcaaatcaaaaccacagtgagataccatctcacaccagttagaatggtgatcattaaaaagtcaggaaacagcagatgctggagaggatgcagagaaataggaatgcttttacactgttggtgggagtgcaaactagttcaaccattgtggaagacagtgtggcgattcctcaaggatctagaactagaaataccatttgacccagcaaccccattactgggtatatacccaaaggattataaaccattctactataaagacacatccacatgtatgcttattgcagcactattcacaatagcaaagacttggaaccaacccaaatgtctatcattgatagactggataaagaaaatgtggcacatatataccatggaatactacgtagccataaaaaaggatgagcgtatgtcctttgcagggacatggatgaagctggaaaccatcattctcagccaactaacacaagaacagaaaaccaaacaccacatgttatctctcataagtgggagttgaacaatgagaacccatggacacagggaggggaacatcatacaccggggcctgtcgggggagtggggaagctagtggagggatagcattaggagaaatacctaatgtagatgacaggttgatgagtgcagcaaaccatcatggcacgtgtatacctatgtaacaaacctgcacgttctgcacatgtatcccagaacttaaaatataataaaaaaaaaatgccaggcgtaaagcaagcagaatctgtcagctccctttcattttagaggtctgtggagcatgttgtacaggtttgcattaattccttcagaaccagagaaaggtatcacttaatggaaaacattactgattgagaaatggtatggtttttttgaggtctaatgcaatattttgaatagagaagaatgtcagctcaaaatctaaaatgttatatgaatgtcaggagaagaaaagtggctgtatatgtttgtatatcatgtgtgtacttgagtgtatgtaggcctacacatgcacacacaaatacacacaagattttcttacgtttatccacatgataatggatcaagaccgtttgtgatggccaaagatgcacaaatttatatgaacacctaaattatgttaggatgggagtgaatggaatgattttcatcaccttaatactttgtaatgatcatgaaaggatttttgaaaaaaagaaaaagccctaatgatttttgaaaataataatagcagagggaatcccatgcaaaatcagtttgttaggcatgtgaagattttaagtaatgcagaaaagtaaaaaaaataccttccctaatggtgatgtacagaaacatgtttatcatcaatgcttttataacttttctctcatctcagtttctgttagagaattatgcataatggattgtgtatttaacaggaattcctcgattgcaatggctttttaaaggtttttttctttagttattaatagaatctttcatttacagcctaaatattgctgtcatcttagagaaacagtgaagtatcagagaggaaataaaatgggataaaatggatattcagaatgtcttgctacctgaccgttacttaaaacaagataccttttctttcttttcatgaaaacaaaactatttgtcttcactatccactctgttaaggaaaataattttctcaatatataaagtgaggcatagagcatacttaaggtaaactaaatcttaagataagtgaggccagagtaaaggagcaccaagcctcacttaaatgggttcatagatctaggctgcagtctgttactgttgaaacacatgatacttttacaaacataacaaaacaaaaaacaagaacattcaggtgtttcagtagaaaccgacagaaaagcgttttaggaatgctgtagattagggaaaattccagagagctcacagaacaacaacttcacttcttttgacttttaaagaaaaggtaaaagaataaattctggaaaatacagataccaccagaaacatttgtctgcccttgtaaattagggaatataggtttggtacctacagagtacaagacaaatgctcatcatgttgtgggggaagcaaaatttaaaaacatgtggactctacctaacctcagagagcttgcatgctaattaaggaattaatatgcaattataaattggcatttgacaagtagcactggaaaggcacagaaaaggtgatttattattcagagaagtggtaactttgatctgtggacatctagaaaagttatctctttggaaggtgagctgggtatcaaagagaggagactttattttaaaaggcaggtatggggtggagaaaactgtcaaaacaaagctatgcaggcagtataatattgcagcaagctgctgaatggaaaaaccaatttgatggaacatggttggatgtcagggaaattgggagatgtgttcagaagagtcagtgaaatttgactgcagatggtctatgaggaaggtgacgtgctacggcatggcgaagtgtgttgagtaggcacccggagactagagtttctgttagtctctgtcactcactcactgtgtgtacttgaggaccatttgacctccttggcaagtacacgtcttacctggaaaacgacggtgtctagttggagaccagtgtatcaactcacggtgattccatacagcaaatttttcttccaggtttggggtagatcaccaggttattgattaaacaccacacaaagtaattggcttgagtttaggaaccatgttttgaaaaaactgttatatctttaaagagaagaatcatcctcagcctggggagatactcacattatttcagagacacaagaactgaaacctcccatgagaatggtggactgggtttgtatgttccaactagcactcattccggggcatgtgctatctacagcgttctgtctctataggtatgttttgatgtgcttgtttttatcctttttcacagcacatatagtggaattcatttaaattaatatgtaagatgcatttgggcctttcatctcaagaacaagaatatggaaaccaaagttatttaaaactctagtcaaaggactgccttgaaataagtatcaaaactccaatatcaactttggcttcaaaaaggaacctaaaggcatttaacagtgtgtcctaagggatcaaatgtcaaatatgatggttactaacacacaggaagaaaaggaccagagctagaaaccagcagtaatatcttccagtatttttgggggagatggaagctgaaaaggatgaggaagagaaaaggatatgaacactgggtttcaaactaactttgctgaattatggaaagagaagaaatatttatttctgctgatatatcatgaaaagttactattaactgaattatttcttttcatttcactcttttctattaaactaatgatcaaacaggttggttctagccacttagaaaatgatgttgaatatgtcttgaaccaaaccagtagacgagttagtttaactgtatgaattaacaactaaagaaacacaaaatgctcatttttaccaggagttaaagctatgtgttttctgtaactaccaaactggaataaaaaagttatctcaataatcggtgtactgtatatgaattgatatctcatttaaattaatctacatcacaaaccttgttcagctttactcctgtctggccaaaattaatctttataatgaagtaccttaggtattttaggataccagtatgtattcaagtgagcgaataaaaattcagttgtctttgctaaaatttctggcatgtttagtgttttaataagttatctatccaaataggtattttaaggtattagtttcagacttccttttggtaaatgtgtttatatttgtaagttttaactggctagttttataacatatattaatttctaaacaggatttagagcaaaaaaaaacccaaacatactttgcttagtccacatttcactttacaaagtaccactggtcagctcagtgatactttctccagtttgtgggtcatttcatcctgcatttgtacaatgattttgagtaacacatcagtagtgaggccagctgattttgttatacccagagaagacttttaaattaaagcttgagaacagaaaaaaaaattactgaaaattgaggatcagcaaacttttcttgtaagtgggtaggtagtaaatatatatattttttattttataggcgatatgatttttgtcacactacttgcctctgctatagtatcacaaaagcagtcataggcaatgccaaaatgagcaagcattgatgtgttccaatattacttacaaaaatagatgttagactttcggcctttgggtctgggatttggcatttaggccataatttgtaaggaatttggccaaagctcatagtttcctagtcgttgctaaacatgacaggggccccaaatgaggtcccaaaatgagttctgaagaacgtttgtcccatgggattttcatggatgaaaaagtaaatctaggaaatgctgcacagaatgcctttcttcttacacactgaaattcaatgtcatcttattaaaggctataagacatcttacaataaagtgatctgtctctgttggctaactcagttccccagaacacatgtgaccttgaaattctttttgtcatagataatttgagtatctgtgattcagaaacaagtttccaaactgatcatttggatatctatatagattgtcatatgcatatctttattgaaatatctttttaaatccgagtcaacttcgtgagtcacttatccacaaaggtaaccaggaaaaatactaaccttcttaagtggttctggataatttcctgattagtcccttcttaggttctaacacattagctcctgctgacaatttgagccgttggccttattctgctttttcctcggtaattaaatccattgtagtttaaatcagttcaacatatatttaccatgtacgatattttccaagcacaccgattaatgaatgagagagaccgtgtctctccctttagggcatggatagtagcaaaggcataaagacaaaggttagaatattatgtgataacttctctaataagagaaatcctgaatgctgtcaaagcacatatgagaagtactaaactgttattatgaaatcagagaaagcttttagcctggagttcatctaagctacaaatttgaagctaatcacagaagggaagagagaggggaacagcaggtacaaaggtaaggagacaagattctctgatgtatcaaggcagtgcatagtacaactctaatatagatttatgctgcagagatgggtgagagttggattaagcaggtttttactgactttgtgaaagtatgtaaggtaggtggaaagttggaggcttgatcagagttgtactatggtaatatagctgtggctggaacgtggagaatggcctggaggggcacactgctcagaagtgagaatttctgaagctgttatgaagctttcccagggaatctgccatgggtaacctattaccccaggttcatcccttagacagataaggtgctgtcaagactcctaccttatgacaagaaaccaagagctacgtaatgtttttttccctgaaaccatctgtttgctagtgtaaacattaaactgtctttccatttgggggttactggaaatatcataaaaagggaataattttagactttttttaaaaacttgaaaggaggctttattatgtatttatagcaaaacaaaaattggcaccaagaggctagcctgagttttatacctgaaggaaatgtggaggcaaacctgggcattttccttgacaacagcaattaaccaagaagagcctcaccttaacgtctgttttaagacagcagaactggtcggcatatgaatatacaaacgtttaattacacaccctgcctgtccttgtgaacctctgtggtttacttacaaacgcatgagttatttcacgaagttatcctcaatcaggatgcagcatagtgttgtgtttactacatatgaaacatgcacaccttatccagtctgacacactgaagcacttaaaaggatgtgcagtaggtttttttataaacaagtagggtttttataaaccattttcttccacacaacaaattatactgttaacagctcggccctggtaagttttatatatgtgtgcatatataaattttatatatgtgtacctacaaacacacatacacacacaaacatataaaaatcacattttatatatgtgtgtgtatatgtatataatacatatattatttggaagtgtgatttctgtatttttcctgtattctaaccatatgaggaatgtctactcaacattgcttagaaacacaagttctaaggtccaaacttaagggtgtgtgtagtttagttagtggctgctatggttgttggtggagagtcagatgttgaaaagaaatggaacaaagttttttctaaacttgaaaatgctgtcttgaaatttgcagctaagatgtagtaaaagaggggctggtaggcaagaaaagaaaaactgtatgtaggcatggatcttaaacaaatcatgaaattgaattttcctaaagcaacttaaactatttatgattttctttgtcctttgccagatctctgaaatagcgtcagtctcaaaattcatgttatcactaattaggattctatcctcagattttttttgcagatgattcaactatttcttagtttccacagataactaaaattactacagtttctcctaccaacaataggcctagactgctaatccaaggaggaaatttgatgtcagaaaaagacacaaacaaagcaaaaatgcagtgttaacagttattcccacttttatctttctttacatagatctcacatcgcattgcaaggagcttacgctagtagtaaataagaaatttaggggaaacctgcatgctgcatttttagcatacaagaagtacaaaattctggctttatttttttcttcattaatatgcatggtaggccaggcatggtggctcacgcctgtaatcccagcactttgggaggccgaggcgggcagatcacgaggtcaggagatcgagaccatcctggctaacacggtgaaaccccatctctactaaaaatacaaaacaaattagctgggcgtggtggcgggcgcctgtagttccagctactcaggaagctgaggcaggagaatggcgtgaacctgggaggcggagcttgcagtgagctgagattccaccactgcactccagcctgggcaacactgcactccagcctgggcaacagagcaagattctgtctcaaaaaaaaaaaaaaaaatgcatggtaatcttggttcttttcatacctacgtttgaccgttcagcagtctaattttaattaaatcataacaaagtaacaacattgactatattgattgcatcttgggaattcagaatttattttttcacataatttttcctatgactagctggtcttctgtaggcaaacttttatgatccttgaactttttctggaaatgatgcagcaaactataaatataaaatctgcaatggtatactgtatgtacatatctttcaaggaggatagctccactgatgtaaaaacaaaaagatattaaaaactctgattttcaagctagaaaattatttatgcaccattggctttattttaaaatacatacttgcagaaaagttgcaaaaatgtcagcgtttccatacgcccatcactctgattctactaatgttaatattgtacgtaagtatagtatgatcaccaaaccagaaaactgacattggtataacactgttaactaaacaacagaccttattaggggtttaccagtttttccataatgtccaggctgcaatccacaatcttgcattgtttatagcattcatttcttcttactcttcttgagtctgtgccagttcctgagccttcgcctgccttttgtgatcctgacacttttgaaaactactagtcaatcttgttgtagaatattactcaattttctgatgttccctcctttttttttattgatgtcatgcattgttggcaaaataccatagaagagtattatgtccctctcagtgcaccctatcaaagggcacacgaggccagtatgtcttatcactagtgatactaattttgactatttggttaatatggagtctactgagttttcccagcatgatattagtgttttcccacattagctttagacaaagacacataaattcttaatttcctaaatatgatatactcactatactcttttatgcctcagtttccctgcctaaaaattattatactgcaaccctaaccctcatctcaaccagtgtagtaagaattaatgtgctgtcctttggagattcttggataaaactcactgtataactgcaaatgatcactctatctcattttaaagaagaacataaatagaatggttaaaagtagattggcagcatgtactcatttcacacccagaactacagagacatctgttatatatgtgacaggccaggcctgaaatctggttctctgagaaccagttagtgtttgcccgatttggcctaagtcagcctgattaaacaaagaacatatttatcacttgctacctaacaggctattacactaactagatggataaccacccattgataaggacaataaataactttttaaaaactgtcacattcagggtttctgctgttcatataagagggaaaaaagtcccttgacatactaaggattctggatccatgtgctgtaattctgtcatattagtttgtatctgataatgaagtaccccaccattgcagagaatggcaaacttcgcaaagtgatttactggctttctactctatttttatttttgaatgtcagtactatcagccctgacacaatacactgggaggaaattggccacttacaggtctagagggaagtaggtagggaaaggtatactaaagaaataagggactcacataatcctccaagccccgctttcctctttgacaaatggaaataatcatatacctgcctcctcaagttattgtaagcatttggtaatctgtccaaaacctttgtattgtaactgacccatagtaagtactcaagaaaaaaagaaaaaggttgtcatttttatcactttatcatctttcatacctgagacccagatttgggtgcaaaagacaagaaaatggaggtgaggctctcataaatagtgtggtttaatttgcagaaggcttctggaaaatgattttataccaaataagaattcaatagcatttgtcaaatggggtggaaatatcccaccatctgcatgtagtcatgaactaaagcatgatgatactgaggtgtacttctgctctttgagagtatgtgttcataggcaaataaacctagaaaatgaagaagaatgcaagctccatgatagcaggactgaactttaccgtgatacccagtgcttgctggtacagtgtctgacatattgcatgtgttcaacgaatattttcagatgaatgttctaatagttagctataaatacataatggcacaggatcttgaatacacagtttatttaccattacatgagatgggagatcccatattatagtttagctaaaaagtagggggatttcctgtcccaacctccacttatattgttattattattattctttttctttttcttttttttttttaagacagggtttcactcccatcacccaggctacagtgcagtggtgcaatcatggctcactgcagcctcgatttcccaggctcaggtgattctcccacctcagcctcctgagtagctgggactacaggagtgcaccatcacacccagctaactttttgtatttttagtagatatggggtttcaccatgttgctcaggctggtctcgaatttctgggctcaagtaatctgcctgccttggcttcccaaaatttggggattacaaatgtgagccaccatgcctggcccactccacttattttaagagaatgacttctgacttccttctaagtaaaacaacacttatattatgttccttttgcattatggtggtaaccattttacttgtgttatctcatatacttctctacaaacttctgaagtaggctcagtatctccgttttatggacacaaaactggaggatcagaaataacttgcctaaaacaatacaagtccaagacttgaacttaagtctatctacaaagaccatttatgttcttgactgatactgttgcatttgtgcactgttgcagccctcttagagtattatattatcttcccccagtagagtaaaataatctccatgagggaagaccctgtcttattcattgctgtatcgtactgcacgtcagttactagatgttcagtcactaatttgtaagtaaaggatagagtgccgtagtagattttatttaacaccctactttggtatagcctattacaacttcagtttttatgtttgaaatcttatttctgcttctgattaagcagacatagactcccttttaggctaccagttatctgattttctgatgtggctgtccgagcaatcagcaagctgtgcgtaatgatggacatactagtaagcttacttccccactaagtgtatccaagtaaaagccctgaaagtcacacggttcttgccacttttaatctgacacctaatatattaggtattagagtgttttgtgcttacctttagctcttctttagtttaggtgattaaaaaatgcctgttgctgtctgtatgtgcagcatgcttcattaacagtcatttatttgggaggttagcagaattggcactctgcagcacaccagcgagcagaaggaaaacaaacgtgagatgattgctaagaaatccttctttcctgctctggtgatagaagctttaagagtttgcaaagtttacttcccagtacccagaaagcatgggaaagagcagggtttctggggattgcaatttcccccaagtcccttgcatccgctctcctccagtgctcagtgggaaatccaaggggtcatggatttccccctttggcacggtgtgctccctgtatttgtggtctcccagaaccagatccttccactgcttgcccctcttgttttttccagcaagtttgccgactcaaactttttctagcagaatccaattatatggattttctctcatattcctttcaacaaccctgtattttcactgtcactttatgaaagaggaaagtgaggctaacagaggttaaatgacttgcccaagaacaacagctaaatggtagagctgggatttaaacctggcttgtgtgattctaaagccaatgatctcattgccatagggaagcaaaggaatttttattttacttgaaacctgtattgattttgtcatgtgtacttgaaatgccatgctgagaggattctggggctgcccttgggctaagcagcaaagagtgccataatcaattagcattgctttccataggagtgggacagaggagtggaggtgccatgtattttcctgtcttgaactatgatctacttttgttcttgattttattgtaataagactgtaataacacgggaatgacattctaaaggaaggatgaagtatctgaggggcaatctaaatgcaagatgaaaataccacatattttatatataaactacaattgcctgctgttctaataataaggctacatatacctatttgggagaaattcaacagagtgtttaaatatccacaatcttaagtcaaacttcataatctcaacttttattttaaattcagggggtacttgtgtgggtttgttacataggtatattgtgtgatgctgaaattaggaggacaaatgaccctatcacccaagcagtgagcatagtacccaataagcagttttcagcccttcctcccctccttctctctttgttctactagtccccagggtctactgttcccatctttatgtccctggatatgcaatatttagctcccacttgtaagtgagatcacccagtatttgtttcctgttcctgcattaatttgtttagtataatggcctccagctgcatccatcttcctgcaaagaacatcatttcattcattttcattgttgcatagtattccgtggtgtgtatgcaccaaattttctttaatccaccatcgatgggcacgtaggttgattctatgaccatgaatagtgctgtgacaaacatacaagtgcatgtgtctttttttttttaattatttcttttcttttttttccttttcttgtttttgagacagggtcttacactgtcacccatgctggagtgcagtggcacgatcttggctcactgcagactccaaatattgagctcaaacaatcctcccacctcagcctcacaagtaactggggctaaaggcaggagccaccacggctggctaacttttaaattttttttttgtagagatggtatccccctgtgttgccctggctggtctcgaagtcctggactgaaacagtcctcctgcctcagcttcccaaagtgctgggattataggtgtgagccactgtgcccagcccaatttatttttctctgggtatatacccagtaatggaatttctgggtcaaatggtagttctgttttaaattctttaagaaatctccaaactgctttccacagtggctgaactaatttacattcccaccaaaggtttatgagcattctcaggattcattttgggagtgatagaaatattctacatcatgatggtgatggtggttgtatgactgtataagtttttgaaatctcatcaaactatacataaaaagaacgcatgtcagtgcataaaatatacaataaacagggaaaatcagagaaagttctatctattacttattaatttcaacttagttaacccataaaattaaaatcatattgttgtttaccttcaaggtttttttaaagattatatgagttaacaaataatacagaaactactatatagtaaatgctgtttaaatggtatctattatttatcatttcaccagttgttttgtactatattctaccattacgttatctccaacattgtttgccagtttaatcacatacccttttatgttgctgatttactacattgtactgtatactctcacaaatacataagcttcatatgtatggataattgtgagaaaaatcatagctttgaatacatggctcttctgtgtttaactaaacaatgttagaagactagaaccattcatgtctgtttttcaactgaattgctgaagtgttaagtatctatatgtccaaataaataatacttattaaaaatgatggactgtaaggtgtgtttaaaaatattgaaagcattagctatgatagaatgtttaggatgaatttgtggtatatacttagaaacctgttattaaagaggaaataacagtaactcagaaaaaacaagtactataaaaaaaaaaagaaaagcagtatactctcaagctcagctaacaaattaccaaattatgtgctataactaagtttagacaacagtgaagcaaggtatgtttgtatttgtgtattcctgtctgtcattgggaatgattaagagagttgaatatcatcattcataaaagaacttagtacatatgacaaaaaaatcaagaaatagtagtataagcatgttattttttcaaattatcattgttgaactacttaacagaaaagcagtttgttgcccctggacaatatttacctatggggactaacagctagtatttaagctatgttcaagcattcctttaataaaagtaaaagttaaataaaactttaaaaaattacaataagtgattacttagtgaaggctgtggatagtgaatgtggacttgtggcttggagttaaattttcagtaacagtttaatacatagaatttaaaagcaatatatctaaaacaattttaatggatgggaagatgatataatccgaaaaattgttacaagcctcaaatggctctagggatgacaaagacatagtctttacttcatttaactaattaaatatttttggcatatataaccttcttcttatagaataatgtaattcaaagtttcaagaatccttaaaaacaatctggcccagtcccgtcttctattcatgaggaaacttgtccagcaagcaaataacagcactgagcctggaacgcagttattctgaatcttatcccagtgatcttttgaaatatcactgtgattattgaggttacttccgttttttgaagagggtcttctcggtagcaaaatataaaggtccaacatcaaaggtagaataaggttttctataaggggaaagtatattttgagaaatccgtagtgggtttatactttaagaaatttcaatgaaagacttttccaaattaatccgtataactgtggactctcgggctatggaagacatccttcagtaagtgaaatgatgatacattagctacctggcttttatttcagaggatttctgcctaatgtactcatatttatggttagaatcttcacaagtggaaagtcttttaaaatggggagcaactgtgtaccttagctgaccctccatcattcctcaaggtcctctttaatgtggtattatgatattatgatggaaacggtgtctaaatcaaccattgggtaggtgagtatggtctaaataagggattccatcctatacatgtctgcctcttgtttaatagatgtagcttcccgaatatatcatccaggtcccttatgtcttcccctcttttgcactgttctattcatattttcagatgcttgggacaaataatctaatgataaaaaccaattaacacatattttctcatcattcctagcagactacttactgcaatctccagtcaagtttgaaagacatcacctataggaatgaaaatctgtttttactggtagatagagtataaagctggttaaaggagaaaatccagcaagttatttgattgactgatgtgataggaattttcattatccaagaagaacctataggctagctactgtaatcacaggacatacagatgacctgaactactcatttgacatataaactatatcttgtatggtcaataatctttcctatccaattgagctgtagtgtccttgtgggcggagaccttgacccaaaactcttcatattttgcattttaccaattgaatcatggacattcaacaaatatctattgactgattgaacattaagattttactgtatgccattttcctttaaaattattggcatattgctttctgaggaagcctatttaatctcttgctttcatttctgtttcccgcttcctcgccattgtgattgactgcacccctcattagctaattgtagagttaggaaactctcaactctacagatgggaactgtggatgatcctttttaaaaatctctgccttcagaatggtagcactctaaataataactagcaagaaagcaaatgtttatgttgttcttacacttaggaggaaagaaacttattcacagttatgctatcacaaaagacttctgaattaacactagtgaaacgtagccttccgacaaagtctcagctctgaaacctgtgctatcctttacattatgagtattacagattctgcaccttggcttactggcacctggcttcacttctgcagaaggacaacatgaaaagccaagttagagagaaaggagtcaccatcaggatgttatctcacacttgaaaagacacaatacttttagaagagttcattacctttagaaactagttcagtatttgaagtatgaagacatagatttaaatactggctctattgatttctagatatttaaccttggacgagtttcatagcctctcatattctaattgccaaagctctaattttatagaggatgatgatgcctgactcccagccatgttataaggattaaatgagaagtgaatgtaagatcacgtggcaggtccacaagagatgttagctgcctttattctttcatttacatactagctgttgattggctgcctgctctggtggttcactattctatgtgcctctaaaatgtcaatcaagaatacaaagattcctaccttcataaagttaaaaatctatttggtgggggccaggaggcagaatttgaatccaagtttaaataaacgatgatagttaatgctcacatacaaaacaagccagtggaccttcacagcacacttgtaagaaagatagggcttctggcatgatccctaacctacaagcaagcaaacatgtttacagagattaagtgtctttcccaaagtgaggtaatttgtagtaaatccaggaagaactcagtgtgcgtgaatccgtgttttcccactctgtcttgctgctatgaggctttgaaaaacatactctgttggaagtattcttagtaattagagatgtagtcaacttgctaaccagaggagaaaagcaaaaaaggtaaaatagatattatgtccttcaggggattgcattttaagcagatcttcatacaggaaaataaaatctttttaggtctttcccttcttgaaagtcattctcaccctcctcgtagacttcagaatcaagtccagaattttttttttttttctttttttcagacggagtcttgctcattgtccaggctggagtgcagtgatgcacgatctcggctcactgcaacctccgcctcctgggttcaagccattctcctgcctcagcctccctagtagctgggactacaggcatgtgccaccacacccaactaattttttctatttttagtagagatggggttttgccgtgttagccaggatggtcttgatctcatgacttcgtgatccacccacctcggcctcccaaagtgctgggattacaggcatgagccaccgtgcctggcctcaagtccagaatctttaatatacgttcaaagatgattggagaccaggctcttgatttaccttccagcctctttccccctcagcctataactcccaaactcaggctgcgctgtgctgtctttaacaaagatagctatgacgtttcaactttgtgccagtacctaagctcagtgctttccatgcattctcactaatccttaccataagtttggcagatagatatcttgctgctcttttatagatggaccacacagctggagagtgggaagtctaggaatagagcacaagttagattctgcagtctacgcttttcattttcttgcactgctgtaacttaaaggttctcacagcttcttgccagtttgttttccttgtcacttggctcagaatggccttcctccctcttatttatcctttaagaatcagttcaaaatggtagcccctttgaggagctttcttgaaactcctgccctaccctacctcccagctcagttcagtgataatcttttgcttccttaacatcttgttcttaataaacttactgcacacattgcaccgaattataatgactggtttattagcacctcctgctaagtaaactgtgagctccttgaggacaagacccgcacctccctaacctctgcacacccagcacctagcaccgtgcctgccacatggtaaacacgattactttttttgttgagctgaattagtactgtttggataccagcaacattttaattcagcagagtgttcaaaacaaataaatacatgaccaggccctgcatgtagattcttggaaaccaggactcttaagggaaaactgattcatgcttttgttttcagcactttgtactgaggtcttcagtgtcactgttagtatgagaattgtttgaagggttgagggaagttttgttctgtgcaagaatgtgaaaaaaaaaaaaaaaaaaaaaaaccaccctgtacaattctcagttattcatctcctcctggctcaatgagagaaagcaatcgaggcctgttttattgtgtagcttccttcttaggatttacgagtctcattcttgggcaggatctcaaaatgagtgctgagtacactacctttgctacagccactgttggataagccagagagagctcacagctgcaggggagatctattgccaccataactcttggctcatcctgcagctttctttctgactctgacagaaaaattgaaattatgaaacttcgtatcctgcaccagagtcccacgtgagattcatgaatcttcagctcccttcagaaaaccggatgctttggttaccactgcccactgacaaattactgtccacgaccccattatttctgattagcaaaggtgaaccttacctacctgaatgtaaataaatgccaataggattcgtgaaattcttcatccttaaaaatctacagcccttaatagaacatgcactgtaaatactatcatatcatgaactaaatctttatcaggtaattggatacatttcctaagctaattttaattgcttccagaaactgcttaacattgtagatcaatcccgaggtccgagatgacatttctctcacaaaattaattattaataccctgatcatttgcttaagacattaatagttttcattgatcagcacgtcctgttgatctaaaatggcctaatcaccatgcatgtcagaagagtatctgaacatatccaattagagatacggccagctttctgccacatcagcagatccgaagttaagagtcccttttgtcttcacaatatattaagtccagctctatcagaaactaagctatttaagggcacaaaagaaaggcgagttctctaatgatgcttgttcattttctgttagctccctggtaaacatacaggctttgcagtgatcacatggtgtaaattaacgctaagagcccattattaagtagcttgtgttggcccatgttttcatgtaagcctgtgtttgctcacagtgtttttcttataagtgggagtaagatgagaaacttcaggttattttcagcttaaaaatattggggctcccacagtgtgtacatatatcaaaatatcacattgtataccataaatatatacaattattatttgtcaatttaaaaataatataaatgtaatatatttttttacatgaaagctaaaataacaagttgagaccacagtaacatctggcaatgtagggtgctgcagagttttcaaagaagtttcatttacttaaccaggagttttcccttgaaacaagattcaaagagaggctaggtggagtggtctacctaggaccacataacaagttcctgccagagttgtaaatagaatgagatctcccggttccataaatttctggtttatttgattgactgatgaataggtagcactctgctcatctttcagaccccaagggaagctcacctcctttgtgaagattgccaaacaaaaagtttcctccttccttgataacgggatatcatattgcaattatatgaaattctcagtaacagcccctactggataaagagactctagaggatagagactgtgccttgttcctcttgatgggcccagtgcttcaccttgtgtctggcaagcagaagatgcttcacatatacattcacacatggcgggctggcaggatgggtgggagaagggatgagtggatgagaggaaccacagttgagagttctgttttactaacttcatgttgcaatccttcagcaccagagggaaatttggctttacttgagtcatacagtgtttaatttttttttttctctgagacagggtctccctctgttgcccaggctggaatgcagtggagtgattatggctcactgcagcctcgaactcctgggttgaagcaatcctcctgtcttagcctcctgagtagcagggactataggcgtgcaccaccatgccaggctgatttttaaaaattttccgtaaaggtgggggtctcgctatgttgcccaggctggtcttgaactcctggcctcaagagatcctcccatcttggccttccaaagttctgggattacaggtgtgaactactgcacctggccttaaaaagtattttgaactaattttcaatacttaaaacttaggagattttcaaaatacagttatattttcaacttttctttgaaaagtcgtagatgcccctgcaaccctggatctgtgttccacattacccatctgcttgagctgaggggcacctgttcccttaagcaaggacatgcctccattcctcagaataacagtgtctgcccacagcttcactcagttactcactttgtagcttttggtaaaggtaatgagtggcctctcttcactgcagaattctcctaattcagtattcttggctaacagaagtattagtgttcctaatcatgttctggatatatccaaatgaacctagtaggcagctactgatagctgtttggatttctctcattagacactggagctgcatacttctgtggcatgttagaagtgaaacacggggcagaggggaaaaattgtttgagttaatggggtagtcaccattttcccacacgatataactccattggaaaaattgggaatttctacctgaggtccaccagtgttaagcctatcttgttctgtggcagttctgtatttgctttttttttaactaattggaaaataaataagaacaggatctggacaaagagagaccttgcaaagcatagtgcattcccctgccttcaggttggttcatgcctaatcagaaactgttcttgtcttcactcagaagccacagggacacttcagctccaatccctgcccaattattatctgcaagaaaaaaataggagtcttattagctttatattcataatttaacatgtccctttcttcccctccaatggtactttcccacaagtgagttttattgatatttgagtaaagataaacttgcagagaccacaaggagaaatattcccaaatctcattgtaatgtctcttctttcccacagattaaaggttatacaaaacttaaaagaagcagcaattctattcgcttgttattggacttgaaactccctttgacctcggaaactgaagatgaggttgccatgggaactgctggtactgcaatcattcattttgtgccttgcaggtagagtgtcattttaaaactttttgatttagaaatgccactgtatttcacactaattcaaaagtgggccttcactttagacggcaatgataaaatcgcaagagtatatgctgctatgactagcatttgctgacactgttgaatataccttcctgatggtcttttagtgactcttttcatggtgttgtatccagagatagacaccgatgtttcacctgtctatctggtccttttagagtcgtttgagccattatttagtttgaaagttgttatttttgctcatcccagtgcccagttgcacagagatattgggcaataaaactgataatatagtctggagtgttgcctactttcatttcagtggatggacgtttatctggatagctctttcagtgtctttgttgataccactccatcttctgatactgactctctttttcatttcaatgtactacagtttagtaggaactagaaagcaaaacacaggaggtttttaccatatactcatggccaactactagaaaagggatttggaaagttcaaacatggctgggcgcagtggctcacaccattaatcccagcactttgggaggctgaggtgggtggatcacccgaggtcagaagttcagaccagcctgagtaacatggcgaaagctcatctctactaaaaatacaaaattagccgggtgcagtggtgcatgcctgtaatcccagctactcggggagctgaggcaggagaattgcttgaacccagaaggcgaaggttgcagtgagccgagatcgcgccattgcactccagcctgggcaacagagtgaggctcggtctcaaaaaaataaaaaaagaaaagaaaagaaaacttcacacatactctctattgctttctccattttctggaagatatgagtctagcagttgacatacatcattcaagtgctggtgcatcagaagtccagcatgcagcgggaattggtttgcagcttgggctgctgtgtatcattccacgcccctttgaaattagtctagttgacttgttttgttattcagagtgtcaagtccaagagggacacctgaatatatttgcatttttacaacatgaagcaaaaatgacttttggatcaccattactttgatgtatgcattcactcaaataatgttactgagtaccgtgtcacaagccagccctgtactgggatctgggaatataatcctgatcaaaacagacatgctactgctctcttagagctctattaactgagtgctgtaacttctgacaacttgttgtagtagattatttgcaattgctataaaatcaaaaataataatggtagtactgacatgtatagatcactcattctatgctaggcaatatgctaagcacgtggtatcctttatccaatttctttcttccacgacccttaagaagtaagcatttatcatttatttcactgtattaactatgaatattaatattatgactgaagcatcaggaagttaagaaactcacccaaattcacaaagccagtaagtggtcgagctaagatgtaaaccgaagccgactatagtcttgcctgttcatagcgtatggtcttttagttgtcttgaggatttggcaagtttatggttgcaaatttagttctgagatttttgttttcattcttcctatgtttttctaaatgtaaaccctcatttacttatacatcttttaatagtctaccttcatgtttcaaacttcttgccttagttgagttcacgtcttccccgctgcatgattgtgaacatcttggcatccctcttagtgatattatttatttcccccatctggtcagagccttcatcttcctcccagcagtatgcccaggctctaatacctcagttgtttttctctgggaccttgaccctcctaagggattcgactgacactttagagttttaacttctcataatgactctggtataaacgtactctttaagccataaagcagtgaattgatttctcatatttggctacagcataatgtttatttaacccaatgtgctaagtaaatatcaagatatgaaagggttaaaaatcaagaaagccactactctcttcagtagtgttttgaaaaacttgggggaattctcacctaaggtgtgtgtgtaactgtatctattttattcacttagctttttatagagaatcagtgtattgattgtttttgtgaggcttttttgtgacctgttttacacggcattaatattctcttaccatatgccttcttcagtgtaggaaagtcaagctttaattaatgtttttgttttcttgctatttgtcttgatttcattaatttacatagcactccactcgctgaattttgattttttaaactgctttaggccaggcatggtgtctcatgcctgtaaccccaacagtttgggaggccgaggtgggtggataacctgaggtcaggagttagagaccagcctgaccaacatgaagaagccccgtctctactaaaaatgtaaaattagcaaggcatggtggtgtatgcctgtaatcccagctacttgggaggctaaggcaggagaatcgcctgaacctgggaggcggaggttgcggtgagccgagatcacgccactgcactccagcctgggcaacaagagtgaaactccatctcaccaaaaacgaaaaacaaaaacaaaacaaaaaactgctcattcttttccttttgtgtatcatccataacttttctatacatcttcaggctgaggtttcttggtgagtttttggtaagggatatgtttacagctgttatgtttaccataattagtgactctcacatatgccttttcctgatctttttcttccccaagtaagacaggatccaaatatacaagcaggctcatcctgcaagggatgcaactgataagatctgttaattatttgagggcatttattagtactttatggtacaatgggaatgttctttttcgccagatgactcagtgtctggcaataattttcaaataaaccaaaactattgatgccagtaatctaaaagttcagccacaatgaaaattggcttcattattcttcttcttcaccaatttaaactcaagatcataaaaccctgctacctaaaaaagcaaggaagctaacaaatgagtaaaatgttcttacagaagtaaaagtgtacagtgcaacagggaatgttagtgactatggaaaactagaaaacaacatgccccactaaaatattaatctgtgcccggctctactcctttgtgacaagtctcccagtctttttttttcaatctacaaactcctaattctctaggatttccataatgttaatgaataaaatttaaattggttttaaaagtaaaaataaagggcctgtataaagcaaaccaaaatggtctgcaggctagatgcagttcctagtccaccactttgtgacactttatttcaaatgtttgctttacaataaactattagtatattttaaaataggtagaagagaagaagtctaatatttctaccataaagataaacaaacatttaaggttctggatatcccaattatacagatttgatcttttcaaattatatgaatatgttaaattatcatatgtatccccaaaatatgtacatctattgtataaaaataaaaagtaattaaaaaaaataaggccaggcacagtggctcatgcctgtaatcccagcactttgggaggcaaagcgggcggaccacttaaggccaggagttcaacagcagtgtggccaacatggcgaaacccagtctctactaaaatacaaaaagtagctgggcatggtggtgcacgtctataatgtcagctgctcgggaggctgaggcatgagaatcacttgaacccggaaggcagaggttgcagtgagccgagatcgtactactgcactccagcctgggtgacagagccagactcaggaaggaaggaaggcaaggaagaaagaaatgataccgcatacacttagaccttagggcttttatactaactttcttttgtcaagaatgctcttgccttaaatgtccccaggacccaccgtctaaccttctttaaatctgtgctcaaatgtcacctaattggtgaggcttttcctgaacacagtaaatacattaaaatggcaatatttattttgaccaatatcttctatgctttttattgcttgatttctcctcaaagctctcatcaatatctgaataatgatatattttgctttcttcttcttcttttttttttttttttttttttttttttgtgagagagagtctggctctgctgcccaggctggagtgcaggggtgtgatctcggctcactgcaagctccacctatcgggtccacaccattctcctgcatcagcctcccgagtaagtcttccaagtagctgggactacaggcacatgccaccatgcctggctaatttttttgtatttttagtagagacggggtttcaccatgttagccaggatggtctcgatctcctgaccttgtgatctgcccacctcggcctcccagagtgctggaattacaggcgtgagccaccacgcccagccgctttcttctttttatacaaaataactttccctactagactgtaaggtttatttgggtagatatttctgtccttttagttcactgctgtattcccagcatccagaaaatgtctggcacatagtgcaattcaataaatatttttcaaatgaatgaatgctgcagcctggccagtcatgagagaaagagactagatctccagtttcaagctgtgctatagaccccgggtgctttgtagtcaccctgataccaactctatggactagcaatactatgatgctaatccatacatgtttttcaaaagtcgatgtaaatatctaaagtattaaaattggtctgtgtgccttgaagtctatatcttggtgcaacactgcctctcccatttcttattttattttatttttgttactgtttttttcttttttttttttttgagatggagtcttgctctgtcttccaggctgaagtgcagtggcacgatcttggctcactgcaacctccatctcccaggttcaagcgattctactgcctcagtctcctgaggatctgggattacaggtgcctaccaccacgcccagctagtttttgtatttctagtagagacggggttttgccatgtgggccaggctggtctcgaactcttaacctcaaatgatccacgtgccttgccttcccaaagtgctgggattataggcatgagccaccacaccaggtcacgcctcgcccatttctgactttaactatagctggggtagaactgttcccctgttgtatttttctgcctcaagtctttatctgagtcacaagcaaggagaactatgggaagttaaccccgtccttaggggcagccttcagctaagagggcatgagaatcagtagataaatgcctctgtctcctgtcctttgggaagtcaattctcaggcatatttaacatactttcttaggggttcaaggctggattgagtctcagtttcccacaataactccttctacttttttcttctttacttctgcttcttggtatcacctcctaaataaactaaactgcttggaagtcctgctcttagcctctacttttaggggagtccaaaccagctaatagcagagaggcagcttagttttggtcatgtcagtaattagaaagaaagcaggtgggaaaaaacagctttaacagagatgattggagagttgactgtgtatgtattaatagatctatatatgtatgtgtatgcatgtgtttgcataatacatgctcacaaaccactgtgtagttatatctataaatattatctgggtcctgcaattagggagttttactctttttagtatttgcttgttttattattaaccagatgttgagcaagtcattgtacctaagattcagcttatacttctgtacaatgaaggagttgaacagatggttttagagtcctgttcaattccagtaatttacaattctatctgtacacatggtttgagaggaagatatgtatgccgatagggttagagctcagcctggaattctattcaactaatatgaaatttcacataggtcatatgctttaccatgtgctattgattctgttcacattggcagcatttgaaagaaagaagaaaatggctgctccatatgtttacgtgcagcaagaggcgtgaagacatttaaaactctctgtgaatgagcgcagaaatttatgcttgatacattctcagttgatcttggtttcaaggaggctaaatttattcccatctctgtggtgcagtttaccaacttcagcaattatctctttctgagaaagtgcatcctctccaaatgcaagcatttgttgatttgctcacaaaatctatgtcgttattatatctgcatctgggggcatgtagtggagaaagatcctgtataattcacaggagacatattctgaaatgggtgaatgttcacaaaaagtggagcaaggaagacccctggattgaatcatcaatcacaggatgtagcttgaatctatgatagacaaaaatatatacaaacctgcaatgagaacacatacaaagaatgctcattggtcttcagaaggcttttgaggctcaggaagtctcatcactaagactgaagtaggctgtctaaagtttgggcttattctagttctgagagcaaaaatacacaaaagaggaattcccagtatttgttaatgttgatgaaaggactccatgagcaccatttttctatctactcagaatatttcattaaagctcatgaccaacccagaaggatcctcccttttatccccaccaggatggagagcacacagtagttcatttcaaggcttgacctcactgcacagcaaggtataatatttcaattcccaagattctcacattttcccccagaataaacagagacacaggcaacagtcaaataattcacaattctacccatgtattaaacctagtactactctgttcttgcacaagtaacaaatattcaattaagaccaaaagagagctgagtgttagttttcatttagttactgcaaagcatagtcctgtattttattgtttctctttgtaagaaaatgacttgccggtgtatttacaatcatgctgaccgaagccaaagcctgggtttcctgtttgctctacgctctctcataactatggccataaaatgaagcccatgtggtagaaagacttagtcaagaagacagctaataactagattaaaaagcagtgactccattgatgaaagttaagaaaaaaaataggggaagtatacttagaaaataataaatagcaaatgcaaaacttcttttcaacataaatttaagtatttaagtccatagtgggaaaatgttaatcagtaatgaagatgttgaggtaaatagaggaactggcagcgattttatatccccataggcatggacatgtagtagcaagcacacaacccaaaagttattagaaatgttcaatttaagacctctcctgaagtaaaattgtgaatgggtccattagatatgctcagccatgctggatgtcttaactataagtaaaactcccttactgatagagtctagggcgtattgtatctagaaaaaaatggaagaactcttttgaatgaaacaatttaggaagacaggaaaaaaccagacaagtgaaaatccaattatgtgtacctaacgtcaacctgtgtgatcattctctgtttaaatgtgggatcagtgatgctgcctcaaagcttgaggatgacgggagcaggaacagtctggcagttggtatcatgccaaaaacaccagctggagacactgcagagctggcggttgagaatatggactccgaaattacatagataggtctgccacttatgagttgtgtgataaaggtacatcatctccctaggtcatgggtttctttttttttttatctgtaaaacaggcaaaataactgtatttacttctttaggctatctgtgaggattgagaacgtgcatatattctttgcacttagtgcagcatctgatactttgcaaacccactgattaatgagctattattcattgagtaatttaacatatgttgaaggttccaaatgtgggaactatgtttaacttagaactaagctatttaatatatatgttaaatgttaaatatatgttaatgtttatgttaaatgttaaatagcttagtttgaaggtaaacatagttcctgttatggcaatgataatgattatggtgacagtgatgttgacgatgatgttgccatattagtttcttagaacattagtttctggccattcttcagtggttgaaggtgttagaacagggtttacagcacatctggaccttatctatacaatggtgttacaataataaatacctatgcagaacaaatacctaaattggttaagcttgtatgtgtgtgtgtgtgtgtgtgtgtatgtacatacatgtgtatgtacatgtaattgtgggtagagcactcaggaaggtctgtcttagtacaggactaagtaacagttgttattaatatcagttaatatcaggactaagtatcagttgctattaatatcatcattagcagcagcaacaacagcaaaccagtggtgttggtgacagccagaacatttagggtctgtctcctggcagcaaggcagctaggacaagtgccaattagagacatccatctgggggcctggcagtggcagagagctgaggaggtgtctataatggtacttccagtagtttatcaagttgtaagaggatagggttccaaacagagtaggatccagtggttcaaaatgataactttgtaaatgcattttgcaacaacaactaacataaagaaaatagcacgtaaaagcccttaatgttactgtactggaatatgctgcagcacagactccattttccaccataatcttccattcctctccacacgcaaactccccttgctgattttaatcagatatttcacctgaatgaagaaactttgttggatgatgtagccccacttaataatgaccttaattcatttagtccttgtgagtctataaagtatttgcttaacagtctatttaagaaggctgttaggaattagagacaactgcaataataatagtaagagtaaaaagttattgggcatttatatgccagatacagcacctcagttttgtatgcactatcacccttaaactcaaaacaaccctctgggagaggtattatcctaagttcatagataaggggttacatgacctaccaataaaaccagagcttgtagaagtccaaggcagcatttaaatttaggtctgcccaggtccaaagcctgggcttttaattgtcatgctatgatgataactattgaaattgagtacctgtcttcataaagcttaccatcttgtaaaatactctgaaccaatggttaccaaaatttagttcatgaaccagcagcatcattgtcatctggcaacttattagaaatggggattttggggctcaggcccagacttacagaattggaatctctgcaggtggggttgtccttgttttaacaaggcctccaagggttgtgtttctcaatcttaccagcctgggtttctactccaagaagacaaggagagaggggaattatttctcagctaaagctataccttaagtactctgaggtcagaccagaatccatttagaatccactggtctgacctcagagactttaatatataaggggattctgatgcttaagaaaggttgagaaccacattaagcactcttgaaagacaagtaaggcagaaattatcagtatcccaattttacatatgagaatctgagagcacactaacatggtcaaggttatatggctgacataaacaaagctggactctagatgtattagtcatggttgactcaaagaataaggtaaatactgttttaacacatcccctttaagacaccttcatagaggagagaatgtcagagtcttgtatttagaaaaaacagtgaagaccagttttttttctcttgtaaagtttttccagagaacctgcaaattgcattgaccaaaacagaagtaatttgcacacaaatgttcataacagtattattcataatagccaaaaagtgggaacaatccaaatgtctatcaattgataaataagtaaaaaatgtggtagtcccatacagtggaatattattcagccataaaaaggaaggaagtactgatactacaacatggacaaactttgaagataccgtgctaagtgaatgaagccagagacaaaggccacatattgtatgattccatttatggactgtccagaatagacaaagccatagggacagaaagtagaatagtattttcccagagccaaggagtgagggaggataaggaacgactgctgttggatatgtgatgtctttttaggctgatgaaaatattctggcattagaaagcggtgatggtcactcaacctcgtgagtacactaaaaatcacttaactgtacattttaaaaggctgaattgtatgatgtgtgaattatatctccataaaaacaattaaatattctgaggagaaaaaaagtactactgtctcctgagagacactgtctgctgtcaggaagttagagttgctcagagccaaattccctgatacatgataaacagaattacataattatagtcctatcccagttctctcattttacacacaagtacactgatttgtccaaagtcccacagataatgagtggcataatcagattccaagtttcccaaactgtaatcccaatctgtcttccactcctccgttatggagcttccctgttgtgtgttttatagtcatggaaggtggctgggattgggggcggcggggaggggcagtcactggtctcttaccaccaccctgcccagcaacaatgtgcaacttctttaattagagaaaaggaataaagcacaaaccttcctcagagagtgaactctctcatgttaattcacctgaggtgtgatattggattccaccccaagagcagggagacttaagacttctagagggcaaaggagggcagcctctgtggtgtgagagtgatcttgaagatgcaggataggcagtcacttcacctattttcaattttgtcctagattggcatccctaggaagcaggatatcttttcatttcctgccaaacctcctggtggccaaaattaaaaatccatattgagtcagtaattaaacttccccctacctgagggttatgtcccagaccaatgctttaaaaagagttctgatacaaaaaaaaaaaaaagcagtttaatggagaaagactatctgaagaaagaatgatgtcaaatagatttaaaacgtatgaatgcagcaatatatatgttgcttgggctgcataagtaaaaagagacaaaaatcaatctaaactccccagtttcaactatattgtttccacatgcgtgacatctataccagaaaaaaactaacaaaactagaaatgcattcctcttggaatggaaacaaatgtcaaaacaaacaactcaggataaacttgagctagagaagaaagctttgctctactcttttctaaggagctttgaagatctggccatggttgacataacaactcattgcagcagatatgttacttcaacagggagcatttcacagattgtcaaagttgtcttctcatcccatccaacctatcttgggggagggtgagaaaaccgaagagcaaaaagattaattcatttgcccaagttcacatggctaagtgctttcagatactgggaatgtttgatttacttgaatcaaaatagtgagaatgtcttcctgaattatacttgataatggttttctagttacattataacatgtctaagctctatataaatgaaaatgaattttattaagagtgttttagtatttgattggctttgtcaaaagatttcagatagtggttttggggaacttggtgaatgcccatgcagtttttgatacagtggcaaagaatatttgtagaagatatgactttttaaactctagaacttataattcctcagaaaatatttacgcattctttatttattaatttatgaatgaaataactgttcattcatttaataacaatttgttaaacacctatattattgggtactgatagatgttgggtgtaccgagatatctgtgatttagtccatgaatttaaggagtttataatcttgtgggctgacacaatttgtttcaaactctgttctgccagatttaagtgagaaatccaggcaaaatacaatgtttctgtcaatgaaccatattgttacagtatcagaagctactgccttggtacagcccacagtggataagatcatggtcctggggctgagaaaaatctgggttcaaaacctacctgtaattatagttgctcagtgtatgagcttgaggaaattgcttaattctctgagaaaacatttaaaatagcccagtaactgccctatagtcagcacttaataataatgtctattgtagtcatttattaataacaaaaggccatggcctcctctctttatcgctgagctccaatgcaagtaaaacacttccatctactttaccttcaatgggtcctaacttgcatagtaggaataaagaaaaaaggaaaattgtgggagtaggagggaaagagagaatgccatgagccgcatgccttctggcctttctgtcattttccaggtatctattcttccaagtaggagggtcaaaagtgattgtgtttagttttgttgtaaagttgaccaagaacggaataggtctgccgggcacagtggctcgtgcctgtaattccagcactttgtgaggctgaggcgggcggatcacctgaggccaggagatcgagaacagcctgaccaacatggcgaaaccccatctctactaaaaatacaaaaattagcaaggcatgatggcaggtgcttgtagtcccagctcctcaggaggctgagaatcacttgaattcaggaggtggaggttgcagtgagctgagatcgtgccactgtactccagcctggatgacaaaagcaaaactccgtctcaaaaaaaaaaaaaaaaaaaaaaaagaataaaaaaaagggaacaggtcacaatttccctcactatcaaataattgtttgcatttaaggggaaggaggaagaaaacaagcttgatgcctattttgtttaattatattattctcagggtaaaactgtatcttgttctctacagtggtaggtaggtaggtagatacgaagtaggaaggtaggtaggtaggtaggtagatagatagatagatagatagatagacagaaaaaaatgtatataagcacttttttctgtatttttaccaagtctgttgggcaatctgttgatatttgaactagataattttaaaaacagaggaaaatactacatcactcacctaatattttgtcattaactacaaataattattattttaactgatgtttttacatcaaaacatgacttaaaagtcctaagcaaatttttcactactgatgatggtaatgattaaaaagtcaggaaacaacaggtgctggagaggatgtggagaaatagaaacacttttacactgttggtgggactgtaaactagttcaaccattgtggaagtcagagtggcgattcctcagggatctagaactagaaataccatttgacccagccatccccttactgggcatatacccaagggattataaatcatgctgctataaagacacatgcacacgtatgtttattgcggcactattcacaatagcaaagacttggaaccaacccaaatgtccatcagtgatagactggattaagaaaacgtggcacatgtacaccatggaatactatgcagccataaaaaatgatgagttcatgtcctttgtagggacatggatgaagctggaaaccatcattctgagcaaactatcgcatggacaaaaaaccaaacactgcatgttcttactcataggtgggagttgaacaatgagaacacatggacacaggaaggggaacatcacacaccggggcctgttgtggggtggggggaggggtagggatagcattaggagatacacctaatgttaaatgacacgttaatgggtgcagcacaccaacatggcacacgtatacatatgtaacaaacctgcacattgtgcacacgtaccctaaaacttaaagtataataaaaaaaaaaaagaaaagtaacccaatacagagggggagaaaaaaaaaaaagctaatgaggctagctaggctcagtgtttctaggaatgatgtaactagaaccatgtgacttttatcatatatttcatcaatgaagataataaatgcttaaacaagataattaccatcctccttcctctctgttaaatgcttcaaatacattatataatttatactgggctcagagtagccctaatatggctaatattggtacctctgtacctctgtattatagatggggcaactaaattgggtcaagtaagtggctgaaggtcacacaagcatggcctccccagaaccagatacttcccacctactttgtcctagtcaaccttagcttccgaccttactgtgttccttccagtgcaacattctccatttttgttgttgttgtttgttgttgttgttttgtttgttcatttgtttgtttttgagacggagtcttgctcttattgcccaggctggggtaaaatggcacaatatcggctcactgcaacttctgcctcccacgttcaagcgattctcctgcctcagcctccagaggagctgggatgacaggcacccaccaccacacctggctagtttttgtatttttagtagagatgggatttcaccatgttggccaggcttgtctcgaacccctgatctcgtgatctgcccgcctcagcctcccaaagtgctgggattacaggcgtgagccaccgcctgcacccctccaccaacactcttctttttatagtccctgtgcggaaactcaaaccatttgtcccctgtcccagtgcctcttcagtctagtccttcaatagcttcctcctcagttactgatttgctacatgactatggagacaaccagattaaactgtgtagatgtcatttcccattgctttatttctgtaactgcaaccacactgtagtgatttctgctttccctcaagaagacaactgtcctccaacacccaacattttatctctgaattgttaccttatttactctgcagcccctacagtagcagtcattatgtctcctcctgacctactctggtatgttctttctcccttcctccttccctcctttgatttttcagtctaattatatcttagcttagaatataaacttttagctaatgaaattttcttcaaacatgccttcaaaccccagctgttcatttccctctgagttaaaatgagtaaagttttgattatgtttgtttaaaattcactaggctaatatatccatatattgaatgtattccatatacattatcttctgtacttctttaaaggcaaatgtgaaattctctaacaaagtctttcctataaaaaaatatgacacaccactctcaggggaattatgataattcaaagaacaaaccaaaccaaattaaactcacatcttttctgagcaaaagagtaaataataaaaatgcagaagtattgtttgttagggtcaacagcttttgctagaacctgatgtgatattctgtatagaattttgttgggaagttatgaagtactgataagacaggcaaatattatttgcacacaaatgatccttgcaaaataaaaattttcaagtggagataaattcttccttatcctctttagttcttcagcagggttcttggataccgtctttgggaatgctcttctctccaatgttgtgatatttacatgaaaactttggttttaatgtaatatttatctaactagatataaccagacttgaaggtgattctctagatttcttgtacctcccttatgatttcagctatgcgctcgattcagttgaatttaagaagattatcaatggcatttcataattgtttatggatttcatattatttaaacttgctctccagttcagtaaataaattttagaggaaatcaatattatgaattttttttcagttattagaaattgcttttgagttttagtctttttctttctttcttttttttcttggtgtaattgtaatagaaacccaaggagtctagaactgtacttgctaccttctggttttgtgactttgatcaaatcactctgcctctcaggatttcagactctgcacaagtaaagagtgagatggagcacaagtgagctttctaggtcagcgtttcccaaaattttatcatctatttttgtccaatctctacgctccctgtattattattctctttaattttttattaattatgttttttttttacttgaaggaactttatcacagcagtatcacttgttataagtaaaaagtagccgtaaagataaagacaacagaaacaaatgtattaaagcctggcacgtcctcagaagactctgctcctgagccttgatagttcaccacaagtataagactgtcatgtgtcagagagattttaaagacatgctggcaccaagtgagactttatttttagtttaatcagaagaactcaaagagaattaagtgaaagaggagtgacttattcttaagtgagttaggttttgtttgtttgtttgtttgttttttgagacagagcctcgcactattgtctgggctggagtgcagtggtgtgatctcggctcactgcaacctctgcctcccaggttcaagctattctcctgcctcagcctccaagtagctgggattataggctctcaccaccatgcccaactaattttttgtacttttagtagagacggggttttactatgttggccagactggtcttgaatgcttgacctcgtgatccactcgcctcggcctcccaaagtgctaggattacaggtgtgagccaccacgcctggccatgagttagtacttttttagtgcctgatctctgtacaatccaaaaattatctcccattccagtgttgtgcatcttgcgtttttagaaatgctaatgtaaagaggaagcatcttccagctctaaaaaaaaaaaaaaaaaaaaaagtggatgctgtaatgccccaatgtaataatatattctggcaacagtgatccagatgaatcatatttttgtgtgtgatcagtttttctttctacatttttcatataggtaaatatttgttgtgtattttaactcatgtactaggtaaaagttgatgtaaatcaatttggggctaagatgtaataatactgttgcctttatggtttaatttaatgatgttgaaaagctttctaagtagtaaaactatagctcattttattccttgcctctccccatccataatagcatgcaatgagtgacataaaggggccagattaacccctgaactgcagccctagaacagcgatggcctggcatagaaagttattgtgactggagatcctttaatcaccagagtattttgacagagtgctgagtagttgcggcattagtagtaggagatttgacacagaaaccattcttaaagtcttggggagcccagttggctcttaaaaacacaacttggaattcctttagtttcagtgccttatttttacctttctttgaagtgcctttttgttcactgatctgttaaaagtgcaatcttgtttctgtttttagccatccattgctattaccataataagcccagtgtttcaaacatgtgtgtcttagagtataattcttccttactcaagactactcaagccattccttccctcccacaaagatgatatctgaattgtgcaggcattggaagaatgcaagtgtcattctcaacttttttttcacctccataaaataaaaacaaacatttatgacctcatgcaaactttttgggtcaggaatttgggagcagcttagctggatggttctgattcaggaaattatactccagtatcagctggggctgcggttgctgaaggtttgactgcggctagagcacccactttcaagttggctcagtcacatatgtgactggcaggctcatgccaggtgttgacggtaggcctctcttctgtaccgcatggagctccctatggctgcttgagtgtcctcgtgacatggcctgtggcttccctcagcagatgatccagagagaaagcaagaggaagccaagtggcttgttgcagaagtcacagttgtcagttccataatattcaatttattataagcgagtcattattttctgccccacactcaagggaagggaaataagttctatattttagaagggggagtgtcaaagaatatttggacgtaatttcaaaccaccacaatctgttcctctcctttgctttcatactgggacaaactgtcgtcagttcttacctacacaacataatacgattctggttggtcttccctcatcttcactgctcttccactcttgtgcatttctaatccattctccatggagaatcccaagtgatcatttgaaaacacaaatctatcatatcacctttcttctttttttgttgttttgttttgagacagggtctcgctctgtcgcccaggctggagtgcagtggcacgatcttggctcactgtaacctacgcctcctgggttcaagcaattctcatgcctcagcctccccagtagctgggattacagacacatgccatcacgtccagctaatttttgtattttgtgtagagacggggtttcaccatgttggccaggctggtctcaaactcctaacctcaagtgatctgcctgcctcgcacttttctgcttgggtggcttactgttacacataggataaaatttagagatcttttcaaggcatataatgtcttacatgagttggttcctgctgccttctctaacctcatctcatacaactccctctgagctcactagaaattctaatcttcttttccattactaaatcatgtcaaccgcttcctaactcagggccttcatacctgcgatttactttctcttttgaatggtctttccccttcctccttgcctgtctatgcctagctttatactgtagatttctgcttaaatacctctccagcagaaaaacttttcctgataaaacttagatagcactgtatcatttgttttctcttttattaaaaaaaaaagctgtattgaagtataattgacatgcaataaactataaaaattaaggtatacactttgatacattttgtcataggcatataactgtgaaatcatcatcaatattcgaaataatgcatcactccaggaggtccctttgtggaggatccttgttattttccaagttggaaacagtgcctagaccatcacaatatttcttacaatttataattgctaattgctttcatctcagtttgtagtaactcgcttgtgcatctcaccatctagactggagctccatttgaagagaaaatgtgtctgtagagttcattgctacatctccatgatcacattgtccagatgttcaataaatttttgaatatatgaataattgtttgtattataagctgataaagtcccttaaagaaatacaagtcaagtgcttagatacttttgatgtagtctgccctttgaagaactagtagatttgtgacttttttttttttttttttttttttttttttgagacggagtctcgctctgtcgcccaggctggagtgcagtggcgggatctcggctcactgcaagctccgcctcccgggttcacgccattctccggcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccgatttgtgactttttaaaattgtagccttctgaaactaagcgaaaaaaaatatgaggtgaatttttgaaaggcctaaacgaagaaaaatgagatcccaacttgtctctcatgtaagggaggtaaagaaaagtaagtgttgaatgccaggtgtagtagtctgctctttatttgagtcgagactaagaagcaatcattgaaaggtttttatttttttatttatttttattttttgaggcagggtctcgttctgtgagaccaggctggagtaagtagtgcaatcatagctcactgaaacctcaaactcctgggctcaaggcatccccctccctcagcctccctagtatgctgggactacaggtgcatgccaacacacctggctagttttttaaaattttttgtacagatgaggtttcactttgtttcccaggcgcatctcaaaatcctggcctcgagcagtcctccctccccagcctctgaaagtgttggacttagaggcatgagccactgtgcccggccttcattaaaggttttcagcttggccctgactttttattgtcttggctttgcctcaggacaattaatatggcactgatacataagaaaacatatgaatatcttcgagacctgtactttacctatctgcatgatttatatcattgcaaataaggaagaaaagttaggaaaagacaaatataattcaaagtgtttaagttttctgaaactagagggttggtgatatggtttggttctgtgtccccacccaaatctcatcttgtagctcccataattcccacatgttgtgggacgtaccgggtaagagatgattgaatcatggggatgggtctttcccattgctgttctcatgatagtgaatgggtctcatgagatctgatggttttaaaaacgggagtttctctgcacaaactctctctttttgcctgccaacatccatgtaagacagaactttgtgcctcctttccttccgccatgattgtgaggcctccccagacacgtagaactgtaagtccattaaacctctctcttttgtaaattgccccatcttgggcatgtcttcatcagcagtgtgaaaactgacaaatacagttagtttaaccactctctggagtgttctattcatgggttggtaacaaataaaccatttataatttaaagttttcacagccttagaaatgctcacatagatgttaggaaatagttttggtatacaacaaaacagaacctttgtgcacatttatttttgtattatattgtactgagggtttctaatcaggtgaagagaaaagcagtgtcagaatgggaagtctgaatttgaattggatatgtttaagcaaattgtctctttaccagccctacctaatttgagaatacataacacccactcagctctccctgaactcacatgttggattttcccaactaattttaatacacacagataaaaagaccagatatttggtctatacattttctgaatgtatggaaacatctatttatgtaacaagcataatattatagctgaaattgaaatcatttttgtattttggtggttgttgactggctaatagctaataagtcaatgtcaggatagcgaaatcccacatgtattcaaatatttaactccaataaataacatttgttcattcagcacctactaaatgaatctacctctgttaaccttcgcaattatcggataggtagatacattgagattatccctgcttagtagatgagaaaactggtggttaggtataattttcccatggtaatgccacttaccagtagcagagttgcaattgaaacttggatttgtggcctctgaaatgatcaagtaatagttattgatttttaagttcatgtaatgacaactatttgtttgatcttggaatcaggactgagtatttttgatagaaaggaataagtcatattttggatgggcagatgaagatcttataagaatgttactgccacagcttatacctaaacatgttgaaaatattttagggaagagaatgtatatgttgatggatttgtgttagctgcttttggattcaatgattaaagccagttttgccttatagctaaaagtatctgataaaaaactaatcacttgtcataaagaagagaagtggaggctatgtcatcattaccatcaccatctgaagtcgtcaaatatattgcatttcctgtgatgtcccagttagttccaagcagttatatttatataaaatcatatatttcagtaaatattggagctttgtaagaataacattattttaacataaataggtgttttcagacagtctcattatttgtgtattccaaatatgtagtaccttgaagaccttgacttatttgagaacagcatgaaaatttgcctgcctgaaaatctattggcgtatattcaagatacgttttacaagcaggagattattttgggagcataattcatcactttgcttacatagttgttggctctttgtctggcatttgattggagagctacattttcttggagtaatgttgaacacaattttggagaaactggtttttttttgacaatttgaaatgttactgattaagatcccttgaggccaattctatacacaaagtacatatttatccattgattccatgaaaacataaaaattctttccatttagtaaatagataatttggtacaggattatttgccctggagtaactggttaaccagggtataataaaatggatcttttttttttttttttttttgagacagagtcttgctttgtcagccaggctgtagtgcagtggcacgatctcggctcactgcaacctccctctcccaggctcaagcaattctcctgcctcagcctcccgagtagctgggtttacaggcatgtgccaccacacccggctaatatttatgttttttttggtagagacggggtttcaccatgttggccaggctggtcttgaactcctgacctcagaatcggccagccttggcctcccaaagtgctgggattacaggcatgagccaccgcactggccaacaaaatggatcttgaagagttccttcacattagatcagaagaaatgtgtatgtgtgtttgtttgtgtgtgtgtgtctgtacctcctgtaattgtcatgtgtatatgtttgcatttagagtagttttttcttattcattttcaaaaataaataatcaattttgcattatttcttgcctctgatcccaatctattagtggaaagaagtgagattcaaccataattggaaaagtcatcaccttttaaaagaagtaacattggtcacattagtcccaattccatctcacattgggtatgtgaccagccttgaaccaggtgaaatatagaaatacagaacttcagatatgatccaagctatacattagtgggaacagtacatcccttgatagtgacactattctatttgaatgtcttaaggttccattgacatgcttttattagctccttcaaaatgttggctaatattacacaattgactgagtatttctgatgcatcctttctgttaataccaaatgccaataaatttcatggtaaaataatttgatattggcattttaaagatattatccttagttttcatgccagttagatcccatctgagtctgcatgtattaatagacttcaggaaaaattccacaatgtcacatatcatgcatggcctagagaaaaggctttattgggaaatttacatatgtcaagatttaacaatgagaagagaagccaggggtcctataatcttccacatcccacctaaaggtgtggcaggacctggctgccttgatcctgcagtgtggctctgtgttcctagcaagggtccgttctcttcagtagcctaccttgtcaatgaaggataagtggaccccttggctccaggcccccagagaccctcaggcgctgtgggatactaaagtatcccttgtgtggaggtggaagcccctggttgtatgataagctgagcttgggtgtagcccctcctactgggagaaggtaggatatccctggctgtagttgtcatattgtccagagttcagagagtgagtatccagcgttattttgagtcagtcctgctcatttaaacttacaacagtagatctgcatgatccccaaacacgcaggtataaaaattttctcaaagttgaccacctgttagacaatctcatcatttagtggaaacctcactgtaatcgccatgaggattatgtatcatcatctgttgtatgtgggtggcattgcactagtactggataaaacaagtgaagctatcatggtttttctcttctaagagtttattagatgacatcattctcaaagtctaaattttgtgaataaaaaataacactatagcatgtgcctttacatgaaggtttaattaaaagcaatgaatgaatacatatgcttcaacattaatctcactgaatatatttttaagaatcctgcagtttgactgtagataggatgaaatgttaaaaatagaccctaaacccaccttgatttatgtatttacttggagagaaacaggtgagggaagcatattgaatcataacctaattcctacaaacattgatttacacacaaattaatttactaaacaaattatagtttatacatttatacattaagcatatttatttaatttaaacatactagtaaaatggacatcggttgtcctccaaattctttgtgttttcatttagataaagatgataatgttgacaataatctgaagcttaataacagaaatagcaatcatgtgttgaatatttattctggtggtagtaaggaatcaatccatatatatttacacatctataaccatacacatatgcatacatatataatagataatatatatttatgcacattttgtattttttttcatttaatctgcacaccatcccttaggagtaacttatttttatgaatgcttctcagataaatggagaattagggaagtgcaatcatttgcccctgttcactctactagtggaagcaggatttgaatctaggcgatttgactctaaaggtccatgctctttatcactattcaatactgcagatgtaaattataaggccattctatccatgtaattttaatacaataaatgctatgtgctgagtgttttttaaagattaaaatttgaatctgcagtaaactggctacttatcttattgtcaaccacatctttttcggtactgtgtccaggacacagttagatattaagtaaaaacatccctggtcattttttttttaaatttgagtttctctggcttctgcacatagcccatataaactcagaaacccgttatttggagatttcactgaatgaaataccataagctttgtagtgggaaggggttgtaagaccaggtcacccaaacttagtttgcaaatgctgcagcagctactcttagcagccactgtcctttccatagcatttccaaggcacctgcattcttttgcagctactactacccaccacacctcttccttagcagttccatagccaagatttcagagattgttatgaaaatcacattgaggccagtacttcgttagaaatttaataaggactacaacattgggttgcaaaggaaggggtaatgcctcttctactaccatttgtagtttgtcctctaggttcagcattaacaatttttatgaagtattaggagctttcaagggcctttggcagggagcaccttatgcctcaatgaaggagccttaagcaaagttaataaaaatgcgaaagtattgtgtcttgacataaggctcctgagtcgtaatgttgataatcttcagcatagagctctagcaacatgatgcatctggtgtctgtaacccagctgttccccaggaaaggtgcagaattgagaatcatcagcctgaaggcatgcataaaagacagcacctgagaagtggtgctgtgtgcctatggaagagcccagtcagaggagtacagacttcaactgaaccatcccccagtatagagatgcgcacacgtcaggggagcataaatgagaaaactggactttctcaagcctgaggtgttggataatgacctgacagcgttctcactagtcccataaaacagcctatgtttgttcccatctaatcatgtgactagaatgtaggagagtacttctaaaagtaaacacatttgaacaatctgtatgtaggaggaagaaagtactgtattaaaattgtcagtttttcttcttatttttccttacctaatgaactttttggcatctatcagtttctaaccaggcagctgctgaaatttttattcatgccttggtttcctcaagaattgatttttgtaattcttttttgcagccttcccttaccgggctattttgaggttgcagcacactgtgaattcagcaggtgcttcaagcctggcagcatcttattgcctttcttccgacttcctttagtgacctccagtatcaaacatgattgctcttccaattttaatttctacttgctgtggtaccgaacaacctcgttagtcctatcactgagcccagttggcaatgttgggaggtctgagtagttccacactccgtaaattgcagtggtattagcaagtacaattgcatactcttaatcatcttgcccttattatatgagaagtttctggtgtattttaagggagaaaatgctttagagagtaaagagggaaaaaatcaaagcaaactctccctctcaatattctaatcacgaaggactggaattttcaagaaccaatttcaatttgatgcttcaatatagaattgaatttagggtgtatgtgagtgagtgtgtatttttgcacacattcacatatatatatttttaatatggtacttgaactgcaataaagccagtactctttccttgattttatgtagaccacttttacatcataattcaaaaatataaggaaacttatgtagccgtaatagaaattcagtagaattagaaagtaaaagcaacaaaatataaagggctgccagcagctaagccttcgcaaatcagttcagttagttgatgtgtttatttgtgcatgtagagccattgtatttgtacaaatgtccctccaacatatatacatgaaaggggtattaaagatccactctcttggttttgtggctgaacaaattgcctcaagctcttactaatggtaataacttttcctatttaaagggcattttcaaatgggagaagattgttattttttacttttttaaaaataatttctgatctaaggaaaataagctaacatctatacaacagaatacattattggtaataactgacatatgttgagtattgtgtgctcaacatatatagcttggtgtataccttatagatcattaaaaatagcaacactgtaggtaagactgggaaaatgtatgttgtttatttcagagattagcgtgtatccacatgtagggaccatggagtgtagagttggaggttcggccaaagccctcctgggccactccttggcaatgttactagttgtaggttccattctatcacagttttaaggatgatgaaactgaggcttatagaatttaagtgatttctcaagatcatagagctggtaaatggtgaagaaagaatttaaaactagtatatctgaatccagaatctgagctgttgactaacatgtagcattgccatctccaatccttggggatttatttttcacagggcctaaatgtgtggaccttttattctgatgcctttttcttcattctttttgtttgcttaaactaaaccttcttttgaactataaaggtgatggtgagtaacaagtcccatgtgtgattttattgtacacagtcagaagacagaagacactcagacagcccatctgctcagagtgtggcttacatcagtttctgtattacggctatcttttgtagaatgatttgtagcctttatcaaacttctcttggttaaaagtttgtaatggcagagaatccctagctaaacagtcagagaaagtaattccttagaggaaattacatcagcattattcattattgcattagagagtgtatttttgtcaattctctagcagagatcaagttcctgagggaattagatggagaaagaagcattgggtatgaattggatgaggttttatgttgcctgaagcttgagttacttattagcaagagtccaaaacatcttctttattgaagtttggagctatctgttcctcaagtgacaaaaatgttcaaccttcatttggggattctaccccaactctattttggtttatggaattcttctttttttttttttttttttttttttttgccaaaacattctttatttggtcaataaagggcagaagttttggattcttaaacattcagtatttttttaaatttagtccagggtttattcaaataccattttgccccaaactactctctcctctctttctggggctctaattatatgattgttagaccttggagggcagcttagattttttttatactttaagttctagggtacatgtgtacaacctgcaggtttgttacatttgtatacacacgccatgttgtgtgctgcacccattaactcgtcatttacattaggtatgtctcctaatactgttccttcccctcccgcaccccacaacaggccccggtgtgtgatgtcccccttcctgtgtccaagtgttctcattgttcaattcccacctatgagtgagaacatgcggtgtttggttttctgtccttgtgatagtttgctcagaatgatggtttccagcttcatccatgtccctgcaaaggacatgaactcatcattttctatggctgcatagtattccatggtgtctatgtgccacattttcttaatccagtgtatcattgatggacatttgggttgattccaagtctttgctattgtgaatagtgccacaataaacatacgtgtgcatgtgtctttatagcagcatgatttatagtcctttgggtatatacccagtaatgggatggctgggtcaaacggtatttctagttctagatccttgaggaatctccacactgtcttccacaatggttgaactagtttacagtcccaccaacagtgtaaaagtgttcctatttctccacatcctctccagcacctgtcgtttcctggctttttaatgatccccattctaactggtgtgagatggtatctcattgtggttttgatttgcatttctctgatggccagtgatgatgagcattttttcatgtgtctgttggctgcataaatgtcttcttttgagaagtgtctgttcatattcattgcccactttttgatggggttgttgtattttttcttgtaaatttgtttgagttctttgtagattctggatattagccctttgtcagatgagtagattgcaaaaattttctcccattctgtaggttgcctgttcactctgatggtagtttcttttgttgtgcagaagctctttagtttaattagatcccatttgtctattttggcttttgttgccattgcttttggtgttttagtcataaagtccttgcccatgcctatgttctgaatggtattgcctaggttttcttctagcatttttatggttttaggcctaaaatttaagtcgttaatccatcttgaattaatttttgtataaggtgtaaggaagggatccagtttcagctttctacatatgggtagccagttttctcagaacctttattaaatagggaatcctttcctcattccttgtttttgtcaggtttgtcaaagatcggatggttatagatgtgtggtattatttctgagggctctgttctgttctgttccattggtctatatctctgttttggtaccagtaccatgctgttttggttactgtagccttgaagtatagtttgaagtcaggtagcgtgatgcctcccgctttgttcttttggcttaggattgccttggcaatgcgggctctattttggttccatctgaactttaaagtagttttttccaattctgtgaagaaagtcagcatcatcctgataccaaagcctggcagagacacaacaaaaaaagagaattttagaccaaaatccctgatgaacattgatgcaaaaattctcaataaaatactggcaaactgaatccagcagcacatcaaaaagcttatccaccaagatcaagttggcttcatccctgggatgcaaggctgattcaacatacgcaaatcaataaacgtaatccatcatataaacagaaccaatgacaaaaaccacatgattatctcagtagatgcagaaaaggccttcaacaaaattcaacagctcttcatactgaaaactctcaataaactaggtattgatggaacgtatctcaaaataataagagctatttatgacaaacccacagccaatatcatactaagtgggcaaaaactggaagcattccctttgaaaactggcacaagacagggatgccctctctcaccactcctattcaacatagggttgaaagttctggccagggcaatcaggcaggagaaagaaataaagggtattcaattaggaaaagatgtagtcaaattgtccctgtttgcagatgacatgattgtatatttagaaaaccccatcatctcagccccaaatctctttaagctgatgaagaacttcagcaaaatctcaggatacaacatgaatgtgcaaaaatcacaagcattcctatacaccaataacagacagagagccaaatcatcagtgaactcccattcacaattgcttcaaagagaataaaatacctaggaatccaacttacaagggatgtgaaggacctcttcaaggagaactacaaaacactgctcaacaaaataaaagaggacacaaacaactggaagaacattccatgctcatggataggaagaatcaatatcatgaaaatggccatactgtccaaggtaatttatagattcaatgtcatccccatcaagctaccaatggtttatggaattcttatgtatagatagcttcagttcacccaaggattacaagcattatatggtaataatacatgaagaagcagagaaaactaaagtacaggttgtcttccttagcaagtacaacctttgcccactgaatgtgctttcttaagtctcagctttgagaaaaagcaaggcttaagtaaggggggttccagtgagcagacattagagtatttcctattgtattaaggcaactgaatgaactgtttgaaagtttaactctcagggtggcttaggtggcttagtaaatacaattatgagaggaaatgttttcttcacttacttgactgtaatttgttgttaagatatattttgaaattgttgagtattttctcatttttctgtgcctctcaattttctgccaaaaaaaaaaatttctgagaattttgtttttttcatttaggatggaacaaagttgctgttactctatgtgattagggaatgatgttttaggtgaattaaataataaatgatttttcccatatgccaaacatggaagactaatgagatttgaaatgcagcgtatttcttgatattgaaaatatacaacatgaaattttttctttgattcagaaggtactttaggatgtcctagtgtgggaaaatcattagaaattgtcagtctcttgtaacattatggaagtcctggtttatcggtatttttctgtggtgagagaagcaggtaatcaaatctttacagaaacaaaatcctacagaaaataatgctggcagtctgctgattaaagtgtctgaataaaatggattaggtaaataaaaagaatgagcatataagtagaagaaattgtagtttctaaatattaaattcagaaagttttgattaatgacttacgtttcatgtcatatggcttaaagattttttgccttatttcttatccttgaaaacaaagtgaagtgcatatgagagctccggtggaataaaaacagcccgttatgggctggtctattacttcttcaacaaagctctatctactgtcatggggcagcttagtatgacagaaagaaaacagatgtgtgtttcagctcttctgcttaatagctttgtgaatcagccaggatatacaacatggtgtagttgtgctacagtagaaaccctttctgaaatttccctggcacagtactgcacgtgtgtatgtttgactcacagcgcattatccaaggtgaattggcagagggcctctgcccacgggtcattcagagacctgggctgatggaggctttctgtcaatgcctgcttcaaacaccgtggagagtggaaagggaaatgtggcaaatcatacaggctcttaacatttctacttggaagtgagatgtaatttctgtcacatttcatctgccagagtaagacacatagtcaaagaaaaagaaagtaggattctaccatatatccagagagatatcactaatgacaaccacaccatgtgtttttgtataaatctcttagtgtgtctgagcttcattatgctaatctgttattttttttaaaaagtggaggatttccctgacttgatgcctcttcctgtgaccctcctctgaacttttgtgtatcctagtcaccagaggaaagatgttttttcatttattcaacaaataattttcagctccttctatgtaaggtaccagctaggctttggagacgttgcagaaaacaaaaataggtaaggctgatctcccagttcttatgttcagttggattgacaatcagcaaaatagatacatatctatgtaatatttcagttggtaaaaagtgctaagaggaagaataaagtagggcagatttgttccaaggaaaacttaagaaaaggggggaaataatatatgaatatcagtaggtgaaggtttctagatgatagaagaggaaatgcagagccctaagcaggattctgctaggcattttttaaactactttattgaggtatgatttacatataaaaagctgtacatatttaagagatacaacttgatgtgtctagagataagaatacacccatgaaaccatcatcacaatcaatgccataaacttattcatcacctccataagttttctcctgcccccttgttgttgtttttattttgttttgatttcctcttatagtaagagccaataaaggaaatataagatctaccctcttagtacctttttaagtaaatagtacagtattgttaatcatatgctctatattgtaggggagatctccagaacttattaatattttgcataactgttctgctaggctttttaaacatttatttagagacagaatcttactctgtcacccaggctagagttcagtagtgtcatcatagttcacggcagcctcgaactgctgagctcaagtgatccttccacctcagctcccaagtgctaggactccaggcatgcacaccatgcctgtctaatattttattttcttagggacaagttcttgctatgttgacaaggctggttttgaactcctggtctaaagtgttcccgagttgggattacaggcgtgagccaccatgcccagctctctgctaaacattttgagaagcagagagaccaggatatctggagtgcagtgagtgaagacagtgttaggaggtgggagaaggggatcagagagaaggcaacatggcagatcatgcagggagagccctgtagcaaggtaaagactttggattttttttctggatgagctgggaagcattgtagggttttagacaaaggggtgtcttgatatgatctaaattttctctggcttctctgtggagaataatctatagggtggcagtgatggaagcaggagcacagctgggcagctattgcagcaatcgatgtaagataaggatggcttagacccaagtggtggaggtagagattgggagacatgccagattctggatgcattttgaaggtggagctatcagatttgtgaatggattgaatgagagatatgagtttaccacagtaattattactatatagatgccattcatttataccacaaaaccaaccgatgtcctgtcaggtgctagtgctgttccacagttggggttacagcagttgggttttcatgatgttgaattctagttaaagaagacaaatgataaataattcgaataataattttaatatgataatagtcagtagttagtgctagaaagaaaatttaatcaaggggatgtgaatgatgtaagtggctacgttggacaggcaaggccttggggagctaaggcctgagccaagaggactgagatgtgaagtgatgggggaagcaggggaatttggtggggcagcactcgaggcagacacacatgtagtgcaaggatcctaaggcttgggtaataggggaagatatgtcattgcagtttaaatatcgaatggggggacaaagtggttctgtattgatagggaggtcagtatggaccagatcacactgggcttggcaggacagggaagaattttagattgtcgtgattccttggcaataagaagttattgtaaggtttcaaacggagaacaatataacctaatttgtctttgacacagggaggagaacaacatacactggggcctgtggtagggcaggggtcgagggggagggagagcatcaggaaaaacagctaacgcatgctcagcttaatactcaggtgataggttgataggtgcagcaaaccattatggcacacgtttacctatgtaacaaacctgcacatcctgcacatgtatcccggaacttaaaataaaataaaataactcacagtgactgatgggcggataatgggttttaagaggactttgacaacgaaaccatttaggaagctattgtgttatgactaattccatatgcttttcttatctgaacacaataagttgacattagttttgtttttaaagtgaaataaatatttgcccctccatgctcctacccctgcttgttcgtcagcattcttagggaatgaaatgatccacagaagacttcccaaatagctgtggtttccctctttaaggtctgtgtctttaaaagcacatggtccatttcagtgaaagtttttctgaatatttaatacatacttaccatttaaatggaagatagtaagtaaaacctaaacttttcctttgcctcatggcagtattggtgttggttaaaaatgataacttcagagacttcagatctccagacccatgagctttacagatgctagctctattctttttccattggctcctgactgtgatgtccttgtgcttcgcttccacagtctcctatccccaggtttttaggacacatttaatcttctttcttgatacagtgctacttctcttgttgagtatttgatggacttggtgactgttacattcttccaaggccacctttttttggcatctggttcaaactatgtctgtttttgctagaaactgtcacgtgaataaaggaaagagtagaaattattgtagtcatattgcagagcaatttgaacattccactgaagttgaatatgtgctacctacaatctagccatgataattctagatatatgccctagaaaagcaggtgcatatacacaagaagacacattactgggatgttcaccaaggcatcatttgtaatagcaaaatggtagaagcaacctaactgtccatacaaaaagggaatgaataaataatctgtttattcatataatggaatattgcataataaagtaactgaattaaagctgtatgtatcaataagaataactgcaaaaatgtaaagtgaaaataaaaaatttcaaaaggatataaaaacgtaatgtaatgctctttatatatattttagaaataccaaaataatacgtgtgtatatacatatgcatccacacacacacacacataactaatggctaatacagtataaaaacatggtaatgatacataaacctttcagaaaacttcagtgaataaaagcaggtagaagagagaaaggaggacctagttgaatctgccctttttaaatgctatgttaaaaaatagatacatatgtttttaaccaatctgtacaatgttcttacctattatgtctggcttttgattatgtagggtatcaatttatgattttttccatacgatagaaatatttaataatttaaaatatcatataataaaaacgtgtcttttatagttcttcctacaagctgtatttgatcacttctgtggttttatgggtggctcataacatctagtcacatcataaaattcttttttccttgtgattggctgaatcatctttaggcgtgatgcttaatttagacgtttaggttaactcttcaataaaatcacaggaatttattgtaagatctaaccaagggactgaaataaattgaatgtagtgaaatttgaggcattgtttcagccaccttaaagaccacatgatctactgatacagttgttaaatccactcagataaacatgtgtgctccaagttggagaaatctgaggcagagaaaaagaattgtcccaggtgcccaagtccacttatatgaacaacttgaattgaacactgttaatattaggctcttttgccaggagtggtggcatgcacctgcagccccagctactcaggaggctgaggtggggggatcactagagcccaggaatttgaagctgcagtgaactatgattattccactgcactacagcctgggcaacatagtgagacgctgtctgtttaaaaaagaaagaaagaaagaaaagaaaccctaggctcttcttcccctctccccagacaaagtctgctgcagtgatctcggcttactacaacctctgcctcatgggttctcatgggtttaagcaattttcctgcctcagcttcctgagtagctggtattacaggcacgtgccaccatgcctggctaattttttctctttttagtagacatggggtttcaccgtgttggccaggctgatctcgaactcctgacctcgtgatccaccagcctcggcctggcctcccagagtcctggaattacaggcatgagcaactgcactttgccccttggctctttttaaaaaatgcatttgtttgagagtaatgaatagaaaaggaagttgtggcatgaactatctgattcttcttttcttccactactgggagatttcataggccaaatattctctctagtcaggggcatgcctgatgatgcttacagtctataaagagtctggtcttgttctcctttcatcttctctggagaaaggataatcaacaacagaaattttttaaaaaccctcatactttagacaagtcacattcagccactctgtggaaacactgatttttctacgaggctttcttagagaataaatattaacacatatgcttcatgggctgatagatattgctgtggtttcaatgtgtcctctacagaatttgtgttgaaatgtaatctgcattgtggagatattaagcagtgtggccttttggaaagttattaagtcacgaaggatgtgccctcgtgaatggattagcaccttagaaaggggctggaggaaactagcttaggaccctttgcccttctgccttcaccatgtgaggacacggtattcaaggtgccaccttggaagcagtgagtgggccctcaccagacctcaaatttgccggcacctttatcctggacttcccagcctccataactgtgagaaataaattcatgttgtttataaattacccagcttcaggtattttgttatagcagcaggaatggactaagagagatttaatatggaatcccaaacaatgaaacaactatttgtacttctaaaatataggtagttctcaaaagcattatgttcagtaggatagctctctaacttatctctaaagttaattaaacattatggctgaaaaatgagttttagtttcctctctttgaacttctataaagaaaatatacctttgagacttgaaaagttcagtgctatgaaacgtctttctagggtagtttgggtagcaccaaagtcacctataattaaaattacatattttccattttaaaaattccattttataattttcaaataaattttttactatcaataaagaggtattttttgatttgtgcaactttatatgtagcacttggtttcattaaacaaatgtcattgatttcattagcataaaactttattttcttcaccttaattttgaatacaattaccaaataaaagtagcttttatctttgtccctttgaggttagagatgatatcttcttgatttctctgtctctcccgagcacagtgcccgcacatggtaggtaattaactgtctgttgactggttaaattatctgtattacaagtaaatacaaaatgccaggttttacaaaacactcattccatattgtctatcactcccactctattttatttttcaccatagtataagttaagatattattaaaatattattaagatcatctggggaagtttgctcacttccattcttgaaattattataatctcctcttaagaaaaaactcaaaatgtgtaagagcatctctgatagcttggttcttatttgtataatgggataattttatttcttcagttgccatcctgcaaacactttttctaagtctttaggaacctctgtttttaaattgcttttgcttcatgtgataaactttaagcccgtggccttctaaaatgattcagtcagtcagttctgacatctcttcatctcttcttggtagcaccctcgccatttctgcaacgatttccactgagtcgcatttcagcctgtgtagaaactcatgatgacgtgttgttttataatactttacactttgtgtattttgccattatgggggtgggttaatgtgttataaatgtacaaatgcttgttatcacagtaaattctaggtagagaacagaccatggaaatgttgttttaatttgtgttagtttgagaaaattaataggtatctcatatgacttataccagaaaatttaaaaactataaacatacagccaagcaagaaggcagtcattatgagtattttcagagtgtattgtctgagaatacggtggcgttttccattgctaaaaagaaatgcacagttttccactagtaacttgggagaaatattttttcaggtatacaatgcagggagttacttgacctaaaatgggtacttaaatttcattgattgtttaaagataagtaaataattttcccttttttgccagagttgttttcatgtaacgatacgatacatcttataacaatacttccattataacatgctttatatgtattatctcatttgattcaggtgatgactattttcaatagatattgttgctgtctccattttacagatgttataggcaaagttaaaggtgtgtaggcaagttacattgattcaaagtgatggacttcaaactctttgcctctattttgttggaacattcattaaatcatatagcacctgctatgagtggagactttcaactcataaagaccagaacatttaggggacaaaagtactcacagcacctggaaccaaaaaaaaaaaaaaagaaagaaagaaagaaacaaaaacaaaaaacctgttaaaaatttcttcatcacagacaagactctttcaagggtactgatagccatgggacagagggaaggacaggtaaagttgatgggccaaggagagtaacatcaccttcctcagcctaagctgcaggattataggaaaagctaagtagcctctgggtgatagtacctgcttgggagagccgttgtgtgaattcactttgtaaggtccaaaaataaatgtgacttagatacgttcacaccattcctctctttcccttttttcctgggttacctgctgtccacctagctttgactattgccaatacccaatgcatggatggaatacagtgagaaggaacctgcaagtgtcaatggaggcagaggcagagaacaaggatgagaacaacaaattttaaagaagctgtcttgaacatttggggaatagaggttggtgaggagactagccaagatgttttgtctctctgttgtataacagagtgccctgtggcatctcttatacaggtggctatacagtttttaatcacttttttaaatgttggatgagtatttcttttgattgcaataaacttatggtgagacacactactaggtggcccagttttattcaggatatgtaggagatggagctttataaagctgcattcatgaagattcttacaaaatattctcaggtggtaacattttaatgggtaaaaataacacatgctttcaaagaaaaatctattattcaacttaatataaccagttttatatatacatataatacacacacacacacacacacacacacacacacaacagacagagatactttttgacttacaatagggttacatcccgataaacccatcataagttaaaaatatagtaagtcaaaaattacatttaatacagctaacgaaaccaaatgtcgcagcttagcccagcctaacttaaacataatgagatcacttacctagcctacattggtcaaaatcatctaacataaagcctattttataataaagtgctgaatacctcatgtagtttattgaatactgtacagaaacttaaaaacaaaatggttgtatgggtatttgaagtacaatttttactgaatgtgtattgttttgggggaccgtgtgtatatgtgtgtgtgcgtgtgaattggaacacacacagttgcttttgcagcagttttgaagtcaagatacaacatatactaatattggtttcacaaggtaaaggccattattatccctatgagaattcagtgaggaagatactgcttttagctgggtagaatgaggtagataaaatatattttgattatttgaattaggagtttcatgtgatgagctgcattgctacatatcttatttcttactctttaaagaaaccaacaagcttttcatgtctctattacagaataaaatagagtaatatgccaacatatagacatttaattttgtcaaatccaactatgcaaacttaaaatgaaaggaaataggaggatataacaacttaaatggcatcagcaatttctcacactgtttcaccccaagagtgttagccttagtgaccttgagacagaagaagtgaatcacttagtagatctctttttattgtatgcatgactagaggaagcatcttagggtgctgcatgtgagcattacgtttaagaacacaatgttgtagaagtatttcttgtatattgtgccaggggctttgtctgcttatcagtggtgcaatacatcatccgtgaactaagattttcattttatcattaatttgttatcctgagagtggcaacttagttttacttaagatagcttccgtagttctaagcacacgtggagactccctgttcagaagaaaaagttctatgtatttccatgtattttattaatgatgacaccttttcctaaagtctcccccaaactgtttcttctcgcttctcattagcaaaaatgacatcacatagccaaaccaattcctggcaaggaaaaggatatcatgatcatttacttagatcaaccgtgattcaaccatagacttgtggatgggcccatcttctatgatgcacatggccagtcaaaggaaaattttggattccagtagaaaaaaaagaaaagagattaaatattgattaggtaggtgctgcaacatatttgttcattaatgtactgtaaagcactatttgtatttcacatttatacattcatattactttataagatggtatacataagaccatgtatattgtactttttgggcaatataaggactttttgtagggctaattttgactccaatttttgctatatgatcagagttacactataattcatgaaaaagacaagactcaactctaatatcaatattagccttagtttaccagttatcactatcggatgtgtcataagcatttgtttttaaggttgaatagagaacctgattgggtgctataaaagtctgatcaacagcttaaatgtttgtttgtttgtctttcttaaggaaaatgagcattgagtttctttctgttccacattgaataaacctcaccaaatctatccctacattcagatactcagtccacaaatactgagtaccttctatgtgctgaccgctgttctaaccctcgtggatacagtaatgaatgagatagataaagtactttttctcaaagagctaacattctattgtgagaaaaaaatagaataatcagagaagtcaacaaaaacaaaaaatgtgagatactgaagagcatgtgagagcaggccagtgggtaactactttaggggtcaaggaagtcctctctgaggaagcagagtttaagctgaaatctaaatgacaacaaggagccaccatggaaacaccagagaagtatattctaagcattggaaatagctggtgcaaagaccctcaggtgggaataagcttgaaatgtagccagcaagtgggaaagaggaagatgaggtcagagaggtatgcgaagactagatcatgtgagattatgtaatccaggtgaaaaggattgattttgattctgaatataatggcaagtcattggaaagatccacttgatcaaaaagtgacaaggtaacatactggataaggtatgggaacagtatcatagggaaacaattgaagtacaattaggctgttgtccaggtgagaggtgacggtggggaagaccaaactggtgtagtgaaatgtacaaaaattgaacagattcaggatgtttgggagataggatggaagaagtgaggaaatgagagaacggggtgaactttcaaacttctggcttgagctacggcatagacgatgaatttttctcagagatgtgtaggaagcaggttcactgaggagagagagcaggcagaattgagagttttgttttggtcctattgaaatagagatgcctgtcagacatccttgtagagatgccagataaacagttggatacatcagcctggagttccaggaagagactaggcctggagataagagatttggtagtcatctgcatataaaaaagcaaagaagtgcccacacagttattttaattaattccacagagccttctaaagtataatttggagaactgaaaattgatgggtacttatttattgaaacatttgtcttgaaaatttgttgacaacacaattgctgagaaattaattgatagttcatgacaagcagtgacggctcatttcctcaaagtttccctaaaagacaaagaaagttttatgttattagctttggcttgctttgaaaatttgtttttgcacatcactgttttgggttagcaataaaattctctgcatttgcttcataaatcaaacaaggacacaattgttaaatagtctgtatcatattaattaggctctgaaacaaagcaagcattacagccatttataacagggtattgcataagttgctaatcaatgagaaaagcaactaattaacaagcaaccagtcagcattttgagcagaagttggtgactttcagcttaattaaaccttgcaggtgtcagtgatgatatgaaagaatctttaatctgtttgtgttgaaattcccccagatcattttcacatctgtacatgtttaaagcccctatctactttcatgtaggtaaagggaattcagtgtcttaaaacagttcacatttttaaaagccctattcttaattaaatcattaagatttctcctggattaagacagtggaatgaagttcatcatctatttcactctaaaaaaaaacttagagggctaagcagctttattgaagtataatttatataccctaaagtatacttgtttcaagggtaaaatttaatgattttaagtaaatgtatagagttgtgcaattatttccagagtataattagaataaaggaaattttaaagtttggacaaatttatccatgaggtatcaaaattagcttgtgagggaggctagatatacctagcctttaggaatgacctataaaagcactgatacatctttccttctagccttcaagtgtttccaaccatctgctacagctaccatcaaaaacaggattctaaatgggatgaatcaaggattaagagtaatctattccttaaataacttttaaaataccataaattcctctttaattacagtagattatttggcaaaattaagaatactagttcctcaggctgccttttttttttttttaacattaagttccggtatacatgtgcagaatgtgcagtttgttacataggtatatgtgtgccatggtgccttgctgcacctattgatccgtcatctagctgccctcccctaaccccccatccccccaacaggcccagtgtgtgttgttcccctccctgtgtccatgtgttctcattgttcaactcccacttatgagtgagaacatgcggtatttggttttctgttcttgtgtcagtttgctgaggatgatgctttccagcttcatccatgatctcattcctttttatggctgcatagtattccatggtgtatatgtaccacattttctttttccagtctatcattgttggtcattcaggttagtttcatgtctttgctgttgtgaatagtgctgaaataaacatacatgtgcatatgtctttatagtagaatgatttatattcctttgggtatatacccagtaatgggattgctgggtcaaatggcatttctagttctagatccttgaggaatcgccacactgtcttccacaatggttgaactcatttacatttccaccaacagtataaaagcattcctatttctccatagtgtcaccagcgtctattgtttcttgactttttaataatcgccattctgactgtcatgagatggtctaagaaaaaagaacaaagctggaggcatcgtgctccctgacttcgaactatactacaaagctacagtaacgaaaacagcatggtactggtagcaaaacagacatatagaccaatggaacagaacagagacctcagaaataacacccaacatctacaaccatttgatcttcaacaaacctgacaaaaacaagcaatggggaaaggatctcctattcaataaatggtgctgggaaaactggctagccatacgcagaaaactgaaactgaaccccctccttacaccttatacgaaaattaactcaagcgggattaaaggcttaagtgtaaaaaccaacaccatcaaagccctggaagaaaacctgggcaataccattcaggacacgggcacgggcaaagacttcatgacgtcaatgccaaaagcaacggcaacaaaagccaaaattgacaaatgggatctaattaaactaaagagcttctgcacagcaaaataaactatcatcagagtgaataggcaacctacagaacgggagaaaatttttgcaatctacccatgtgacaaaggcctaatattcagcatctacaaggaacttgaacaaattttcaagaaaaaaacaaccccatcaaaaagtgagcaaaggatatgaacagacacttctcaaaagaagacatttatgtagccaagaaacatatgaaaaacagctcaacatcactgatctttagagaaatgcctttttttttttttttttttgagacagagtcttgcactgttgcccaggctggagtgcagtgacatgatcttggctcactgcaacctccacctcccgggttcaagtgattctcctgcctcagcctcccaagtagctgggaatacaggcacacgccaccatgaccagctaatttttttgtacttttagtacagacggagtttcacaatgttggccatgatggtcttgatctcttgacctagtgatccgcctgtctcggcctcccaaagtgctgggattacaggtgtgagccactggtggccgacccgagaaatgccctttttttaaagggatagttctctcatggctaattcaaggaatacaaggattctttcataatgataatgtctctatttcttctcggttataatctctgtgcaagatgatgtcattttcaaaaagttggaaatgggcaaacacttgtatttgagatttaaataagtatgcatataaaaaatatttgtcatattgagcacattacaacaattatttcaaatttccaagagatggatgatgatttgttgaatggaagtagaaaatattaagtaaaatagcagccatcactttctatgtgccagaaactgttctgagcactatccacacacttaggacagtgccttaaacactgtatatgtagtagttagaacagatacatgtttacatgtaatatgggataggtatgggggaatggataatgcttagaaccatcctggcacatagaaagtgatggaaaacagttcttagaacaattcctgggacatagaaagtgttgtaaaaattaaatgtgggtatatatatatatggaatatgcatgtatatgtgtataaataatatatgtatatgtgtgtatgtatgtataatatgtgtatatgtgtaaatatgtgtgtatgtacatatatcattatacattttgtatatatacatgtttacgtatacacatattattacaaatgtttgctctatataaataagctatatgtgggatatccaatataaatatctattctataagattgttgtaaaaagtaaatgagcatccatatgtacatgtatatacacactcacttcatttttacaacaacctatgaaataggtatattgatcctattccagaaactaagaaactgagcctcataaattaaacagtttgctcaaggtgccccaaatagtagcacagcggggataattaacacagaaagtcaggctctggagtcattgctcttatttaatcagtatctcctactggaaattttgattatcaatattgttcatatcatatggcttcaattgtttatcattagtgaaacctacaatgtttcattcagtgttccaatctaataaaacaatttgtgtctgctctgacatacttctcttaaaaatgtcaggtattttcagacacattggcaacctggtattgtggaaggagtggtaagtttggaatctggagacttaggttagaagtgatagatcttccaacagatcattgcagagactgggaaattatttaggctcaccaaaccagttatctgtaaaatacaggatatgttccttgaccttatacctctctgttgtgccttcataataatgagacagtagcacttatattgcctgagagtttctgtttacttgagtatctcttcataaagtgtaagttctttaagggcagggaccctgtcttttttactttgtgtcttcagcatcctttaggctactccctgtcgtctcagaagcacatactaaataagtgcagaagcaaactataaaagaagagaaaatatcatgattcccaaaacagttttcatcaggatcaaatgtaaatgaaattccgttcctgggctcttgctaccagctggcctatgactaaaacaccaggctggtgctgcttctagtagcaatagacattgactgaaaggcatggaagcaacctagaaattgcattgattgtaaatattttcaaatgaatatcttgaagaatggattcaaaacattccattatccatctatggggaaaatatttgcagcctctgtatatacctttattttgtgtttctgttatctcttagagtctttcaaaattgttgatcagagacaaagggtggctgttggatcataattgtaaaatgatggacatcagaagaactatttagttaagtaatgagagaaggagcaagtcctgtagaacttagttctaggatatcacacagcacatttcaggactcttctttaaatccttaaggagaggtcttttcatttgcctgacgaagaacatgagggaacaagcactttttccttgaaatgttttttgtactgatcagatctgctaataacgcaacatagacagactaccaggaatgcaactgcttatatcctctctgttcacaaaacattgcagtgcatttgttgtgccttcattttcctcatcagaactcagagctcatgactttaacccttttcagttttggaatcagttgtttctaagataggggctatgctttgtttctgtacctggtacttttttcccctggcataaatgaaaatatctcttcaaatatgtacccaagtagtagtaatatactctgtcccagtccctggagagctgtacaaactggaggtaagccagtcattcatttgattatattaagattcaatgtttaaaagcaggacaatgccataccatatgaaatcatattttacttctcacttactttagctcagttactttggtgatgcagaaagtggttttgaatttaagataggcattcaggctggaggcaggggctcacacctgtaatctcagcacttgaggaagctgaggtaggtggattgcctgagcacacgagttcaagaccagcctgggcaacacagcaaaaccctgtatctatgaaaatacaaaaaataagccaggcatggtggcatgtgcctgtagtcccagctacatgggaggctaaggtaggaggatcacctgagcccagcaggttgaggctgcagtcagccatgatcgtgccactgtgctccagcctggggaacagagggagaccctgtatccaaaaatatatatatatatttattaagggtccatagaaatctaggttatagaataggttatatcataaaatattagcctcataccttcattctactcataaaagacttagctgtataaaataaatattgccacaggttgagtttaatgctttctaattgcttggctttcagtgaagaatctctttacacaagaatgtccttgtgtgcggaataaatcggactttagaaaatctgaaaacctcatttacacagaaatatgcacatccctggactctatacagcccccctcctgtgtaattattcttcctttgacacaaagcactctaattccagaatgcctgtgttaaaaattaaagttggttaggtgtgatttttcctttcggatcctcttctggacattgaacaaaaggagactatacatttaaaagacacaaacctaaacatgaagtaagaaagacttgaaatttggctctagaaagtacatatttgaggctgagtaggttattttaactcaccaaatcttaatttcatcctttgtaaaatgaaatgatgaaaataatacttgccttataagcttgtctggaaagttgacttagacaggtcctgcaaaaatcttggcatgttcgtggacacatagaaagttctcagttaacgttaagcaccccctgttctcgcgtcttcctcctcaccttctcatcgctgatgtatatgaaagtataacatgcagcaagggaactagactgagtctgcctcaacacattctggaaggaagtattctgttctgcctatgctcctttccacaagttttattctaatcgtcagatgtgttctacttcatctgagtaattgtttgtgataacacctggagaggtcttaacttttgtatcttataaaaacaccaaacaccacatgttctcactcataagtgggagttgaacaatgagaacacatggtcacaggtcacagtaaggggaatgtcacacaccggggcctgtcggggggtggggggctagtggagggatagcattaggagaaatacctaatgtagatgaccggttgatgggtgcagcaaaccaccatggcacgtgtatacctatgtaacaaacctgcacgttctgcacatgtaccccagaacttaaagtataataaaaaaattaaaaataaaacaccaaaatattaagtggggagtgacttaatgaaccccatggaatgagaacgaaatacaatgtatatgcatttaacttgtacagttgtaagcagcatttttcagtgggctgtgatattaattccatttcacaaaagaatttgtgagactctcaagcaggtatggccaagagaatgatcctcattctgatttagcttctcagaagattgatgttctctctgggatcttttgtgtgtccagcatggtacttgcagcagaccattatgtgctgtcatgctgcttcttgatatccagactcggtgtgctctgcagaactgcagcctcgctacatgtttcagtgcaggaaattcacattaagggatccttttccagagagattgctcaggcaatttcagttccatctctgttttaaatgttggaaaacaccccctttctctcagtctacccttgctctgcatgcctatcttttgctttgctgtttctagattctgcgtttggttatgtatcctgtactcactatggcagtaggaggagatttaatatttattaccttttggtgggaagaataacttccagatgaaagtccagctgaaaacatagtctcctttggacaagaatataaagacttcagtctgccagagtagcattactagacacctggctgcaggaaatgtgatgttacttttttgacatctctgctcactgcaacttctgccacccgggttccagtgattctcgtgcctcaactccccaagcagttgggattacaagtgtgtgccaccacgcccagctaattttttgtatttttagtagagatgggttggacaggctggtctcgaactcctgacctcagcccacctcggcctcccagagcttgctgggattacaggtgtgagccaccacgctcagctggacaagcaagttttgaagcagaggagttgtctgcaaaatctggaatatgggggcagttatggagaaataataattagtactgttcattgaatgttttaatgtttgccagaccttttgagttcttcatatacattatcttagcctacctaaagcaaccatgtaaggatgtgtgttaatatatccatttacagatgaagtaatggaaactcagataagtagatatttcatgcaagatcacgcagctggtgtggaaaagctgagatctgagactggtgcactctgactcaaaagccagcactcttagggattagatttccttgtgtgaaaaataggtcatatgagaatgatggaagcatatagctacttttctttttcaccaaatactaattctgcatatacacataataaagtagtttttctgtagctatcaaggacttacctgaaaaggaaagggtgacatcagaaatccatgctgtgttgtgggggcatatttactctcaccttaataaatgctgcaaagcattatagaaaactacttccctgctcatggtaatatgacaaaatcctttcatcttcacgtttttcaaaagtgatattctggtgggcctgcaaatagtaaatattagcttcttgaaagatcctttatggagactaatttttttttttttcatttttattctcatggtttttttccctgattttctaccctcttgttttgcccattcatggtccatatatttttgtcattttaactcctcatcctgaagcacagcaatcatttctgagttttatggatcaccgcacagatattctggtggtaggcgattaatccttatccaaccacacagcagttttacctaggctttgggatgatatttagctgttactgtggagcttcctactggaatctagagaacagaggggcaggggaggtcagaggataggtaaacataaatcaggtttgtgcaaacaagcatgatgaatgctagttcccaaagtgctctgccttttgtcaaacttatatattaggagagagggttgtgtggcatgaatgatgaatcataaaactgctctctctggtgaaagggcaagcatagaaaccactgtagtaacacggtagcttggatgcatcatagggcttgggaatacagagtggaaaacagtaatatgtgtatcagcctgaatgaaacagtaaggagaacagagcagagtgtcccctgactaggaaatccagatcagtcaaaaggaagtgagtttggagaagcaaaacaagatacagtacgtcagggtttcttaaccaggcctcacacatagaaaaaaacaaaacaaaacaaaaaaaccctgtctgttcatttaccatttactgaaatttagctgtttcttcaattattaatgagataatcatggaattttgatcagctacagtggctttaccactaccagaagtaactgattgatttcttcatatatatctcaaaatattgtttatgccattcactactttgaaatttcagtagctattacattcaccactagaaacatatattttattacaaaatttaaaaatacttttaaaattgttcttcagtataaattgttgtctttgtaattctgtgtatgttattttatgcactagaaaatactatcctgaaaaagcattcataggtttcaccagtacactaaaagggtccaggaaagaaacaaaaagtgtgaactcttatggtcgatatgctgtttttaatgttaggtgagattcagctttttaagaatttaatttttagaaagcttgagagagaaaaatttctactttgatatattcagtacaatatattttgccacaagtcagcatctaccatgaataaaaattaatttggggactaatgccttaccttctacttgtcaaccttgcaacctgcctgtcaacatgagaccatggcaagcttttcagattaatcagtgctaattcagctcccatttcctttacttgtattatacagataaagtttgcaatgagattaagagtcttggctcttaattggaatttctgattctttttttttttttttttttttcgaggctgagtctcaccctgtctcccaggctggagtgcagagaagtgatctcggcacactgcaacctccgcctcccgggttcaagcaattcccttgcctcagcttccccaatagctgggactataggcgcatactaccactcccagctaatttttgtatttttttagtagagacaggatttcaccccattggccaggctggtctcgaactcctggcctcaatgatccacccacctcggcctcctagagtgctgggattacaggcatgagccactgggcctggcctctgattcttaattttagctgtactacttaattatatatgtgaaactagatatattattttatctccctaagcctcagtttactcataatgtgagtaataatagtagctaccttatagggatgtggtgaaggctaaatgcaataaagagaacttaaaacagtaaaaatacatagtaagagcttaatccataattgccagtattgttttcagtacatactgtaatcgtgcttaataagaattgtaacccactgccatcttcatcctccaaaaaggtagtgggtctctaaaaatccatgcacacctcccacaacgccacaagagcagacttctgggaccctggacatcttgggacctcttcataggatggcttgtatattctattctaaaactatttgcattaaatattaggtcaatatacaagaatacttacaaagtatacctaaggtataaagaataactatgtaacagatacttaatgacagtttaagccaattatcatttaccattagctctgaaatttccagaatgctcctctgtgataccagtctcttccctcccaagtgtaaccatgatcctgaaatttgtgtttattattccactacttttatggttttgccacatgtatctcccaatataaactttgagtgaatagagttacgttgaaacttgtgacttgcttctttcactcagcttaagttcctgagattcatccatgctgctataactagatctgtttatcttattttcacttttccatcattatttgtgaattggtattctataatttgctatccacttactattgatatcctctctttttttgctattatcattaatttctgctatgaatattgttaaatatgtctcctgctgcgcctgattctaacaagtagagttgactcatgaggtatttatatcctcagcttcacgagataacactaaattgtttttcaaacaatttttgttgttacatttgttctaccagtatcgaattgttcctgttctttcacattctggacaacacttgacagtgtcagacttttgcctgtttgacaatttgttgagtttgaaatgatatctcaatattttaatttgcaattagacgtctccttatttggagaagttctgtgtattctgggcactatcttttgccagttctcttgagttgcacacgtattctcccagttgcttgctggccttttcactcttatttggagtcctttgatagagcagaagctcttaatattaacatagttgagcccattaagttttttctttatgattgtactttgtgtcttctatcttaaaaatccacaatctaaggccgaggtgggcggatcatgaggtcaggagatcgagaccatcctggctaacacggtgaaaccccatctctactaaaaatacgaaaaaaaaattagccaggcgtggtggtgggcacctgtagtcccagctactcgggaggctgaggcaggagaatggcgggaacccaggaggtggagcttgcagtgagccgagatcgcgccaccgcactccagcctgggcgacagagcaagactctatctcaaaaaaaaaacaacaaaaaacaaacaaaatccacaatctatttttcatatgggtaaaaaggactaaataaaatccccttatatcatttaagagggaaaataattacccaagaggagaggaaagaattggattggcttggaagtggttatttttacattttttcatctgtagctacactgtgggtagaaaaatagaaaaattacttgtgataacccagattacttagcatctttagataataaaagtttactcttactgtggcattcacctctaatttaacttcatgagtctgttttcttagtcaactgtactagatgctagagatacaaaaattgttacgaggaggaagcaagcgtctaggcctccacatctggatagccattctcacatttaccacatcacagggatgccatgcaagggcagtacacagaagtttatctgtgtttcattttataatcttagtattttgtgtgtccatactcagtctgcccttggttcccactccccactttgctcttctttgtatataatttgatttgtgcctcatcttcttactagtctgaacatgttgttgaggtaggatatccaaccatcctggtttggctgaagttgggagacctcctgggatgcaggacttttagtgctgaaaccaagccccaggtacctgggacaaattggtcaccctactttgagggcaaggactatgtatgttgcatctttgcaccatgtacaactcattttacaatgtttacacatagacagtagtttttaaatggattttgcattaagttggaaggcactcagttctgacatggatccttccagtcattcttgcaagttatgtttattttctagcatctgatttcatgaagctgccatttttcttagacaagttgactcttttttcttgaatccactgaccttagggtagcagtaaactttgtttaccaacagggctctgtcatccacatgagggatgttgccattaagtgtctttttttttttttttttttttgagatggaatctcactctgtcgcccaggctggagtgtagtagcgcaatctcggctcactgcaagctccgcctcctgggttcaggccattctcctgcttcagcctcccgagtagttgggaatacaggtgcccgccaccacgcctggctaattttttgtatttttagtagagacggggtttcaccgtgttagccaggatggtctcgatctcctgaccttgtgatctgcccgcctcggcctcccaaagtgctgggattacaggcgtgagccaccgtgcctggccaactgtcatttttccccacaaatgcatcaaagcttgtttattaaaacaaatttattatgaatcaggattaattaacagattaacatttaacatactttaattgaagatattcatttagattttgttctgtcgtcaagtaatcacaaaagttgtagttaccaagttttctgccattgttgaattatcctggaggtcacatttttgtgtacaaattgatgagggacttgcttcgtagtataatttgagaggtggctgaactggcttctatagctagacatatttccccttttgggctagtgagtgcctccattagttgtcaccccttccattgtaagccgtttttcctcccgcattaccttataaaccacaaatgcctggaggagcctcagcatattaagacagttttgatcggtaccccttttagcagaagttattttttcagctgctttccaaagtaacagatgagagggaatttgaccttgtgaaagcaattgtgaggcagccaggtaggaggtgccgcaggaacactgagcagcaggggcaggaggccgtagctgtgtgtgtgtgagctggagtaggacaccttaagggaaatggctttagggatcaactttgctgttccacagtgctgtgaccttgggcaagagaaaagtctttaacaggtttgatttatgagaatattttctactctcgatagaatgcagtggatatctgatgcagttttgtgccatctaagtgactactgagagaagatttccaaatttctctgattgccatcagtagggagtgatgaagtgggattttcttttctagttgcctttatccgtgtcggtgaaatgagaacaaagctctctattctctcaatttagaaagaaatcagatctgaatctccaaaatcagttgaacatccttcaaccagtagttccgtgtctgatgtgtagacagtggtaactgccatactgaaagaaatgtagtcttgtgataattcagaactggacgtaaccaaaaaagtggtttttaatcacaaaattattttctggattgtaacaatttggaactggatataacccaaaagggtttttttgtttgttttttactcatgatataatttgtctgagaaaagcttccccagttgtgtggcaaataggttaggaggcctatttgagtaaaaatccaactgctgttacagtggaccttcagaataatttaatttggtcaattgtccatagctgtagtgaaattttgtcttaagaagcggtatctgaaaggaacttatgttacagactgaatgtcccccctcaaattgaagccttaacccccaaatgtgactatgaggtcataagggtgtggcaccaatccaacaggattgccgtctttataataaggggaaggaacatcagggagacatacacagaaaaggccctgtggggacacaaagagaaggtggccatctgcaagccaagaagagagccctcaccagaaaccaatcctgttggcacctcagtcttggacttacagcctccagaactgtgagaaaataaatttctgttgtttcagcaacccactagctggaattgtgtcacggcagcctgagcagactaatgcagcatctaattttaaaaaaatacttttcaaatattcaattttcccaagtccggtgatcaccacttggtttctgaatttgattttctattttctagtgaagaattttaccctgttccttcccgttctaggttcacagactgacttctggtccttgctgggggtgctgccagccttggaggctggtgagttgactttataagaaaatagaaaagcctaagttacagcaccagctttcttagttttccacagttcatggttctcctgtaggccactaatattcctgatacatctctctagcttttgtcataatcaaaatcggttgactgtataatacgtggtgcctgcttgcactgatgctgtgttattctgtttgtttgtttgttttctaaaggggaatcttgtagattactagagagttcatgatactctggtatcagttatgccacaaactagtattaatccatggacatttcccgccagcccaacctgccgcagaaactcaatttgagggttttctctatgtttctcgttaatataactttcatcctctgctaagttatcatttctctttacctggagccagaaaagtaggaccctgagccgaatctgcctctctacctgcttttgtaaatgaagtttcattggaacacacaaccatattcattggtttatgtgttatctatgactgttatcacacaacaacagcagcattgagaagttgtaaaggagcaaaaaaagacacagaaccatctgaagtctttgtgcagtggctcatgcctgtaatctcagcactttgggaggccaaggctggcggatcacttgaggtcaggagttcaagaccagcctggccaacatggtgaaaccccatctgtgccaaaaaatacaacaaaaattagccaggcatgggggtacacaactgtagtcccaactactcgggaggctgaggtgggagaattgcttgaacctgggaggcagaggttgcagtgagccaagatcctgccactgcactccagcctgggcgacagattgagaccctgtctcaaaacaaagaatctgagcctaaaatatttacaatctgtatatctatcttactaaaacatatacttaaggaaaaagtttgctgactattgctttacgttacctattggcttgacaagcccaatacattcccatttcttattagtacacgaatcataaataatactgagaaactataacttaatattgttaaatcttcttctctgtaattatagtaaaatttgagaggaattagtatggtatatccctatctgtttattaagggagtgtgtgtgtgtgtgtgtgtgtgtgtgtgtactatatgtttaataaaatcttaggaatactaggatttgttgagtagcgttcttatttaaaaaatgtgtaaaatttaaaattatgtaaatattcataatacagaagtcttcttagctttaaagatttacctgggtgaagacaggcattgtctgtacttgatcaagtaaattttcagttcattcaaaatgtttattttgcttgcatcttaccaaacctcaacttatagtcagttgaccaagttataaaagttctctttcattcccatgagatctcaatctatattggtggaggtgggagtagtaatattataaggcaaaatctctcatctgttctccagaaattaagtcttaacaatgttttctaagagcaatagccctgatgcagtgcttaatgctttatttccatatttgttatttctgactgctagaaagcaaaggtcactaggtcaggaaattagcttaagggggaaaaaggaaagtagttactcttaaggttaaaatccatatagtatgatgggttattgtgatgaatatttagttttgaaagacttcatttattatgtaatagccatatgcagttaacagaatgcttctgttagtgaacctcacaaatgatttagtaacccccagagattagctggatgttcatatgtagtagaagaagaaagcaaatttgacattaaaaacaacacataatgcaatgaaaacaaaataccccttaagagttaccatgtactatacaagacccaccagtcatccccagtaccattcagagcatgagattgattcagtcatgtccaccatctggttctataccggttttcaagtcccaatgatcatagttttgataatgtaccaggtaccatattaagggcttcatatgtaaataattttaaagtttttttttttaatttgaagaaacagaagtcaggttaacaaatatgccttaggtaaagtaaaattcaaaccaagtaagtaagagttcaaagtttatgcagtattaaaaatcatttctggccaggcatgatgactcacacctgtaatcccagagcttcagaaggccaagatgggaaaatcacttaaacccaagagttcaagaccagcttgggcaacatagggagaccgtatctctacaaaaaaaaaaaaacaaaaaaaaacaacaactaaaaaattagctggacatggtggcgtgcacctgtaatcctacctacttagcaggctgagtgagaggatcgcttgagcaaaggagttcagggctgttgtgagccatgattgcactactgcacttcaccctgggggacagagcaagaccctgtctcaaaatacacatacgcacacacacacacacacacacgtgtgtgtatgtatgtatgtatatatatatataaactttgtttatgtctctcctgatctgtaatctcttaaaagacagagactgtatttttctaattgtttaattcccctagtgctcatctggtacattttctacctagtgcagtcgtatcttatttagagtctcatttctaaaaactgtgcatagacaaaattggttttcaaaaccttttaggtaaagcccatgttggagactgacatatgacatttcggtaaacccaacacttctgattttcttcataacactggaaaaatatggctgtttttcagttgagcattagataaaggacttttcctatcctcaggggtcatgttgtacgtaaaatatattctttcatacaccagaattacactcaacatgacattgagaggcatgaagagatcaagacttactcaaagagttgcacatttatgtctctcttctcatgctcactgtggggcatagtattgacattgagagaaccctgaacagtattatccttgagcctcttagggcgtgatttaactcacataagttaaattcaccaatggtgccaaaatattgtaccaaatagagataaagacctcacattcctttagcacttactatatgccagccacattgaatgaactctgcacttaataattctcatgacactgcacaaggtatatgtcatcactgtctttgtgttatgagtgatgaagctcaggtgtgcctcagaaaagctgagtaaattccccagggttgccctgccagtgaatgccaaaatcaggatttaaagacctcaaatgcttttaactatctagctttgcattttccttaagaaatgttgattgaaaaattacaagtaatagtatatataatttatattttgtatatataatttatatatacatttatataatatctatttataacatatataaattatatatacaatctaaggttgtacactatctgcctttcgcttcaagttgatttttataaatagtcttctccatgttgtttctatattccaaagaattatttaaggtagtaaaatcatcagccatttgtaaataggagtccagtcatgcaaaccttagctatagccccacgaaggctacaacagctgggagcactgttcacataaaacacaacataaatgatgcccccacccaggatgcagaacaatcactgcccttgcctgctagctaggcactggattcatcaagaacattttaggaacagataaactcctaaaactctttatcacacttcattagttacattcagtgctatgcgtccaaattctgctcctgtacatgtttaataaacagagatgtctacacattgtctgattgtaaattgtgaggatttcagcatggtggactttgggtccataaacacataggcttctcacgtttatacagaaagtcaagcttgatttggggcttaaatccattgtgaaaatgcagtagatcttttaattaggtgaggatatttctaaagacatctttaatgtctattttattagtgatgataatgtaatcacaaaaacagctaaatccaaaatatcctctccacactcatagtagtccaccgcctataaaggtctttaagaaagcagaagcacagtgttcataaccttgctggcatgaggttaattcagaaagtcacttggtctttgctcttgacctcaaaatctacctcctgttaagaaggagaaaaaggaagaaaagcatttgctcgtcacttgtcaggaaataaaaggaagaaatgggatactgagagtaaagtagtatagtggaaacacgcattttctattttctacttaaagttccattacctttcaacattgttgatattgtagatgaagaaatgcttgcctactctctacaaatgatatcctatcccttacaagaacagataaacatagtggttgggaaacaatttaaattgtttctgagttctttggaggatttcatgtaaattcattagtaactctggaactatctactatgcatttaaggaattaaaaatgtattagtttcactacacaaatgtattagcttccactctgtagttaaatgaaaaatgtattagcttatatgtataaatatcttaacattcagtctgtagtattttctcttagatattactccatttgaactagtctataatgcaaacactgcttaaagtctcaatgctggagaattacactttttaaaaaattttcttaagtagcagaaaatatttgtgtatgcggcaatatttgtttaatatagcaaataagtattccttcctaaaaatgctctttcagaacttattcaatgctataatagttttggaaactgaagaaggatattactttttgaaaaatttgaaaaaatgctttcagaacttactcaatgctataatagctttggaaactaaagaaggatattagtttttgaaaaattctagggccgggcacagtggctcaggcctgtaatcccagcacttggggaggccaaggcaggtgggtcatgaggtcaggagatcgagaccatcctggctaacacggtgaaaccccatctctactaaaaatacagaaaaaaaaaaaatatatatatatatatatgttagctgggcgtggtggcatgcacctgtagtcccacctactccggaggctgaggcaggagaatcgcttgaacccgggaggcagaggttgcactgagccaagatcacaccactgtactccagcctgggtgacagagtgagactccatctcaaaaaataacaataaaataaaaaattctataaatgattacatacattaaccacttgaaatctaaaaaaaagaaatccagtattggggtgaagattttattcttagtagaaagacctggtatgtgccactcagttattgaagggattcgtttcatgtagtaactaaatatagatcagcaagacagatatctcggaaccatctaggggaatttgtaagttttcatcgaattttttttttctagtgagcgatgttgctgtattacacttaaactgaaacctattcactctctacgcacctgttcaatgccaccactctggataactgttaaaattcctttccctctatatctccttgaaaaatagcctgttacatctgatgggtcaatctgacaatctccaaagaaagataaaagtaaagtcaaaaaaggacagtgtgagatattgagataccaaactgtaattggaaatgaaaatattttctcttcatttttctggttctcccacactttttcctctattaacaattttagccatgccttatctcccatttaactgtaatttgaaagtgaaaaatctgtgagtaaaaaaggtgctgtttgtgtatatctacataaacattcatgcatctctatcccccatgtccagtggctccttcaccatggaataactagatcccaattttctgttcctttgtctttcagttatttttggaagctttcacaagggcgccttgaatgtgcccacagcaggacttgttagttggaggcaccacccagcatctgccctgctcattgcctattgtggctttttctggccatgttcagagcttgctcttggatcttgatgaaattgaaactggccagattgtcccatagcactgatgtttatggtttctttagaataaacatagaaactgaccctcccagtcttaaaacttgagaaagttacgtttgttgagttcctttctcaggaaaccaaccatcaggtctcccagatagtttcaaggaactgaaacttaccagatcaccacctctggacaatgagacaccagacccctcacgcatcattattgcctaaccgagcacctgcttcctgtggaccaacttctcttccttactcctccctaattcctgttttcccacataaggttacatttcttccctgctatataaacccctaattttagttggtgagacagatgaatttgagactgatctcccatctccttggctgcagaacctgattaaagccttcttccctgacaatacttgttgtcccagtgattggctttctctgcagtgaaaagcagaacctagaccaaaccccaaaccttggcattttggtattggtaacaaaagcttccaccacctattaggaggaagaggacaatagagctaattccacatactctaaaaactttacgtcatcaggcatcagaatgtacttcatcccctctcttctttggcccctctgttactattgaggaacactaattatgcttatgtaaattagacatagaagatagaatatttattgcctataggggctgtgtaatcattttatagaagtcagacacctacaacctgctcacctggggaaaaaaacccaggaattatttatctctactctttaaattatctgagttaataaacacatctagaattgaagtgttttagaaaataaataaaagtcctccttaatgcatttttttattggataatctccaaacttcccaacccaaactcatatctgtttattactttataactgtatccccactcctaatatgaacagtgaagtccaaataagcttataaaacccaaacaaaattacaaacaccaattaccaatagaggtagataaatttttataagcatcaaattttatgaagagtgttttctagtcatttaaatgtatttgctgctgaaggacaaaacagtattaactatctcaaaggcagtggctttagaattgacaataccctttcatatacatctctatatcagtttttaattatttgtaattatagtgcatagtttccattttcttttcctctttctttctttctttgttttttttttttttggtttttttttttttttgagatagcgtctcactctgtcacctagtctggagtgcggtgagtggcatgatctcagctcactgcaaccttgactttgagggctcaggtaatcctcccaactcagcctccctagtagctggatctacaagtgtgcaccaccacgcctggctaatttttatatttttagtagagacagtgtttcaccatgttagccaggctgttcttgagctcctgggctcaagtgatctgcctgctttggcttttcaaagtgctaggattacagtcctgagccaccgtacctggcctccattttctttacatacacaaggtgcttaaaccatttttttaaataagctaattgtagaggtacaatttgtaagtgaatggattaacaatttgcccatagttacaagtttaaaagcaaaatggattctgattccaggtatggcttccaaattctggcttttttaaaactgcaaaccatgatcaaagttagattaggcattcgatgaagagtcctcctttcaaaaggagccctcctttgccttatctctgaaaccagcagagtacacacacttcagttgctgttcttcaggttgtgcaatacaggggcccaagtatgtcaccccgtgattggtccctgcctcaacaagaaacatcactgagctctgaaggtacctctgctgtctgtgtctcttgggatttgaattcatcctcttgattattactgccctgcttattcaactcctataaatcctataaagcctgtatgttttaccatagttgtcaccacgcatgtgacattgggttatctgcctaacctctgatgtccctctagatctgtcatctaatactcatgcctacccttgcctaaatgtattttctacatttctaacttccgattacagacgcttcccttgattgactcttcatcgaatgcctaatctaactttgatcatggtttgcagttttaaaaaagccagaatttggaacccatacctggaatcagaatctattttgcttttaaacttgtaactatgggcaaattgctaattccttcatttataaattgtacctctacaatagaggtagataaatgataggtctttaatgagttacatgtataaactgccaaccacagtggtggaatttataggaatttaacaagtgataattattgttctcctcttgcttgactttaacttccaccttattggaaaaatttttccattaacttctaccttaatgcccattctcacatggcttcagattcatgaccctgtgcagattctttaaacctgttagtgctcttttggatccttgataatagcctttctctgtttccagcctcaccttcaaactcctggtttcatgtgattcagtgttgtgcccctgtccccaacagagctgtagcaataaaaggtttccctttcaggaagatgtgaatatgccttaaacctctttaagcccttaaaatgtaaatcgaattttatttgtattataaagaaagttgcggtttacaaattgaagatttctgtaatgaagaaacatttatctttttttttttactttctgacacacattcagacatgtcattagcttttttaaaactgcaataatcaataaactttgatacttacctattttaattctattcacaactcaaaaactgtatcagagtgaatttctttatatgaaaactaatatcgttgatgaaaccatttagctagacatatacagtgtgatgactaacaggcatctcgaagtcaacttgttgacctgacctcctctttttctcccccaaacctgtgtcacctgcacatgtccccatttcagataatgacaacttcatctttttcattgctcagaccaaaaccttaaattcttttaaatttgtttgctttctctcatgtccctcagccaatatgtggctttacctttaacatatgttcagaacccaactattagttctcaccaccttccatgctaccattctggtctgagacaccagcaagcatctttcttctggaatattaaaataccctcctcattggtctgccttttactccctacaatctattttacaatttggtctcactgcttttcccctttcctcctacactgtattttcaacacagctatccgagtgattcttttaaaaagtaaaccagaacacaacattcttttttttcttcaaaaacttgcattgactctccattttactcagagcaaagccaaagtccttctcttactctgtcatgtataacctgcactgcatccctcctcaactatctaactcctctcctcctaattctattctatgatattttcttctattcctatttaattctgtcctagttccactggtgccctgccccacctgttaacatgccaggcttgcacctgccatcaggctatggtctactactccctcagatcagtgcttgcccaactccatctcttcctcaaaaatttgctcagacctcaccttcttaatgaagctattctaaacacctatttcctactgcatcttacgcacttccctccacattcatggagctcccttaccctgttccactttttctttttttggtaacatttataaacttctaacacactatgtattttgcttattatatgtttaataaattcttcaagggcatgcatctctgttttattccctgagaatagtgcctggcacacagcaggtactcgatgcatatttattaaatgaatgaatttttctttgtctgaaataaatttatttggaaaatatttaacacatttgtgttttgtttagttggggttttgttactactgctatttctataaaaggttgaaatacagaagggaaaagaaaatctcaccagctatctggccttgtacagataaagccaaatgattgaatgcttgactgaattgactggttgtttggacatattttttgtaatagcttaaggaacaactaagctatctgacttccaccccctttccccgtgctagggctagaactgtcaaaaaggcacataatacacatttgggttttaaagaatttagttaattgaattcaatgaaccaaaagtacagtgaaaatcatcaacatttatatgtaaaacaaattctgtttttgtctggcttaaaggggatgtagctgggggctaaaggattagaaatgagtaagagaataatctgacattgctttgcttttcatgcaagctttgtaagctctcaaatggcaatgttggagaattcattacattgtggtaaagtatgacaagttgaagagtctaaattgagtaacaaaagcaaacaccaacatattatacatgaaaactgctgttgaaacaacagatcaaaaactgtactctaacactgtagcactttttatatttttctttattcagagattttgtaaggctgtttatgggttagcatggaaggaataaggctttctaccaaaagcagacacacagtttttgtacagaaatatgtctaccagggattatatactgaggaaatggtgaattgatggaaagaatacgataaacaaggggggaaatgtagtaaagaatcagtggttacctgatgcagttctttaagaaaaggatgattgggtagtgggaacacttacaaagctaaacagtgactgtgagataataactggacacaagaacagctctttaatatctagtgagtgtgtgtatatgtgtgtgtgtatatatgcacacatatatctttcacacactgtgcacatacacacacactttgtatgaggaaggtctatgatcagaaatactaacatcactattcaagccttgatgacagattttccactcctgtgataattcctttgtagctgattgactttggaaccagagagtcccttctaacaatgcagctattcctaggattataggttctcatcaatacctctttttaaatgtgtcacatttgtcaggtcacttttctctctgaaggaggcagtatcagagtgctggacagaggataagaggggaagagaataaggatgattaacaggaagagaaaaaaattggagggaggtcataaagattttccttgatttctcaattgtgccttggcatggaactaagacaaattctgccagatcacccattaaaagtcagtgtacttaataccctcaaaattaatgctatatacaacttcaactgtatgtttttttaaaaaagaaatgcaccaaacgcattacattttaatgatggatagaattaaatgctgtcatatgcttggcctttgcaaattgctccattaattattataggtgcttccagtgtgacatgtgagtattaaaaaaaactgtattgaatttatctgtaaatagatttgaaatgattggtgtacattctgttgaaacttcccagggagtacatattattcacattttttgtagacgtgaaagcaggaaacacttaaattgtccagaaatcagcctttgcattaaaacatctgcattattttattcctcataactgtaggaaatatctcatttaagcaatcttataagtcaactaaatgcaaataaattctccagtggagaatgacaagttcatcaacttgattccctcccactcccaacattttctgtcttattgtcaactgcttcacatggtctgttcagtggatgtgtttgtgcaccatcttcacaatgaccctagtctacattcctggttatatatcattactctaaatatcccccccaaactgtggcaaagctttgcagcacaatgaattacaatgcaatttggtatcatggaggtgaattttttaaattttgttctttgctgttttgccagagctgattgatgccagaaaggaagattgcttagaaactaggattctatgatagcctgtattgacagatgcaacttttaaaaccagtcagattgcaagccatttttacatcatattgaatcatatacttaattatgtctgtacttctttcacaccttaactttggtgaatctcaaagtatttcatgaaaacttggggaagacatcctccgtattagtcagggttctctagagggacagaactaataggatagatgtgtgtataaatgagagtttattaaggagcactaactcacatgatcacaagataaggtcccgcaataggctgtctgcaagctgcggagcaaggaagccagtccaaatcccaaaacctcaaaagtagggaagccgacagtgcagccttcagtctatggttgaaggtccaagagtagaacttgcagtacaatgtttgaaggcaggaagcatgcagcatggaagaaagatgtagggtgggagattaagcccgttcagtcttgctacactctgcctgcttttattccggctgcactggcagctgattagatggtgcccacccagattgagggtgggtctgccgttcccagtccactgactcaaatgttaatctcctttggcaacaccctcacagacatacccaggaacaatactttgcatcattcagtccagtcaagttgacacccaatattaaccattaaactctccttcctctattaaaccacataaattatatagactatctcacatctttagtgccattgcctgcctgcctgaccatgttttttatatgtgtgtacacatatacaggtatgtgtatacagaaacaggtatatgtatacattcttgtgtatattggtattatagccaaatctaatatgtgtagcttccctgtatttgatgaatcccctccttaatgtctctccctctgctcactgatcacacacatatttatttctgcacttaaaagatagatacttacatttttctgtccttctgtctttgttcctgctattccttcctcactcatctccacttgttgaaactttgtctgcccctcaagacccagggggcatattttgttctgattgtttgggtctcaattcaaaatctaccaacagataggctgtgtgatttgatgcaagtgatctaaccattctaaaccacagtgtcctttacagggcagtggggatggtaataaaatatacctcatagggcagatgtaaggctatattgaaataatctttttaaaacattatacacaactcttgccacaaaggaagggcttaaacaatgcacgctaaactctatcatctctatggagccccttttatctctatgtattaatctcttctcaagtgatctcatagtgatttgctcttagaaagctttttgtttgtttatttgtttgtttgagatggagtctctctctgtctcccaaactagagtgcagtggtgctatctcagctcactgcaacctctgcctcccatgttcaagcaattttcatgcctcagcctccagactggctgcaactacaggtccccaccaccacacctggctaatttttgtatttttagtagaggtggagtttcatcatgttggccaggctggtcttgaactcctggcctcaatgatccacccgcctcagcctcccaaagtgctgggttacagtcctgagccacagtgcccagccggaaagctcttattgaacgacgttcactagtctagtgacttgtgtgcatgtccatcttctgcattactgagcatgtatagatctacaataacaaaactgtgcgagatgctgaggatatagcagtaaaaatacaggtaaggaatccctgattacctttcaggtggagaagacacataaacaagccaacatcagtggcatattttcagatagtgataggagctataaaggagataaaagtggtgatgcgatagtctccattctgctttgtatgttaggagctacattacaaagagtagactgagaccacactattgctttagtttctctttcaaaggctccctgactccctatatgtgaggtcacaggcaccctatataaagctgccagagctatgcttcatagcttctctggcagctgcttcctccctttcattcaaatttatttgctctcatcagatttaaacgcattttctccttgtatctgatcaccccaccgtgtcttccattttactcagattaaggccacagtctgactggtgttgatttcaggttcatgccaagacactgtaagtaactctcattcctccttatgattccatttactactgcctaagagcacaagcgcagagccagggcatctgtccccatgtcctgccccccagtgtgtgttcttccttaaataaccaggtagggaagggcagataaggaagcccctacaggcaagtcctaatggtcttccaaagggaaaggaacttggtcatagatgctctcaataatagtaccaactcccatcgccgagttttattttagagtctcagaatgggtctagtgacacttgctctcataataaagtagaagaaacatttcttttggataaattgcccataggcttcattatcagaagctccatacatctaggtttctaacacttttaccatctttcaccatgagctcctttcagaaactctcttgagtctcagagccaagaatgaatgctgagggaaaagggagatgatatctatcttgccatgctttaccctgtatctctctgcctgtctatccatcactcaattcagatgtatactttatccttccttttttctgcaaaatacctctatctaaacctgagagcacaagactatagaagaactggatttcctaagtgagtccatggattagactcaccatgccctatagggtctgtctatagaggagtcacagaaactaggacatttgggctctctgaccaagaatcactgaaaatgggcgcaggctttttgtggctaaccctgagcatactagattaatatatctgtttgaagtgtatgttagggttgcatctagagataaacgcagtgactctaactgatgtcaagaaaagcaactaaccccttgtcttgtattctgcaaacatctagtattattctgcttgttcccaagacacaggcttcatgaattaatgcctcctttcccagttaaatattcaaaactcatttgcctaaactaagtggcaaagaaaaaaaatttaaagatgggtgtggaggagcattgcttgattgtaccaaaagcatttgattaaattgattggagagctacagccaaattaacgaagactggcacaccttacctatctctttctcttatttttcagacatgaaaattgctcaggcttcaagtctagtctgtgtgaaagcattaagtgtttcagaaatcaacatgtcttatcaatctattgtgctctggggaaaaaaaaagccagttagtgacattatttccttatgttctagaaacctgataataccttattgtacatcaggagtataagcaaatttcattgtaaagaggttcttctgacaagatctgtgaagaacatgatgttattaacttagacgtctgcacttacaatatagcttttccaagacaatttttgctgggctacaggtggttatttaagacaatcaatttacatagaacaatttattcttttttcatgctgttaaagcaaattggtatgtaattagatttatatactgaataatctcatttgcatatccaattaattcttcctgttttaatttgctagggttgaattcacattagtagtaaaaataacacttaaattataaaggcctcaaaattttctttgctgtaatttgttcaagatgttgcatttaaaaattggtccccagcattctttacaaaatctactgggaatatgtgaaagattttacttaaaagtgcccttagccaaatatcacacttgaggttcactctttgttcatgatgaagaggttaatggatggtagaaagctagtccttgcctcaatacccaataatattcaaaacaaggaaaactcaggttctgttttcaccctctgacctttcatgctttgagtatgtttaaacactgagacatacatgcacagaaatgaaatctgttcccaaataatttatatttattcttcaactgtatcacttcaactattgttgtttaacacagtgggaatatatatactgtagacaaatattattctttttggattcagatacaccagagcttagtatttgtttgtttcttttgccacttctgatattgggaaaccgattttgtctatctaagagtcagtgtcctcatccttaaaaccaaaagagaaaaatatgtgcctttctagaatgactaatttcacatggcataacatataaaagtatctactagtgtggatccaacaatagaagatgttcagtcagacatggtatctggtctgtaataaacatatataaacactatcaatcaaaatgaatattcaatttctaggacttcatagtatttttattaagttcagtgaatgtttgttagtggccattttcattaccagactttagattcaaatattggctaagcattttgtgcaaattatttagtctctctatgccttagtttcttcgtgtgtaattcgggaataataaaaagtatttttacctcgtataatcgtggtcagaattgaaggggttaatacataccctcagactattccctggtgcatagtaagcactcaatgaatgttaaccatggctatcattgttaccatgttgaaagaataggcacccatatcagagtttctttattgttatctattagtaagtgtaagagtgttttaggactaccttaacaaagtaccactgactgtgtagcttaaacaacaggaattaattttttcatagttctaaaagctagaagtccaagatcaaggcttcagaagtttagattgttcctgaggactctctccctggttttcagatgatcaccttctccctgtatcctcacatggcctttcctctgactgtatccaaatttcctcttcttataaggacagcagtcagattgggttaaagaccaccctaaggtttcatttaacttaattacctcttaaaaggccctgtgtccaaatacagtcacattctaaggtaccaggggttagggcttcagcatgaaatttggggaaacataatttagctcataatgccaaggttgaatttcccttatatctggtagagaccctgaagctctgttttcagaactgatattaaatgtaagcatatctgtgtacttaaggtatttaaaaagcaaggccaggcacggtggctcacacctgtaaccccagcactttgggaagccagggtgggcggatcacccgaggtcaggagttcgagatcagcctggccaacatggtgagaccccgtccctactaaaaatacaaaaattagccaggcatggttgtggacgcctgtaatcccagctactcaggaggctgaggcaagagaatcgcttgaacctgggaggcagaggttgcagtgagccgagattacaccattgcactccagcctgggcaacgagagcgaaactcatctcataaataaataaataaataaataaataaataaataaatagcataagtaacctatgccttatctcaaggtcttggcccattttctgcagctacagccatgctttcaaagctatacttttattttctcccctcagatttttatagcctgtgcatcagattcatgtaatagaaatgtcataacatttatattaggtctctattccagagacctaggcttacacctcatatttgttgtttgttgtataaatatacacatacaaattacctaaactcaggcaagtgattttacctccatgagacctccttttacttatctgtaaaaggggacatatttcctcacaaacagatgcaaactaagacaggatagggaaaagaattttgtaaattctaaattgctgtagagataccagctgtctctgcttactgaaaaggcaatcttaattccattttctattttatggtcattgttagtttacagttactaatattaaatggctttagtggtcactttaggagagacatttactttgttgttaaaccaatatgtttacaattagatataagtttctttctggatttgaagataactgtaatttgcagttgacgcttatgcaaattgctatgttctgctgcatacccattttaaaatacaaatccttcccagtcatcactgagtgtatataacaactgcaaagaaaacgctctgaagatttttttttcctgtcaaaatgccactttgccttcagaaccaccatctaaacattatcttaatgacacttactttatttggaatgccagtatcctttgtgtaattttcagatagcctgcagatatttgaaaaactttaccagcttcttcatcatttcagtctgggaaatgagcatcctattactggcatgccttgtgttattgtgctttgctttattgcacttcacagattttgagttttttttgcaaactgaaggtttgtgccaacactgcatcgagcaagtctactgccaccattttcccaacagcatgtgcttactttgtatctcagtgtcacatttttgtaattgtcacaatagttcaaagtttattcttactattatatctgttatagtgatctgtgatcattgatgtgaccattgtaactgttttgggataccatgaaccgcacccatataagacgaagaacttaatcgatcaatgttgtactctggctgccccactggctggcctctcccccatctctctcccttctcctggggcctcccttttccctaagaaacaacaatattgaaattaggccaattactaaccccaccgtggcccctaagtgttcaaatgagaggaagaagcgtacatctttcactttgaataaaaaactagaaggaattgaccttaatgaggaaggcatggtgaaagccaagacaggctgaaagctatgcctcttgcgccaaatggttggctaagttatgaatgcaaaggaaaaattcttgaaggaaattaaaagtgcaacttcaggcaacgcatgaataagaaattaatacagtcttattgctgatatggcaaagtttgagtagtctggatagaagatcacaccagccgcaacattcaacattctcttaagcgaaagcctaatccaaagcaaggccctaattctcttcaattctgtgaaggctgaaagaggcctggaagctgcagaaaagaaggtggaagctagcagaggttgcttcatgagatttaaggaaagagatgccacctccttaacataaaagtgcaaggtgtagaaacaaatgctgatatagaaactgcagcaagttttccagatctagctaagataattaataaaggtggctaccctaaaaaacagattttaaatgtagataaacagccttatgttggaagaagatgccatccaggactttgataagtagagaggacaagtcaatgcctggcttcaaaacttcaaaggacgggcttactttcttgttaggggttaatacagctggtgactttaagttgaagacagtgttcattgaccatcctgaaagtcttaggacccttatgaatcatgccagatctactctgcctgtgttcttttatggaacaacaaagcctggataacagtacatctgtttacaacatggtttgctgaatattttctgcccactgttgagacctactgctcagaaaaaaagattcctttcaaaatattacttgtgtttgacaatgcaccttgtcacctaagagctctgatggagatatattaggagatgtatattgttacccttccagctaacacaacatcgaatctgcagccaatggatcaggagtcattttgactttcaagtcttatttaagaaatgcattttataaggttatagctgccatacatagtgacttctctgatggatctcggcaaagtaaattgaaactcttctagaaaggattcaccatcccagatgccattaagaaaatttgtggctgggcacggtggctcatacctgtaatactagcactttgagaggctgaggcaggcggatcacttgaggcaaggaatttgagaccagcctgaccaacatggtgaaaccctgtctactaaaaatacaaatatatctatctatagatagatattttacatataaatatatatatttataaatatatataatataaattcatattatatgtataaaatatgtatttttataaatatatatatatatataaaagggaagggaaaaggaaggaaggaaatttataattcatgaaaagaggtcaaaatatcaaccttaccaggattttggaaattgattccaaccctcacggatgactttgaggggcttaaagctttcaatggaggaagcaactgcagatgtggtggaaatagcaagagaacaagagttagaagtggagcccagagagagaagtgattgaatcgctgccatcatgataaaacttgaatggatgaggagttgcttcttatagataagcaaataacatggtttcttgagatggaatctattcttggtaaagattgtgcaaattgttgaaatgacaacaaaagagaatattatgtaaacttagtggataaagcagtggtggagtttgagaggattggcttcagtttgaaaagaattcctactgcggataaaatcccagcattacctgctgaggaagtctgtcatgaacggaagactcaatcaatgcagcaaacttcaatgttgtcttattttaagaaatggccacagccaccccagccttcagcaacatccaccctgatcagtcagcagccatcttaatcgagggaagactctcccccttcaaaaagataacaacttgctgaaggctcagataatcattagcatttttaacaataaattattttaagttatgtacattgtgttttttagacataatgctattgtacacttattaaactgcagtatagtgtaaacatgactcttgtatgcaatggaaaaccaaaaaacttgcgtggctcattttattgcagtatttgttttattgcactggtctggaactgagcttaagatatatctgtatagataagactatgaatgtatgaaatttcataggctggaggtatcttaaagaacatctaattcatttacaatcctgttataaaggttatagactctttactatggaacgcaaggatattaacatcttttactagcagacattgagtgaacaagtttatatgtcaaaaagactgttacggtcttttcctttctgatgccttctaagacatggtggacctaccagggtaaagattcaagagtggccattgcagtctatttaacagctccattctttcaccacctcctttgatctcatctttttgagcctctttccttgcagtgaagggacaagcagggtagaaaaaaatattcccttaggatcctcttgcttcctttgtgctcccgatgatccctttgtattttcaatctgtgggtctctttaatgcctttattctctccttctcccaaaaatagtgtcagttcaccaaggacaccacataggtagtcagtcatttggttcgatcagattctcatggaacctacaagacaagcacccttttcacttttctaggaatggcctcctcttagcatataatctgggtgttacactgaaaaaagtctagctcttcctttgattgagtagcattatcaaaattaccaagggccaggcacggtggctcatacctgtactcccagcactttgggagactgagccaggaagatcgcttgagcccaggagtttgaaaccagcctaggcaacgtagggagacctccatctctacaattttttttcttttttttcttttttttttttgagacggagtctcactctgttgcccaggctagagggcagtggtgctatcttggctcactgcaacctccacctccctggttcaagcaattttccctacttcttactctcgagtagctgggattacaggcacctgccaccactcctggctaacttttgcattttttttagtaaagatggggtttcaccatgttggccaggctgatctcaaactcctgacctcaggtgatccacccgccttggccttccaaagtgctgggattataggtgtgacccaccgcacctggccaaaaaaaaggtgttgtttttttttttttaaatagccaggtatggcggttcatgcatccagttctagcaacttggtaggaggattgcttgagctcctaccaacatttttcgattgctgaggcaggaggattgcttgagctcacaaggtcaaggttgtagtgaactatgattacaccactgcactgcagcctgggcaacagagcaagaccctgtctctgaaacagacaaacacaataacacaccaagaaatttgggaacagaagggaaataaaaacctcatcccaattacacattcacttacaaaacagatacttagaaagtgcctaaataagtactagtaatttatgtagtaccagtggaaagtggtctaatagtcttattatttcaactactatccttatggatctgctaatctaaacagacacctctctcccaaaatacagtaagtgttcagcagataatgaaaggggactgctgtgcagctgctgtggggcatggcattgaaactgaatccaaagcccactgggtctgtgaggtagatggaatgtgacagggagagaagagagaaaagacttcctagagaaggtgccaatgtttctaggcacacaggaataacaaagaaaactcagcaggggcccagagcacagggacttgtccaatgagatgagagaagcaaggaagtagtagtacaggtctcagtggaatccttgccttagtatggtatgtgattttttatagtgcagagtggatctcgtgtgtgaatgtattctccatcgtagacgtgtggtcgcttatcagtgtggtcacttatcaatcacatttaagctgttgtttaaaatacttatggatcttttcttttggaattttctttacggctcctattttattcctctgaatatttcaagtgcttgtaaatccttgtcctttgaagttagatttcatttttggcaacagctaagctttccatatttagaaacttgttcagagccatttcatggtaaatgttggtgttcatgctgggtaatactgttttttggtcaaaaatgaattgtgactataaattaatgaagctaatttttttgtgtggcttataaatcagttctctatcatttttaaagggggaattttaaaacatacgcgttaatacatgtgaaagcttttttaaaaattgtaaatctccacaatttttaaaaattgtaaaaaaagcaaggactttttttatttttattaatcattaagttatattacatttcaacatactgctttaaaactcaataaataagttttaaattctcttttaaactactagtttcttaagtaattgttcatttgatgttgtctaccagttgagcaactggtacattaaccagagctgtagattgagctcttttccaaatatttagattttgggttcatagagaaataccttaagagaattgtcaaatgaggaaactgacattcagaaaggagaaataagtaaggtatctaagatcacaagggtagtaattgacttaccaaataatatagtttcaaatccctgacattaagtcaactaaagattggtcttttcactgatgtagatctagtcattttagtcagaaatactcttctttctcctattttctctctaaaacctctgccttcaacctttgttagtctccccatctctttttgtattgcttctatctgtgtgagggtttggataacaagaagatagtcttctttcctttatatttcctttatttttcttcagtgactactcaaaaatcttacccagaatggacactaaatgaatgaatttctaattgttttgcagctttctcttctgttaggatcaagtgaccagttcgtctctaccaaacccaggatgtgtttttgatttatgtgatttgtggttttgagttataagtggttccataaggccaactagcagctagaaaacagtaagtttgggactgtaaacagttacagggaagtggaagtttttggttgttttattgttgttaattctttgttttgttgcccttggtagacaaaacttaagtgatgatagagcttacagttgctaatttacccaattccatgctttgctttttgaaagcaattgctgtgtttcccttcaggggatgagctttatttactccttctactccaaagctgagctataggaattcaagtggggtctggaaataccattgaaaaaaagagtttttttgaccaccttggcaatggccagttgtttctttccatggccagcctctttgttgtttgttgagaatactgtctaagaaaatcccctcaaaattagaagtctctgaaaactatacagatctcaagggcctaaaagggaatgttatcattttaattattgtgctactttcaaaattatactgtttgtaatcatgggtattgaaaaagcccagacatttgagtttaattatgtgctttgtaatcctaagatacaatccttttttctcatgcttttatataccgtgtttctctcttttctccaacacttaataaggccaacccaagggtattaattccgggaatgagtaaaaatggtgttattctttctcaaagcctagtcaggtcagtccacaagcattcagccctgctcacagtatgtatttgaagaatgtatctttgtttagaaaagaaaaggaaggtttgggaagagtgtggattaatattatatgctgcttccctttgggcctgttttttccccccagtcctttcttaccctagcaaatacagttaggagtcctggattgcacattgtaagaacaaataggaatctgcaggccttcctggaaggtctgggtcatagcagcttctttgcttcttcttcttatcttctgcgtggcactagctagtatgccccagataacacagggaaggaatttgactccttgacatcttacatgcagccaaacacttcagaatgtatagaactttctgaatccaggtagcatctcactctgaatgtcagatggatttttaaaaaatttattccccaaataattgtttatgaggaaattttttgtctctctaaggtgcagccacgtagagtcacttattctctgaagggtcccaccctataagtgatataaatcctgatatttcaaggaatttagaaaatatgtttgttttattcctcctccctccagtgtgatacagaatcttaataaggagcctatgttgccttttgaatcattaactctgaagaaagttcaggaatgttagacttgggagattaataactgtaactgcaaagagaagtcttgtctgttaaagaatttgtgtgcactattgcatcactcagtatgtatgtgaggctttctatttttaacatttttaatgacaagctgcctccttggttctgtatgcccttcacctttgtcagaatgagattgatagtgaaagtttctctgctgttctcataaaagttgaattaagggtcttgatttcggtttactgtactgcagcattatctctcattcatctagtggtctcttctctgtttctgtttcctgctctgcctgtattctagcatgcagggcagttggcagggactggccatgcaaaataatagctgtttccagaataagtcattgagtcatctgaaagtacaacattatagtgacatacctgacttctctataatgcagaaaagggagtcataataacttaaagcattgcacattgccagagctatttgaaatgacggaacatgaatattttgacatctagtagtagcctagtgcctctttgccagaagatgctaatgaaacaaacatggaaatcactgcgggattaccaagactgttttgactttctttcaggataatcccactgggtttttaacttgcaaatatctgaatgcccatcacatggaggaggaagctgatttgtttgcaatagaacttgaaaaaatggtgaaaactaaagatactttctaccttggatttcggatttgctttctgataattagagatatctcaaaaataaaatggactttctggaatggaaaagataagaatgttttattgtcctcgaggcattagaattgtaaccgtatttggcgagaatgttgaagagtagcaccatgcatcctagggaatttttaaaacaattaaaagagaataattataagtcaaagttatcaggaaggaaggacagatgtaatctcatttcgctgcatgatagtaaatgaaggtacatataatatttccaagagagaaaaatttactcaaagtccaagaaattcagagtaaattcaaatggataagaaggtaaaaatgtagtctaaggattataactacttctgcccatgcaaaaagcagttatgtttataatcccagattaaattgcccagaagtatcatcagatcccctatctggttctctttagagcatgtttcaccaactgtaatcaaagatttgtttttatgactgattgatgtctgttttctcccagtacattgtaaattccatgaagacagcaactatgtctgttctctgtttgaatcccaagctctagtacagtccctggagcataatgcggactaacttaacatttggtgagtgaattaatgaatgaatacattgtgacaattataatgtgacaataaattattgagaggtcaagtctcaaaagggaggtctaagctaattaattttctgaatgtgtatgcagtactagcttatgtacaaaaatctttcttcagatgtgtatgagtcagcagcaactggaacttggaggtggtctttagaccccaatgtcggtatctgttcaagtattctattcgtaccttatcagctgtcttccttttcctgtggtggaaggactgccagtttcatctaagtggtttgcctcagagttcaggagaatagctcattgggagttctggtcagatattttcaaactcaaatgagtaagctctctgaaaaacctatacataatgaaaaatagtttaagattacagtggtgttttgatgtgatctggaacagttcacccactcctacttggcaataaaaataaattatgcaatgggacagccaactgttacagcttggaaaactgttaaaaactcaaaataaatacgtaggttaatgtcatgaagtacttgaccggacaagcatatttttccaattctaagggtagaaagtgtctttgtaaacattcctacatgtcagaaaactaaataaaaatgacctctagcttcgaggcacttattggaaacctattttacattgaatacacaagccaagataatacagactgtttgataagaaacattagagaaatctgtaacatgaggctttttattataggtttattacatcaatctctccagtgggtaatggaacttgtaaatatactcttatgtaggagtctccttgtgggctttttattcatgctgaagtaagcacagcaaacttatttgctgtcagggtacattgaatttaagattagtatttattttggttctaaggaggttttgcgtttgtgaattgaaagttggatcagctgcatgaaaacaagatgggactacagggagcacaggaagtaaattagttttttctaaatatgcattctgtaaacctacgtatttagctagcatggggtgcgtatgcgcagtttctcagatgggtgagtcatgcatcggatgtgtatgtttatggctctgtggtttgggtagagatagatattcaaaatggcatattgcagttactgttttctaatgcaaatcgttctagagaaaaaatatatatgtttataagaaagatttcttaacctctttttgaccagtgactttcttaatttcagtgggggcatatgaaataaaaccctcaaaatcatcagccacactgtaccttccatatcattgacagataacactgacaaattattccggcttgttctgacacctgaatagaatgtatcaggtggtaactgaagccatgaggatgagttgcccatacagaggaaaggattataatagtaaatagctatgttttatgaatgacatactagatactgtgcgaagtgaactagatgtgttatttcatttaatgctgtgcttatgagacagccaggtcggagggggtacctggcaaaactccagccagcctgtgccctggggtggacccacaggaagttcgcaccttttgcagcggggaggagcctggctgctcctcttcctgtgtggaacctgggattcggcagggtgggaagtgctctgtcagggactctggcccagcaagagtccctgttttccttttttcttcctttcacccaataaaaccctgtcttactcacacttcaaaccgtctgtgagcctaaattttcatggccatgggacagacaaggaccccatcattagctgagctaaggaaaagtcctgcaatacttacatcacatgactatgaaggcaggtaccatggacactctcatttgtcaaagacggaaaagtaaagcacacagaggtaatacgatttactgaaattcacacaaataaatttaaagtctgttccatctatgttgtgttgttaccttaggatctcacttcatatttgtgaagaatcatccttcccatttccttaaatacccaaaccatgagcatttgtaccatcctttattccttttggacatttgcagcagaatgtctattttgtttaatattagctcataatctgggaagtgagtagtagtattcacattttatctgaagtaagtgagacttagagaggtggagtgacttgcccaggcctgatttactgggtcttagtttcaagcctttttttataatgaagctcactctatctccaatagagcatgttcaaggttctaggtccagaaagggataagctgcaaatcatgaatccataagaataaatacctacttgcatttttttatgtggacatgcaaataacacacccacacacacaaacagacacacacacacacacacacacacacacacacacacacacacacagaactaacctaatatttcaggtctcatgaattgtatttggtttaaaaatacagtgagatcagaaagaatgctctgttcaaaaaaatcacatactttgtctcattagagacagaattgatactctttattgaagagtaaaattcagtaagaaccttcttaaaaataggagcaggccaggtggtggctcagacctgtaatcccagcaatcttaggaggccaaggcgagcagatcacttgaggtcagagttggagaccagcctggccaacatggtaaaaccccgtctctactaaaaatacaaaaattagccaggtgtaatggtacatgtctgtattcccagctactcgggaggctgaggcaggagaatcacttgaacccaggaggtggaggttgcggtgagccgagatcacatcactgcacttcaccctgggtgacagaggagactccatctcaaaaaaaaaaaaaaaaaaaaaagaagaagaagaagaagaaaaagaaggaagagagggcaaatgtgtattatcttataggtattaccctagtctgcagtgaggtttttgttctcttatgtcctataaagatcagtgaattctaacgacttttacactaatgttcaagttggtccttaattttattatttcccttttcacttatttgacttggctttctacataccagatggtcacctgagcccagagccacatcttttcatttgttatgctttacaatttgtcataatatctggtatatttgatatggacaaatatttgtttgattgttttcttttgatgtggtgatgtttgaactcatcctaaatgtacacaatagttttgagagacattttaaacccaataacatgtaaatttcttaaaacattgctcctgttcagatacatcgaactggaaacctggtcagggattgtgtgaacagcttcattttctcactataccttgtacatgaaatcctatttctgtttgtcttttattggcttttaaaatagcatgacgatctgatgcacagtcactgggctttggcaaatctctatttcctcccagccacagaaatttacatttcttcccaagctactctgactgtgaataatctatgtgaggagtgacctcagttcatttgaaagcatccaacatcctgaaaactgtaaagccacagcacgcactgatttctcaaggtctaagagatggtttataaatgattaaaaaaaaaactctaatagtatactcaaaacattttttaaaaaaagaaatagagttatgagtctgcaaggacttatttaagaaagacgtcctaatattgggggaggtggattcactggcactgttatatcaaccaagtatttcatgtgtgaggagataaagcagcaaactacgcaaaataaacagcgtgtgttcaccttagatatctaggacgcttcactttgaataaattttctctgcttttttgaatccagagcaatattgtctgttagacaagttctgggttttgtctgcttcaggcctgtcttaaccctgccattaattggcatatgtccaggcaattaaaactgtggtatggagcaaattaaaaaagagaatttaaagcaccagagtcatttgaaattccaaggtcaaatggaaataacattgaattatcttcttttggggattatacctgcctctatttgtctccaccagaggtgataatctagactttggttacctactctttgcatcctcaaaacgggaacacacaggaatgcttttttccgaaggccagaatgacagatataagattgaagttaaacacaactgatgcccagcacgtcagagcaggacaaagaatcagaggcaatttaatcccacctttatgcttttgaaagacaaaaggaactcaagcccagaatggcaaaatgatttactaaaggtcatcacaactaggcacccctctaattctggtaataattaaaatcaacaatatttattgaacactgacctttgccaagcactgtttcaagctcttcccatgattttttggtattatagttaaggagcggaggtaaagggacagtgaaataagtatcctctatatcctactactaccaaacagtttttcttcagctgagccaatagctaccatcttccaactaattcttagccagactaagatgacaaaggaaatacactaagcatgatttagctttttcttatgtctccagttgttgttttgaaagtgtattcatggcagggaaatatcccaaagccaggcagccccaaggaggagtgcctctagcatgagtattccagaaagtcatcaacctctgaatacttaagttgaccctgtgatttatgtatctaggactgaaataaaacatttctgactttctatacaagattttgcaatgtttatattagtcaagatcagctttttccaaaacatgctcgatggatcactcccttctcaggatgctgtataagaaagaagcaaaaaagctgtgatcaaataatttttgtttaaaaaaaaaaaatcctggccaggcgtggtggctcgtgcctgtaatcccagcactttggaaggccgaggtgggcggatcacctgagatcgggaattcaagaccagcctgaccaacatggagaaaccctgtctctactgaaagtacaaaattaaccaggcgtagtggcgggtgcttgtaatcccagctgctcaggaggctgaggcaggagaatcgcttcaacccaggaggcagaggttgcggtgaaccgagacgccattgcactgcagcctgggcaacaagagcaaaattccatctcaaaaaaaaaaaaaaaaaaaaaaaatcctgcatcatcctgatgatgttcattatcatatagaaattttaagaatacccgtaataaatgttttttaagtcagcatttcccaaattcagacaaacacagaacccaaccccctgccaccttttgttaaaaaattcatgttaaccttcctgcagagcagatatcaagaaagatgtgtgagaggaaatttcattcaaaaaacacttatcaagtgctgatattatagctgatgctgggttatagagatcaaagacccagttccagaattcatagagctcacaagctacagaaagagataagcttgtaaatcacagttataatacagtttagtaattagtgtcatgcacaaaaataggggatgtggagctagaaattaagatatttcccatcaccttgctgttgaagagtagtactgactgctatattatattatccctaaattcagaggcttaatttactagaaatttagatctcactcatataagattcaatggaggagagtggcagcaacaactatggttcatacagtcattcagggatgcagattaatcttcagtgtgtgactttccagatgtctttggacatcaacatccagctgctaaacaggaaaagagaaaagttaaaaggaacactgtgcaagatgcttttatgatctaggcctgagaggatacatttctttcacctgtggtccaatggttcattcatataactacaactaactgcgagagaggctaggaaatgtgggctacttctgggtcctgcaaggatggggaaagggtttggtaagcagctaactagtctcaacctcaatgggcaatatgaacttaggcaacagaaggtatagggaccttccaggcagaagtaatcaactatctgttgacataaaggaagggcaatcatggcactattgacaccctacgaaaagtatgatatggcaagagtagagaccacctgcggaagagtgtaggagacaggatggctgggaacagtggctcatgcctgtaatcccagcgctttgggaggctgaggtgggtggatcacttgagatcaggagttcgagaccagcctggccaacatggtgaagccccatcttcacatttgtattttagtatacaaaaattagctgggtgtgatggtgtgtgcctgtaatcccagctgctcaggaggctgaggcaggagaatcgcttgaacccaagaggcagaagttgcagtgagccgagatcacgccactgcactccatcctgggcaacagagtgagactctgtctcagaagaaaaaaaaaagaaaagggaaataaagacacaagatcatgtgagctttttgtactatgttaaggagcttgtattttactttttcaatgatggcgatttattaaagaatctaaaaatcattgaactagaatcaaaaaagtgagttaagagattaatggtatataataggaatagataatgagctaacaagtaattgatggcatagaatagggatggattcaagaagtactgtaggtaaaatatacatgacttggggacccagtgaatgtaaaaagtgaggaagagagaaggtacagtcaagaatatttcctgggcatgtctggctagttagatattgttctgatttattaaaaacaagagacattgggaaaggaatttggtaagtgggaggaactcataagggtctgaagtataggaaggaggttgaaacttgagggtggtcagcatgtaggtttccttgaagcatgtggaatgaatgcagtctaaaggagaaagaaaatcgaggcatgcagagagcttagaacaaaaccacacaccagaatttaaagggctcaaagaagaatttgtccatgaagaatctaaaatgataaagagaaccaagggaagaaagaattttttaaaacaaggtaggaaacaacccacatgtccatcagctggtgaatgcatgcatacaatgtgatatgtctgtaaaacaatactattcagcaataatagggaataaagtactgatgcatacatattacaacaaagatgaaccttgaaaacatactaagtaaaagagtcctgtccaaaaagaccacatattgtctgattctatttgtatgaaatgttcagaatatgcaaatctattgagatagaaagactagttgttttctggggcattgagaggtaggtgggggtggttgggtagtggggaaaagggaacaaatgctaatgagcacaggttttttgcaggaattaggaaaatattgtaaatttgattgtgatgatggctatacaactttgtgaatgtacttaaaactattgaattatagactttttaaataggtaaattgcatggtgtatgaactatatctcaaagctatcagttaagaaaaccaaaaaaggaaagtagaaccagtgaagtttggggtaatagaaatacatacgtcttctaagccagcttctggaggcaaaattcaatggcttctaaaccaatcctgtgattttcttttttggtccagaattgcatttgcatttttctgtgggaaacacttctactttatttgcagatggtcacattcttaaggcatttagatcatcacctatattttttttccttaagtaagtctagattttctgtaaattagcattgaattttatgataagtaagttggagaagttttatatagtaaatttctttcaatatcaaaattatcttgaagataatacacttagctataaacatgtaacctcccattatccagggttatatagtcaatatctagactttcagccatgcctgggacccaaagtgagcccagccacatcttatcagaggaaagcatttgtcattttacatttaaattcacatctgaggtattctccaggttttcttggaactgcagaaatatcaccgttatacattatttagtaaccagcttgctttgcaaaggtcaggttcgtgttattcaaagcgtgatgcttagtatgcgatgacacaaacagatttcttgctttaaagtaatagaatgcgatgagtgaaaccaactttctttggaagaaagatgtctcctttccacgacatttgatttgtaagtgggtttggcttcattaatatttaattgtctttttaatctgtatgtcagttcttattgcagactgcttctggggaggttttcctctgaaataccaataacaaccattcttcactctaacatcaaaacaagggctctctccgggacacctagttgtatttcatctctagggatataattattttgtcgttatccacagttcctcaagggactgatgatgtaggacaccctccttaaagacctttatatgtcaaaagaagaacctgatttgttaatgttgcaaatactaattcagatggtcttgcatcattcttgtgagttgccttttcttaaccaggctatacagaatttgtacttttttattagcacgttagtggagtttgaagctgttagttgatcttttcaggatattttcatgagctttactagtttaggaaacagtgctttttctgtgggatgcattttgaacatttaaattcattttcaaacacaaatcagaatagggaatgaaatgataaacaaccctttataaattttcaacttgatcacctatagcaataaagctacaaaaagaactcagaattagtatctctggagattgacatagagaaattgagattgacatctctgcagcaagttgagcctctttgtgaactggtcatttttatttcctggtcacttgggagaaacctgggtgaaaaaattggacatctgtttttgtttgtgatagcaaattccctatgggatgagcctcaccctaattaggggaccactcttggccctctcaggagagaatataagggtagataaggagacttaggttaccctctcaatcaatcacagtggggcaaaatggaataatttcacacattttcctttagctggatacttgatatatgagaaaaaatatggggtatccacatcctaaaattttaacacttccctgtgcttaccaacgtggcgtgtggtatcagtggaacggatgctttcatctgccttttttcgaaggttagttgtggcattgccttgattagtcaaagattttatctcttggtaaaggatattatcgatttagatagacacattttgaagttagaatacagcttgtaattatgaatgggcgaagatatctgacccttaaaaaattcagactccctaagttgtctacgcagcatgcaggttcacctgcactggtatcacacccaagctagcaatagaacaaattcatttgactttattttatgacttttcctagaagagacataacaatgaatcatcttgttatccaagccaataaatatgcttccttttagatttcttaattcagtttgccagctattttgggtattagaataacgggtttcatgtccttggggggtttaatttgcttccagagtcttgtttttgtagaatagcttaagtcttcatagtcatggtttatgattcttcaaataggtcattataagtaagatctgattttgaactggtattaagaaaatagacattgaaaaaaactgtttcagggaaaaaacattttcctttctagatcatagtgcaataagtggctcttttatgatcactgttgatttttccaaagtaagacattactgatttattttatctatgttagctttttcttccaaaacaattccttgatgtaattttatcataaggaataaaatgttctttttttatttttattttttattatactttaagttctagggtacatgtgcacaacgtgcaggttttttacatatgtatacatgtgccatgttggtgtgctgcacccattaattcctcctttacattaggtatatctcctaatgctatccctcccccctccccccaccccacaacaggccccagtgtgtgatgttccctttcctgtgtccatgtgttattgttcaattcccacctatgagtgcgaacacacggtgtttggttttttgtctttgtgatagtgtgctgagaatgatggtttccagcttcatccatgtccctacaaaggacatgaactcatcctttttcatggctgcgtagtattccatggtgtatatgtgccacattttcttaatccactctatcattgatggacatttgggttggttccaagtctttgctattgtgaatcatgtctcaataaacatatgtgtgcatgtgtctttatagcagcatggtttataatccttggggtatatacctagtaatgggatggctgggtcaaatggtatttctagttctagatccctgaggaatcgccacactaacttccacaatggttgaactagtttacagtcccactaacagtgtaaaagtgttcctatttctccacatcctctccagcacctgctgtttcctgactttttaatgattgccattctaactggtgtgagatggtatctcattgtggttttgatttgcatttctctgatggccagtgataatgagcattttttcatgtgtcttttggctgcataaatgtcttcttttgagaactgtctgttcatatcctttgcccacttgttaatggggttgtttgactttttcttgcaaatttgtttgagttccttgtagattctggatattagccctttgtcagatgagtagattacaaaaattttctcccattctgtaggttccctattcactgtgatggtagtttcttttgctgtgcagaagctctttagtttaattagatcccatttgtcaattttggcttttgttgccattgcttttggtgttttagacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctggccatttttcctagcaccatttattaaacagggaatcctttgcccatttcttgtttttatcaggtttgtcaaagatcagatagttatagatatgtggcattatttctgagggctctgttctgttccattggtctatatgtctgttttggtaccagtaccatgctgttttggttactgtagccttgtagtatagtttgaagtcaggtaacatgatgcctccagctttgttcttttgactcaggattgtcttggcgatgcgggctcttttttggttccatatgaactttaaagtagttttttccaattctgtgaagaaagtcattggtagcttgatggggatggcatggaatctataaattaccttgggcagtatgaccattttcacaatattgattcttcctaccctggagcatggaatgttcttccatttgtttgtgtcctcttttatttccttgagcagtggtttgtagttctcctggaagaggtccttcacatcctttgtaagttggattcctagctattttattctctttgaagcaattgtgaatgggagttcactcatgatttggctctctgtttgtctgttattggtatataagaatgcttgtgatttttgcacattgattttgtatcctgagactttactgaagttgcttatcaacttaaggagattttgggctgagacaatggggttttctagatatacaatcaggtcatctgcaaacagggacaatttgacttcctcttttcctaattgaataccctttatttccttctcctgcctgattgccttggccagaacttccaacactatgttgaataggagtggtgagagagggcatccctgtcttgtgccagttttcaaagggaatgcttccagtttttgcccattcagtatgatattggctgtgggtttgtcatagatagttcttattattttgagatacatcccatcaatacctaatttattgagagtttttagcatgaagggctgttgaattttgtcacaggccttttctgcatctgttgagataaacgtggtttttgtcgttggttctgtttatatgctggattacgtttattgatttgcatatgttgaaccagccttgcatcatagggatgaagcccacttgatcatggtggataagctttttgatgtgctgctggattcggtttgccagtattttattgaggatttttgcatcgatgttcatcaggtatattggtctaaaattctctttttttgttgtgtctctgccaggctttggtatcaggatgatgctggcctcataaaacgagttagggaggattccctctttttctattgattggaatagtttcagaaggaatggtaccagctcctccttgtacctctggtagaattcggctgtgaatccatctggtcctggactttctttggttggtaagctattaattattgcctcaatttcagagcctgttattggtctattcagagattcaacttcttcctggtttagtcttgggagggtgtatgtgtcgaggaatttatccatttcttctagattttctagtgcatttgcatagaggtgtttatagtattctctgatggtagtttgtatttctgtgggatcagtggtgatatcccctttgtcattttttattgcatctatttgattcttctctcttttcttctttattagtcttgctagcagtctatcaattttgttgatcttttcaaaaaaccacctcctggattcattgatttttttgaacggttttttgtgtctctatctccttcagttctgctctgatcttagttatttcttgccttctgctaggttttgaatgtgtttgctcttgcttctccagttcttttaattgtgatgttagggtgtcaattttggatctttcctgctttctcttgtgggcatttagtgctataaatttccctctacacactcctttaaatgtgtcccagagattctggtatgttgtgtctttgttctccttggtttccaagaacatctttatttctgccttcatttcgttatgtacccagtagtcattcaggagcaggttgttcagtttccatgtagttgagcagttttgagtgagtttctcaatcctgagttctagtttgattgcactgtggtctgacagacaatttgttataatttctgttcttttacatttgctgaggagtgctttacttccacctatgtggtcaattttggaataagtgtgatgtggtgctgagaagaatgtatattctgttgatttgcggggagagttctgtagatgtctattaggtctgcttggtgcagagctgagttcaattcctggatatccttgttaactttctgtctcattgatctgtctaatgttgacagtggggtgttgaaatctcccattattattgtgtgggagtctaagtccctttgtaggtctctaaggacttgctttatgaatctgggtgctcctgtattgggtacatatatatttaggatagttagctcttcttgttgaattgatccctttaccattatgtaatggccttctttgtctcttttgatctttgttggtttaaagtctgttttatcagagactaggattgcaacccctgccttttttttgttttccatttgcttggtagatcttcctccatccctttactttgagcctatgtgtgtctctgcacgtgggatgggtttcctaaatatagcacactgatggatcttgactctttatccaatttgccagtctgtgtcttttaattggagcatttagcccatgtacatctaaggttaatattgttatgtgcgaatttgatcctgtcattatgatgttagctggttagtttgctcagtagttgatgcagtttcttcctagcctcgatggtctttacaatttggcatgtttttgcagtggctggtaccggttgttcctttccatgtttagtgcttccttcaggagctcttttaggacaggcctggtggtgacaaaatctctcagcatttgcttgtctgtaaaggattttatttctccttcacttatgaagcttagtttggctggatatgaaattctggtttgaaaattcttttctttaagaatgttgaatattggccccccactctcttctggcttgtagtttctgcggagagatcagctgttagtctgatgggcttccctttgtgggtaacccgacctttctctctgtctgcccttaacattttttccttcatttcaactttggtgaatctgacaattatgtgtcttggagttgctcttctcgaggagtatctttgtggcgttctctgtatttcctgaatttgaatgttggcctgccttgctagattggggaagttctggataatatcctgcagagtgttttccaacttggttccattctccccgtcactttcaggtacaccaaacagacgtagatttggtcttttcacatagtcccatttttcttggaggctttgttcatttcattttattcttttttctctaaacttctcttctcacttcatttcactcatttgatcttccatcactgataccctttcttccagttgatcgaatcggctactgaagcttgtgcgttcgtcacatagttctcgtgccatggttttcagctccatcaggtcctttaaggacttcccttcattggttattctagttagccattcatgtaatcttttttcaaggtttttaacttctttgccatggtttcaaacttcctcctttagcttgaagaagtttgatcatctgaagccttcttctctcaactcatcaaagtcattttccatctgctttgttctgttgctggtgaggagctgcgttcctttggaggaggagaggcgcgctgatttttagaattttcagtttttctgctctgttttttccccatctttgtggggaaaggtctacctttggtctttgatgatggtgacatacgacatacagatggggttttggtgtggatgtcctttctgtttgttagttttcctcctaacagcaaggaccctcagctgcaggtctgttggagtttgccggaggtccactccagaccctgtttgcctgggtatcagcagcggaggctgcaaaacagcaaatattgctgaacagcaaatattgctgaacagcaaatgttgctgcctgatccttcctttggaagttttgtctcagaggagcaccggccatgtgaggtgtcagtctgcccctactggggggtgcctcccagttaggctactcaggggtcagggacccacttgaggaggcagtctgtctgttctcagatctcaagctgcgtgctgggagaaccaccactgtcttccaagctgtcagacagggacatttaagtctgaagaggtttctgctgccttttgtttggctatgccctgcccccagtggtggagtctacagaggcaggtaggcctccttgagctgtggtgggctccacccagttcgagcttccaggccaatttgtttacctactcaagcctcagcaatggtgggcgcccctcccccagcctcgctgctgccttgcagtttgatctcagactgccgtgctagcaataagggaggctccatggatgtaggaccctccgagccatgcgcgggatataatctcctggtttgctgttttctaagaccgtcagaaaagtgcagtattagggtgggagtgacccgattttccaggtgccgtctgtcacccctttccttggctaggaaagggaattccctgaccccttgcacttcccgggtgaggcaatgcgtcgccctgcttcggctcacacttggtgcgctgcacgtactgtctgacaatccccagtgagatgtacctggtacctcagttggaaatgcagaaatcattcgtcttctgtgttgctcacactgggagctgtagactggagctgttcctattcggccatctataaaatgttttaaatatgcaactttccattgctcaaggcagacaggacccttaattggttttttaacattgaaattcattaactagtttagtaatagttataagaaattttctatgaaccatccagctactggtttaaggccctggggattaagaatctgtccttgcccagtaggagcttacattcgagtgggctagagaatcacgtaaatagataattgcattgcaatttgataactacaataatagatattcaaagtacaatgacagtactacttaccggtttccaaaatatttttgtacttgtctaatggcaagtatgttattttgcaaagatttgtttttctctccggtcaatacaatatacagggcagtggtagaattcttagatggaaaatacgcaatctatggtcaaactatttgggtttaaatgcctggccttaataactggaaaacaatgagaaatcatttcatctccccaagctttatcccagaagcagtaaaataggtataaaagggagtgcttttgggtggctatgtacagtcgatttatgctatcaccttacatctgggtctaagccagcttctcctggcccaactagatcgctcttgcagagactgattgcaaaatataaccctgaattcctcctatacagaaatgcacactcctttgcaatgtggctttcctgctcttcccatcaataggtggactcttacttccctatccccttagtctgggctgggcttgtgacctgctttgatcagtagaatgtggcagaagtgatacttctgaggctcagttttttgttttttgttttgtttcgaggtggtgtctcattctgtcgcccaggctggagtgcagtggcgtgatctcggctcactgcaagctgcacctcacgggttcacgccattctcctgcctcagcctcccaagtagctgggactacaggtgcccaccaccacgcccggctaattttttttgcatttttagtagagacagggtttcaccatgttagccaggatggtcttgatttcccgacctcgtgatccgcctgcctcagcctcccaaagtgctgggattacaggtgcgagtcgctgcgcccggccggagggtcagttttaagaggccttgcagcttccacttttgtcatcttggaatgttgctttgagacctccatggcaggaggccagtcttgcctaccagaggatgagagcccatgtggaagaggacagaggcaacccagcagactgccagcaccaactgccagacatttcagtgaggccatctcagaccttccagcccagctgatgctccagctgaatgtagccacgtaagtgagcccagatgaaagaaccatgagaaataataaatcattattgttttaaccgctcagttttggagtagtttgtgaaagcaatagataattgaagtacttaccgcatacaatccatatgcctcataataaaagtagcctttttaaggtagcctttttaaacacaaactgatttcataaatctgaattcctcatcacgtttttttttatattttttaattgacacataattgcatatatttatggggttcagtgtgatatttctattgatatatataatgtacaatgatcaaatcagggtaattagcatctccatcagctcaaacatttactgtttctttgtgttgggaaaattttaagttctctcttgtagctatttgaaaatatgcaagaaattgttaactgtgtccaggcatgctggctcatgcctataatcccagcactttgggaggctgaggcaggtggatcacttgaggtcaggagttcgagaccagcctagccaacatggtgaaatctcgtctctattaaataatacaagaattagctgggtgtggtggtgcatgcctgtattcccagctactggggaggtggaggcaggacagtcacctgaacccgggaggcggaggttgctttgagctgagatcaggccacagcactccagtctgggtgacaggatgagacttcgtctcaaaaaacaaacaaacaaaaaaacaaaaaaaaaaaaaaccattaactgtgctatagagcactagagcttattcgtcttatgtagctgtgaatttggatctgttaaccaacctctccctatccccacctgcccctatagttcccagcctctagtagcctctattctactctctactttcatatgattaattgctttagtttccacatataagtgagaacacgtggtatttatctttcaaatattttatggataagacctcaaaagcacaggcaacaaaagcaaaaacagacaaatggaattatgtgaagtaaaaggcttctgtacagcaaagaaaacaatcagcagtggagagacagtcttaccacatatatatgtatttttttttttcagttagcttcctcaggttgaaaaacacccatattttttaaaagttgtcttccctacatgatctggcccttcctgcctctcctcaccttatctccttccatctcctctcttatctctattctagccacactcccagaacatgccaagccttttcaggctccgggacttttgttctctctcttttctctttctggaattattttccccagactttaacatgcctgactctgtctcacatataagttctcacctaaatgccactttctcagcaaggtctttgactttctaaaatagttccaccctctcagccagccaaaacttacccaatttccctattttgatagcgcttatcactatctacaattatcttgtttatttatgtttccatttattgtctgttttttccaccttcccaagaatgaaagctccacgaagaccaggaaaagactgatgggccactgtgtgtccagctcttagaaaaaggtctggcacatagtacatgcttagtaagtacacattgaatgggaggaaatagctgttctgaataatgactcaaaataacagagggaaagcatctaacaggggacccaggtcttgagagcagcaccagcaactcaaatacgaacacacgctgctcttcctactgttaccatgtctgaaatgctttctttgtgctggacactgctaagcctaatatgtctgttatctcatttgtttctcatatcaacctcaaagttctaggttctagatttattatcctccttctaccaacaagaaaactgagtcttagaaaagttaaacaactcagataaaatacccatgatttaaattcatgaagtttaactctaagttccattttaaaataatataatgatactctgatttcttttcagattgtataaatctttcaccttttaaaataatacactggactattactgcctgaacaaattactgtttatattattattccacttttatccctccctcctacatgatgataatattttacttatgtttagatcctgaacaccaaacatccagtgaatacagctgaagatgtaaccgactgagtggttttttttttgtggtggggggcacagagtcttgctctgtcacccaggttagagtgcagtggcatgcctttgggtcactgcgacctccgcctcctgggttcaagcaattatcctgcctcagcctcccgagtagctggaattacaggtgtgcaccaccaggcctgactaatttttgtatttttaatagagacagggtttctgtatgttggccagactggcgtcaaactcctgacctcaagtgatccggctgcctcggcctcccagattgctgggattacaggcgtgagccactgtgcctggccaagactgattattaatgaactaattctacctatacaatttggaggtatgggagacagcatcatggagaaacctcatttgaagtgcaccttgatgaatggatgagcaagagttggccaggtagaaaatagcaattctaggggaaagaaacgacatgggaattttttcagtgttgtttttgaaatttacagaatttggaagaaaatgtttcagtaaggaaaacttcctgatggtctttatactgttttcaagttctttggaaacttcagaaacatataaaaagacacagtttttgaaaaagtggaggggaaattattagagagcatgtatcatccagcgaagactaactggatgacattcttaagtagtacttggtgtttgtccttaattgaaagatgtttgtgtggactaggaacatctaaatagacttttcaatctgtaaatgaaatcttcagagcctgcagggttctggttttttaagtaagtatctgtccgaggaatactctgcacatcaaataacttaaatccagtaacatgtgataactgttcagggattagcacactggattctattctctctctctatagatagatagatagatcactcttttagatagatagatagatagatagatagatagatagatagatagatgtgtatatatatagatatatctctctctatatatgtatatatatatctatatagagagatctatatacctatatatctatacatctatgtatatagatatagatcctgaacaccagacatccagtgaatacagctgaagatgtaacccattgagattttttttttttgtggtggggggcacagagtcttgctctgtcacccaggttagagtgcagtgagatctatgtatctatacatagatatagagagagatctatgtatctatacatagatatagagatctatgtatctatccatctatccatctatatctatctatctatctatctatctatctatctatctatctgtagagagaaagagcacacacttacgactggtttatcttaacaggagctttaggatgtctggaaagtaatacagtcttcataaagagaggttgaacattatcaaacagcatggttcattgtgagtttttgttttaagcattttaaacagttgacttcaaattcccagcagatggtggtggcagcaggcaggcactctagtcaatgagaagtcaaagtgaacttttaaaatagttgattcttaaacttggaagaaaaaggagtgaatgttagaaaaaaaaaataacaggtttcctgcaatgcatcttatcatgcacaagtcaaaaaatgagaaacggtacaatttgcaataaacacaagagtgtgtattttacactacggaaatgtaaagcatttaatcagtctgttagcagaaaacttgaatattagctgtcaccaaatccctttagtgtataataacctcagaattgcggaccaatgtgttttcctcccagcaaagcttaccagaagtgttttcttaaagactggcattcctattaataatttaaggtaggaaaaaaagggggtacattttcttcttagtagtccaatccacaatataatgatgatgatgatcttactatacttaataccactcttattgtagtgatttttcttttaatgctatttttggataagaggtaattatttttaattgttaaactactttctatagattttttgagcacttcaaagtctagaattccaggattctgtgaagaaattctttttcagccctgtcgtaaaaaaatttttttgatccttggtcatgtttatatttatcctgtccttaataatattgattataacttctcttttcagtgaatatattatacatgttcgactttatcttactaggtagctgcttaataacagccaaactcattatttatgtcacttatcttccccttttagttatctttgtgtttaggctcctactctatggcggtgaaagcaatggttgtgggagggaaggggaagttgcttgatgtaagtgaccggaaccacaagaaatattcccagtataaagtgaccctgtttgcagattacctttctgctttatttcctatgctgtatcttccattttctaggattcctcaggccatctttgcatggttggtttatcagaatgaagtaaaatagctccggatagaatttggcccctccaaatgccaggcccatgagatagcaaggaaacttcatcaaatgccaatgacaggaaaagagctgtatgtcttacgaagcaggcccacattaagtctgtaggactgcatggcttttctcttgccctagaaagtcaacagatgaggtaactccccacccaactggttccttttctttacttggatgatcaaggggtaaaagtacagctgtcattttagctacaaaggtacctttttacattaaactgaaaaagtgcacatgtgttctgttgaaatgccccctatatatctgttttgaatttcagttcactgaatgttctgaaaattaaataaacacaaaacaggacatgctaatatcttcaatgaggtgcttaattccccatcttaatcagccgttttccatcctgtttctttttcctgcctatctgtcaaatgtttcttaattaagaattattcttaattacaaagtttatgtgtcattttattttagaggtagttaattaaatttaacactaatcattggagatattgccttttctgcacacacattgatgcttaattattggaataccttgaatctcttgactgagggggagtagggcatattgatttgtgtctggtatgtggcagctcgtactgaatagggcagagactcagcccatcaaccagacaaagaagtaggaagctcattttttcttagttgataaaggacagtgaacaaatgcactctggtcattcagcgcattatgtgatgtctctgaggggcatggaagtgtgatgattatggatgacattcgatcctaaaaagaatagccagaataaagctattctttaagagtccttggatacttgttagaatggatttgccaatttttgtatgtatgggattatactggggtcaccctgagcaggtcatctggttggatgagaagcgagatccagtggccagattagaaaaaggatgcattagctcttggttccttctacccaatctttcccctccaacattctcagaccttatctcctgggtcacttcttcagagaagtcttccacaactatatattgcatacctttccttgacatcattcattctcactataattgcaatttatgtggttggatttttattgtctgcctcacccaataaatgaagtatccttgagggtagttgtcatttctaattttgcttatcatttatttgtcatttgcttaactagtatttgacactaaatatattttggaatggattaatgaatgaattattaaatatttttagaagctataagttatttgactttttaaaaaagtattaaatgttcattacgtttgccagcactgtattattaggttctgggagtaagggatggttgggtgaaagtgaatccctgccttcagcaatttataatacaatacaaaagaaactcatccaactaaatataatataagctagactataatatgtggtgtaatagatacatgaacccatctctgtgaaaacacatagcaaatcagccaagcgaggcaaggcttcaaaaagagggagattatttgaaatctgccttgaaggtagttttggacaaataagaactggggaaagggcatgctgggaagaggtaacaagatgagcaagagtcagatgtataaatgaatatgatgttagcaaattgtcaaagattggaaaacatggtggtgctcagtcctggctcggatacagtgaggcaggctttctgtacactgttggcaggactgcaaatgggtagacacttttggcaaaacacgttagaagactcactatttcctcttctagaaatatatttcataaccggagatgtgtgcaattctttatattcaaaattgtttctcacagcatatttgacaaacttcattaacggtctacacacataattgtagtccaatgattacatgaattatgtaataactataggatgaaaaactatgcatccattaaaaattatgtttttgaagaatcatgacatggataggtgcttggattgcagtgtatataaacataatgaaaatctcaatataaagttggataccagttttatacatgtaaaaatacagaggaataaaggaaataacagtaacagtaatttactaatactaattctctttggtggtagattgacaagtacgttccattttcttctgtatgttttctgttttctagatgttctacagttgtaaatattggttgcataataagaaaaacagatttaaacttggatatgttatgaagaaaatgcaatatcatatctatggctaaaatacaaaatgtatagggaatgcttttagaaaatgagtcttgagttttaaaaattatttagactctaatgggggttgtgccttgtattaatcattctgggtaccaggaaaacctgcgagatacggcccgccacccaaggattttaaaacctggctgagaagacaatacataaatatctaatttaataacaatctcagataatagttctagtaataccatggggcaggatgctacagattgccaaaacatggcacataagctatggcctagaagtttagagtagagattagcctattgagtaattatacagaatttctaaatgttttttgtcatctccctgccacacccctggagcagcgtgtgatctcaccagcagtgcaagggcacatgggctctcaaatacctgccatagcaacaggatcaggagatgacttagagaaggtggagaggagggttaagagaccccagaacttatatggctagaggtccaaaaacaagtagatgccactcactggcctgcctgaattacgtatctttccaatggaccccaacctaaatacctagatatgtaggttgtaccttttctgtatatgatgaacttgatatatgtgcaccccttacgtatgtatacacatgtatgtatattctgtatatatttgtgtgtgtgtttgtgtgcataccccatatatattcatgtataaatatatatatatatgtagaaatattttctaataatcactcagtttctattgcaggtgattatataaactctcttaaatggatttgccattttcattatttgttgccataaatttgcttcatcctaaaatactgcttaattactagattggtcaacaacatgtatcttgctataattgaaaaatgacttacattttggaaaagaataagatgaatatttttccagataccttgggaacaaataaattcctccattttgagtgttactgtaaacataaaatactagaatgggatattttttggatattcacttaatgtttttgtgtttgatcttccaatatgaatcgttatccattcacagatatttataaatcctctactaggtgcaaagccattgataagtgttgcaagaaaataaagtacaagttaaagaacatgagtacctgttgtctacagatactgagaattctagaatatataaataacactccttgaccatgaaacatttatgatctcttggaggaatcttgtgaggaaaggtgttgattttgccctcaaggcggttctgtcaaccttttctacctgtgggctgaagagatcaaggacctcttcatggaaaaggtggctcgttcactaggctctaggttacaattgttcttaacttttttttactgaggatgtcagagacccctttagtcatgtgatgaaaataattgtttcttacctgcaaaatttacaagcccagcatcttgtatttaatttcagtaatttatggattctttctaaggtaatccacgtgcatttagtttacagacccccacttcaatgagtagttagaatttggacatgcactaggctaaaaacaaaggcaattttaggtaacaatacagaagcaaagtgtataaagtatatatagaaaatggagagtagctccatttgaatacctggaatgggttaattaaagatctagactgaaaggtaggaattggttaaataaagatctagacaaaaaggatcaaattcctaattactgaaaattgcaccctgtatcatatcatatcatgagtccatttccagtggcctgccttttagctattattagtcatcacttaatccaacaaaagtgcccaatcttcccagtttcatttcaggacaagcctttagcaacaacaaattttgcccttatccttcacggagtagattttctctgccgccagcatccaaatgtgcatttgacactctgaaactgaaggagagactgggacagaccataccaatcactgaccccatcattcagagtgattgagatctgtcttgtcactttcctgtgtggagacattttctctccttagattctctataagacaaaacaatccaccaccattatttttatagcatgcccatctcccagagtgtcacaaactctttacaacaagaaatggaatagaaagacgatgctttgcagacttgggtatagttattttcagacagaaagggaaaatgacaagaagagattgagtggaataaaagtaaagataaggctgctgacttgaaaaaacagtcatgacaagattgatagaccctgcccaaatccacatctctcacctgcacacatgtacacacacacacacacacacacacacgcaggtggatagtctcagcagcttttatcgaaagttttgttgatgatgtggtcttcctgatactagttttcaatgatagaattacatgcttattcttgaatataagtcagtttggtctctctgaacacatgtccacatgttgaagttgaaatgagttaatggatgtaaacatttagaccagtgccttacacaaatgaacacacttcgaatgtttttccattattattgatgttgataatggtgatgaagatgatgatgattaacagtagtatagtattaacttgtttatcagaaaaaaaaaattgtggaacagaacaagaacccagtaaggtaataagtctttttaattattttgacatttgagcaaaggtaaacacatataagaaatctaagacttgcattctgttccttccctaggagtgttccaatatcctttcaggtagtggttatttcttaaaacgtccttttatcaccacctgccatagaatcacttgtgttacttcttaaaaacatggattcctgggctctaccttaaacctaccaaaaaagagtctctggggacaggtcccaaagccagccttttaaagaaattccccatgatgagtcttaagcctacaaatttgagaaaggtgtttacctatcgtttaaagaatcaaccttacaggcagggtttaatctgattaggaatagtggaggggaacactggctctgaaacatctttcaccactttccctgcaattcacactattaaatatttattcctttggtttccagtgtatatataggagtctccatttaaaatttaaatacaaggggaagccattaacatccattagcacaccatgtgagttagggatttgaaagccaatcatttagcaaggcttcaaggggagagtaagatgaatgaatcccattgaggaaaaaagagctaagaaggcagggagcagaataggccagcctaactgaagcattgcagctgagaatcctggacagctaggggagtaaggaaacaatgaattctgcagaccagctgctggaaacaaaaaaaaggagaaattatacaaagtggtataaaatgcttttcaaatatgtttgtggtagaggtggaccccaatgaccagttttgtctgtttctctttaagtgtggcctacagtagagtctaatgctggacccatgcatttgaaggtctaatactgagttaaagatctcggcataaatcctggggctaataacattggaccctgagcaagtcagacaaaattgcacctagatttagctaaagagtatcagctaactttgttttaagaataaacgttttttctcttcacttataaatactagttctcctaaattatttttcaaagtacttacataagcttcaacattttttccttgtctatggtcatatttaaaatagtttaacaaaaatttgttgcccatgttgttttgttgtaatctgtatgaacatctcattgtacagattaaaatgataaaaggaatcgggagtgctcaagcaagaagatttagggggagacaaagaagagaatttacttaaaagtgtaattagccaggccagggccttgttcagggatcagtgtgataatttatacttatctgaacttgtgaaacgtaaagattacattcttgtgaaatgaaaactacatttacttagcgattagcttttttttacatggcaattagctttggtcatgtgtatacatatacattaagatcagtaatatttatctgtcatcttttccttgtgtctacattagctaccatctggtctttaacctaaaaatgtccacatcaggaatcatctttatcagggtcaagtaatgggaataaaaaggcaaggtaacttttattgcagaactgaagaggagatttgaagagaagtaactttggcatcaagaatagagaagtaatggggagtgaatacttgaggtgtcctaatccactttctattaccttcaattggtgataaaaatgttaatgatgatcttcaaattcaagaatacacgtaaatccccaaggaaaccaaagggagcagtataattctttacctgactttcttgcatctagttttatttcagtttaggagctagcactgtcccatacaatacaagagcatttggtcttgtactaagaaaagacttagaaaaattgaagggtccttccaaacaaatgtggctgttttgacaattatgcaaatagtgtgaagattaaaaacccaagtaatcttcataggtcatggtattgatttaaatgagaaaacctaactgctttttgttttttgagttgtgttgggatttttctttttcttagtgtgttttttttgttgttgttgttcttgttgaagcatgacacttatctgtttttccttgctagattaaagccttgctttccctttgttatttaaatcacatcagcaaggaattaaagagccttagagcaggtggctgtggtttgggtttacattagtggactttttgccattatgtttctattccaatttccagtttcagttagcaacattatactctgtgattttgggcaggagaaaacccaaaccacagactaaactgatttttgtttggagaaaatgcacaaccaattcccaattacccaagttgtatttcaatcccagagtgcatggaatgaaaataattgcaagtgtgaatacacacaaaaagaaatacatcctgtacagaaaactagctccctcactgttggtaggagaagaaggatatttgctctggagtggtcagggagtcctgttactgaataaggcccttaacttgagagtacctttattaagaaagcagatgagtgctgtaggggaagctagcaacatgcatgatgcatgcagcctgataatgagatgcccttctagcaatatttaacccttacattaatccaaatctacctccttataactcctgctttttggattaaaaagcaaagtaagcccagtgcttctaacagtatgagagatcacagcaaatgtttaaaggcagtgaccacgtcacccactccacccaaccctacccccgacacacaccccatctcctccaggatatagtttcccggttactgcaatcattcctcagctccaaatctctatgccctttttcctttttctcttttccttcttctcaataaacagttttattgagatataattaacatataaaattgtttgatgtttgcttttgtgcatacattatacaatgatcaccacaatcaagctaatgaacatattcatcacctctacatggttactatttgtgtgtgtgtctgtgtgtctgtgtgtgttacacccttttctcttgatggtctctgctttcacatttcactaaagctgtagtaccccaacttctaagtcctgtgctctgagcacatgcaaagtttgaccatgctatcctctgctgtggactttcttatcacttctataagccagttttagtttatactgacatctgcccactctgggttgaattcctacctgctgtgggagaaaacaaacagtgtacaaatcattgccaccaaaaagtgatggtgtccaagtggagatgctttggaggtcattaacaatatgacctgaggtttaggaatgagagccaagctaaagatttaggtttgagattccttagctcagaggtgttaatgaagccacaggtggccatgacttggtctgtgaaaagggcagactttaaatagggaacagtgatttttcttcagcctagtaatgtttgtccacacagagtttcaatcatttaaatatcaagagatctaacagaaatgtctgtgtttctgatttccgttggtgatataaaaagagtggagttacatgtctgcagtgcggcaatagcctaaagctgagcagacattgccttctataggcagggcacatgctctttggttccctgaagttcccaccacttgctgctcagcaacttcacccatttacatgccagcctgtcttctgtagacattttaatttgcaatatctgatagacaaggccaagcactgtggctcgtgcctgcaatctcagcactctgggagaccgagacaggtggatcacttgagcctggaagtttgagaccagcctgggcaacatggtaagactctatgtcttcaaaaaaaatacaaaaattatctgggcatggtggcatgcgcctgtagtcccagctacttgggaagattgcttgtcctcaagaggtggaggttgcaatgagccaagattgcactactgcactccactccgaacaagatcctgtctcaaaaaataatatctaatagacaatagtaaacatatatctatgcctttgatttcattctctcctgctgatcattcagtcaattttttgtaatcgaatgggaatttaaagtgtgcctttttgatagggttttcatcaagttattagagagatgaaagccatctaatgttagtgtaggaagaaatcttaccaattatttattcattttacaaatggagagaatgaaactcaaagaggccagggcagtgaaactcagagaggccttgttcagagttgacaataagttaatatcacagggaggatagaactcaggtcacactgttcttcctaagtcttagaatctttagctattaacataggtactgactggtatatttgctctcaattgaacagaaaagttgagtacttgtatctggaagggaatcaaaacaacaacaacaaaagataaaaaataaaaatctgtaactactttgataacttattaaaatatgaaaatacagtatacagttattgaaggaattataaacttctttattgcagttgtgtttgaacagtgccttttaaaaaataatctgcttatttctacctattgagagaaatagctattttttcagtattttcctttggaccacattgagttttttccccaaacacagtttgtcattcaaccaaatgaaaaggtcctcaggcaccaccctccacccaagaaccaaaggaatcatttgatgtgaaaggtacgagtcatgccaggctcggcaccagccaattaccgattacacaagctgtattttatcactccaaatacatggaattaaaataattgcaaatatgtgtatacacacaaacagaagtgtatcatatgcacacagctccttgatggtggtagaaggacagggatatttactctggaatgagatgtgattcctgttattggacaaggcccgtaacttgagcccacacttattaacacagcatatcagtgcagacagcttgataatgaggaaacatccagcaaggttaactcttcagcaaggttagaggcgtgaatagtctcatccagttaccagctgaatatttttcagagaatgcccatttccctagttaagtgtttctcaaacttagctccctacgtgggtctttgtaaccacactgggaatgcatggagccatctcctgaacccaggccagtgagctaaacatttctgtggcccagtcactagtgacggttgagcattaagaacattgcaaatggtgacaatctaggaaccattaagctacagaacaggtccaagatgaggagatacgtccttacagaggtctaatgtagcacctgagaattacagaggtctaatgtagcaccagtcatccacagttgagactggaatctagtctaacacgacagagagttcgaaaggttgcagacataagaaagtaacagcagtgtgtgaaacatcacttcctgatttccttgaaagcaacttagttctgactgccaacctccatccagttcttgccaggttgctacggaagttgctttgctattcttatgggagccaacccaacccctagcattgtacacagaaaatggggaaggagatctaaattccagtcaaagttgccactgacattcccattgtcacatcccaagtggttccttgaaatatggctgctctcagctatctgccactagaaaaagaatcctcactgaagttataacatcagtagcttggatagcacctccctaggcacatcatggagcaagcctatggtagagggagcattttggctccatgcaaatgcctgactcccacagaaccacattttcctcccagtccagaggaaacttgccattcttttttgtgacttgcctcaacccatttgtctgcatcttgccagagaccacctgcttttcaatgaccttttaccattccttacaggagaaagaaacagaggcagagagggaaggagggaatggataccagaaagcaattaatctgcaggagagtagtggttcagaaggtcagaatggagcaaactctctgaaatccactctagaattagcagtagagcagctgatataagagacctacatttttcatgtagtgctctggccccagtttcccccacctcctctctcctatacaccacaatacgaatccagggcttctgtaaggtcacagagcaatccttgcctatctccagcacatacataaaaattcttaccggttcactgtttcacatatattctttatgaaaacccagtcatatcctgtgaggtaggggcgtgtgtgtttgtgtctgtgtgtattttttcattatgcccaaaaactaagatcatatgtcttctcatcactttctatttttgttgctcaggggaaaactgaacacataaacttagaaaagcagtcataccagcctatgaggtccagatgagctaataaatgtcctcttgtctttataatctccaattcctgtgataagatattagggcaataggttttccaaagtaaatttatattctattagcaggtagtgtgtattctacagcttctggatattttgctacaagtaacatttcagttaaattatattctctgggacaggtaattagaggtaaaattgctccccttttgggtacatgcatccttccccacgaatattctcatcaagaggcaaaggtggctggagtaaagtcccaagtgtgttcgtttctaagagaagccgtttagcatatcagaatgagcatgatctttgaaattgtccagatacgtagccccacactagctatgggaccttaggtaggttatttaactctctaacccttattttatcatcaataagtgtggtaataatggcaacatcacaatttaggcaaataatcagtatcccatccatgaaagaggttgctgttgctgcctttaccatccttaacaatatcctctttatttatggggaagggtcattatccatcatcaagtgacaaagcttgtctgccttacctcctagagcaggttcagcagactatagcctatgggggcaaatcctgacagttgtctgtttttgtacagcacatggactaagaaagacttcagctgtaaaaaatcaaaaggagaatattaacatttcataacacatgaaaattctatgaaattcaaatttcagtgtccaccaataaagttttattgcaacacagccacactcattcctttgcatattgcctaaggcaactttcatgctataggtgcagagagttgaatagctgtaacaaaaacccttgccccacaaaacttaaaatatttactattgtgccctttacagaaagagcccgtcaatgccctagccctagagaatacagtatagggaagaccacgtgagaaactgcttcatcacaaataatcagctttgcccttgtgatctttggtgtaggtcttgcatttggaatcagtgtttagtttttatatgtgctattttttaatatgtatggcttgtctctgcattggcagttaccccggcatatctcagtttcagttctgagtgaacgtgttgatgtctttgaggcattcctcaagaacgtctcaaaattattagttatattcctttattcctcattgatcatattataaaccaccttacctataatatgccctcatcgtttgttgaaaatttacccagcatttctacagtggtgtaataacaaagagtctgaaacataattttatgtataatatatgatggttgtggtggtggttctgaagaagaaagaggaagaggagggtagagggaaagaagaggaaaaagattcagttttactcccaatgtggaataatagcaggaagtctgttgtgtggctccaggacattatctcagttccaagctgagtgaaatcaaggtgggagttttctccactaggatactgagaatgaggaactcacaggaaagtaatagaagctattaattgcaggatctagtccttgcacaataatatttcatcacgctatttacctggagccattgcctcaggggaatatagtaattagcataactatcaacaacaatagcatgtatgcataagttaaaacatatgtattttgactagcaaattgtctcactaacaaaagagggttagatgtagtttcttggtgctgcaaaaatgtgcaagcaaaataaacaattattagagcttttttctcctgctgtttataattgaactgagctacaacccatgctttttcccattacaaatatatttatgacctttgttcgttagcacagaaatatatgtcaacatatgagacaactggatacctacctgctagggacggtgacatttgttcttactgctttgcagagtatgcaggtgtgatgaatgtcaacaccctgcgtccttgttattgttaggcagcagtatgcaatccacttgattttcatttagtgtgttggataaattaaatctcagattcttaaacttaagtggcacacttggacccatgagaagtattaagtttcttgctatgcaactggcaattctatctgcttattcacaaatatttgaaaatgcgatcccttgactaagtatttttgcaaatagcaggaggaaaagttggcaagaagcagctttgcttctaagagagtttgatgttctcctttcggaaaagcgatgaaaacctacagtgcccggtgctttacctccgctacctatgccctccctgcaggcagttccaataattttccttttcctgccagcctactttctccttgatgaagttcagtgaatatttaagccttgaggattggggctggagagagggagcattgatttcatcagttgttttggaacacgtgggatcttttctatttttccttttgcatcttttttagtatgataaaaattaggattaaatttatctttctgaggcctgttgctgtttatttctttgactaaaatatccggcaacagtatatcatgaacagctctctttcttaaaattatttcgtaaatattttttgtcgcacacacactggcgcatgcaaacactatttcgtttaatcttgtggtgactctgtcaagaaagggaaatagctttatagaaaaattctgaactaaagtgtgtaaaattaagatctctgtgtttcattgtataaaaattttagctcaaatgaacaaaagacctctcatttttatttttattttagcatttctttaccataaggttagagtaactttttaaaaatatggtagcctaaaaaaactaatgactaaaccttaaagactaatttaaaatttttatcaaatttttttctattattttcttaggaaaattctcaaacctattaaattcaaaagaatgttatggtgaacacctgtatgcatgtcaatgagatgctaccttcatgattttattataaccagctatccattctccatccacccatcaattcacctttatttttgatacattgcaaagtaaaccgcaaatatccatatgtcttcctaaatacctagtctgcctatcattaattagtatttgatatttggtttacagctttttgtttctttgagctaaaatttatataacctgaaacacacagatcttaagtgtccatttcttgagatttgaccagtgcatatttctgtgtcaacgaaatccccagatatatcaagatatagaacagagttatcacaaaaatctcctccggtccctgttaagtcttagttgctttaaatcaaatatcagttcaggttgattttataaggttttctttaaaactgtttagatgcaggcagaatacaaaagatgaaaaagacatgatccctaccctctaaaagcatatagatggtgacaaaaaccaccaaaatagaaaatttcaattttcaatatgttttaaataataacatgtggtagatgctatggaagcacctagcagtgtctgttcatccatctggactctcaggaaagggttttggaggagaagtcagctttagtctggagagaaaaaatgaataaatgttagccaggagaaaagaatgataagagaaattgctccaagaaatagagtacgtattttaaatcagtttctgctgttctagtgtttgggagaatttatgaatcagagcacaccgaggaacttgcatcgtcctctcaagaatactaggaaacacatcacaagaattcattgataaactgagtctctgtaccccaagggtatttccactgccttccaccttccgagttgctgggccccaacttctaagaaggacacttctcaaaccttcagtggctcctgtttgctgctattattagacacattcttcttatcctagcatttctaggtgcctttcatcttcccagtatagtcctaatctgactttgccccacttccccgtttacttacatcttatactcaaattatattaaactctccagtcctcatactttcctgctaggatgcctttgcccaagtctttgcctgtttctggaatcctctctctttaatgtctacctttcataaccccgttcatctgccaagtctttccccctgcccatcagaagccatcttgtctaaaaactcccatagttccttgctcctaccattcccacttttaaagccaaacacagctgttttgttctgctgtagctgacaatgtctagcacagtgctcagcacaaagtaggaaattagtaagtatttgttgaataacagtgagttctatcttatgtcagtgtgtacttatagatctagagtttctctaaagcagagtctgtgttctatacttctttacattcccagaaatcataaaggacagtcaagaattgaacaacattggccaggtgcggtggctcgcacctgtaatttcaggactttaggtggatcactttaggtcaggagttcgagatcagcctggcaaacataacaaagccccgtctctaccaaaagtacaaaaattagctgggcatggtggcagatgcctgtaatcccagctacttaggaggcgaggcaagagaattgcttgaactcaggaggcagaggttgcagtgagctaaggtcgtgccaccgcactccagcctgggcaacagagtgagaccctgtctcaaaaaaagaaagaaagaaagaaattgaacaacattaaataaacctacaatgctattctaatatctgagctgtagcattacagttctatttatatttaatacaaatttaaagaacatgtagtttgaggagtagacctcacaacgtttgtttttgtattagtatacttcaacccctctcttactacccctgaaggcttataaatgaaccgtttggttttaaattttaaaaaggaatcttataaattaagtgcagaaagaaaatgggaaagtccttgatatggtaaatgtttagttttggagagaatatcaatgttatttatgtagtcagtgcatctgttgactgactacctattacatgccaggggctgggcaaaaagcacctgtcctggtgtagcactgtttccagtataggaatatcttacagcagaccccagagaaagagttggactttgtatatttgggccctttgatttgtgtatgagaaacgtattactgagtgaatggaagccttctgattgcagataaccccaattattggaaagttcttctttatagtaagctttgtactgcctctctctaacatcttccagccagccctatttctgtcactggagcctccagaaccaagtaaacccctcttatgcacagcaccttttcagtattgaagatttacattacacaccctacccccaagcctcacctttttcagaccaagtatatagaactcaaaatactttttcaaaggaattggtttccaaattgctgtttgttttttcttaaacattttatatcagttccaacatctgatgtcagtttgatgtcctcctcagtttattctgtaacaggttttgtgatagacaccagcagagggatattgggggttgtggggaagggatgttatagagaagacgaacagagcataatctttgttgtcctaaagtatatacatggcaggagaaaacaatcactttgtcagatcatttcaatatgatgctgcaagtcatgtcagagataagcaatgggtactgtgggagcactcgggtaatctagtccaatctgggttttagggaaagaattttagaagtgtcaccagagttgagtctgaaattatgagcaaatgttttccaagagaagaatgataggaagggagacaatagaagttaaggcactgaggtatgaaatcagtatagggtggtaggggtgggggtaatgacactatagttacttatgtgaagtattagctcgagaatggcagaaaatagggcttgtgaggtatgtatgtatatacacatgtatgcattatgtgtatatgtgtgtctatctctgtaagtgtgtatgtaaatacattctgattttctaattcttagattttgccccaattctcttgttagaaattagaattttggctctacggccaaggactttattcagcatattagcttttcaagagatcataaataatcatcgttgataactataatgacctgaagtgttataacaaataatttctgcgaagtggagttttaggtaatacatatcattaaaggcattgctatgagttgaatgtgtgttccctccaaagttcaggttgaaacttaatctccatcatggtggtatgaagagatgaagtcttttgggaagtgtttaaatcatgagggcatcacatttatgaatgaattaatgcacttataaaagaggcttcaaagaaagtttgctgctttttgctgtttggctcttctgccatgtgaggacatagcattcctccccttcagacgacacagcctcaaggcaccatcttggaagcagagcaaggcctcaccagacaccaaacttgctggctccttgatcttggattttccagcctccagaactgtgaaaataaatttatattatttgttaatgacccagtcttaggtcttatttatagaatcccaaagggactgagacagtatagttataaatcaatgtcaagtttcttccagtttcttaatatggaggtttgccatttgaggatgcttcattgcttctctgacctgaataaagtagcatatatgattctcattatactattgatatttaagggaacggcttacatccatttcataagagttgtgtctcatgaattatttgtattccagaaaccaaactttgtctggagcatcccaatttaagatagccatttgttaagttaattgccatgaatgggtgacatttaataaagtatgtgaatacttaggaacggaaggttgcgaattaaaaaataaaattattctcctctttattcagtttcgtatatcacttaccaaagctcaccctgcctattctatggtgtttgagttcatgcatccagacttgtgttaagaagaagggtgacaaatttagaattcacagtgtgtgttgccatgggaaatacaacaagctattaagaaattgtcttttcaataactttttagtgtaattaaggagatcatgcatatgctcctggaaagagagcctgtagtattgagtactagctaagtgctgtgggctgtgtagacaatgtctgtggtatgcctgcccagtgactgtttctcctgcttttgcaatagcattttaatttttctttggagaactatacctgtcctattttcagcagtccatttgtttttttctgagcatccgtctctgtctcccagacttaaagagatccaggttggaatactcaaaatccaccctcaaacttgtgctgaatctatgtggaaaggagatgtgcctactcattaccatgtttgtggtggcagaatgtcaggttggggttgccagtgaccatgtttgtccccacaaagaagagcctacctgaaaatacagacagcaaaagacaatggatcttaagtctttgcaattatatcagacaatatatattttttcttaggctagttaaagttctccatcacttgaattagtcatggtttattcagagaagcaaccgatacgatgcatagagagagagaaaaaaaaagatacttattttaaggaactggctcatgcagttgtgagggctgtcaagtctgaattgcacagggcaggctggcagtctggagattcagggaagagttgatgttacagtcttggagtccaaaggcagtctggagggagaattccttcttcagggatctcagtcttttaagactttaaactgattggatgaggcccacccacaggttccagggcaatttgctttatactactgatttaaatgttactcacacccaaaaaacaccttgtaacattcatccggactgatgtttgactaaatgggtacgatagccaagccaagttaacacatgaaattaatcatctcactcctaaatgaaaacgccgtggctaatctatgcagtaactactatagttgctcagatgttgcagaaattatcacaggactgatgtagtcaggagaggttgtcaagagaacatactatttcatggtaagttataaaatccatacttttactattttgtaaataaggaatatcttttatggctatgagaaaattgaataagctgatacacatgggaggcacctaaatatttaattttctctcccttttcccttccatttatatatttgagtttctgattaagcctgtgttgtacctgagtctggaactttgcaaggcactttatgttgaggatttatgttttagagattaaatgacttcatgcggaccacgccgtaatctaagggtctagagctcagagtgaccacagcgaaggcactgagccttgtacttattttacaaataggaagctgttctctgtggtgattaattttttaaaaattaagtttcagtgctagtgttctttgccagtcagatgtctacatatgtttctaagtccgtacagctagaaagtgtgtgtcaaataaaagagttgaagttacttagctcctggcctcatatctatttcatcatgctatttaggcattcttttaagatataaaaagcaaaaatatgtaaaaatagccatttctacatggcagagtctgttttaagagcctggccaacactttgggaggccaaggcgggcggatcacctgaggtcaggagttcgagatcagcctggccaacttcgtgaaactctgtctctactaaaaatacaaaacaaaaattagccaggtgtggtggcaggctcctgtaatcccagctacttgggaggctgaggccggagaattgctggaacccgggaggtggaggttgcagtgagccgagatagtgccattgcactccagtgtgggcgacaagagcgagactctgtcttaaaaaaaaaaaagaacctgggattgttagattgttagtatacctgtcccaggtattttatttctaattgggagactagcttaatgcttggaagaatttgatgatgatcttttaaaatgtcaccaaatctaatcactcagccctaaaatacaccctcagggtataacttcagattaatgaggactaagacttgttgggagggctttggagtggaaatttccaccattgttaatttgcaggaggacatgtctgatgtgtttttgtgatggtttcacatctgacagtctgtctcctaggcacctggctgttctccactcggttccttcctgaatgttgcgctagattgtcaaatgccacttcagactagatctgtgcccccgaaagtcatgtgcaacttcatgaaaaaaatctacctgacattttcaaatgcaactcacttgaacttgtaaaagtcaggtgtaaattgagaatagatttgcacctaagtcttctttggttgatttcagtatttgcttggaactgacatttggagaataactcagttgccctcagaattggtcccctgctcactccaaagtgttgtcagggagcgcttagtgtccgaatggctagtacagtatgcttcaggtgaatttcaggcacttttatttactgggtttggaccagtttggaatggaaattaacaatatgtgaattcagtggtttcaccagtgtagcctcttgagcaaaccttggacactgaatcatatttgttgcctaaagatattaatgattatctggcttagcctcatgggcctgattcttcttcaacagtaatgtgttgattattggcattttagacatggttggtattatacagctgaatctctgcacaaattcagagcagctatgcaggcttctgccactgggtgagttgatgaaggagatgatgtctcctctcataatgctgcaccaaacagatggaatggcaagctgtctatgactctgagtatctctgaacatgaacctgtccttctgcctaccctaatcattccactttcacgaagtgcatgcactactgagccacagagaaattacacagcaagcagtagacatggtgcctgaaggcaatgcaactcttgaactggaaatttagcacacatgtgaaatccttcgcagatacaaagccgttcttagactattattttcaaaggtaaaattagagatgtaataaccttatgagatcatcatgtccagttctctcattctagagatagtaaaactgtgatccagaagttaagtcccttacttatggttatatatttagaggaagagatggggcaagaattccaggtccttgcacatcacagtattatccttctaatagagggtgaccaatgaatgcatgatttggtttgtaagcaaatgtgaaatccagagattttcatcatttccaacaatgcaaaaatgttgaatcttagactagaggctctttgacctcttcctggatttattctgtttctctttttacattcctgcaaggaaggactcttgatatatttttgccttgtagaaatattcatttctaagttggtttgaaattagcctgtcatctgattcactgagatagagttaaaataaattcccctggcaaaaaaaaaaagaaaggattttatcatctatatggatcaattccaagagttcgcttcagtttactgatccgttttccctacagtataggatattcaattaaaccttccctcaaattggccatgaattttgatgaaaatgaaagaagtttcgtttagcaaacagtttctatcagggactataataatagaatgcaataagaattattttcacctatgcacctgaacgaacatgttttgtctggtttttggtttgatttctatctgtatctttatttttctctttttgtttttcacccagattttgtgtagcttgtccaaagtggttgagatgtgggatcaggtgaaattgctcatagatacaataatgcttcacaccagtgttttcaccactgatttagtagtgtctttgataaactcttataatattccatacttacatctttctgttttaaatagaactgctgggatatgagttatgtctggtactcccttatttttattaaagcatatatagaaatttttcataccctttgcttcaggccttccttgccccacttagcatctgtagagtggacataggcaggaagagcccactctacaaaatgcatccagtatattttgagtagagactgattatggttactgatcttggtcctggaaatgagaaatgaattagatacagatggtacctctgtggaactttagagcaggagatgaagcaaaacgagggagaagacataagtgaggataacagcacacaaagtggtgagcattgccagtgaaaatgcagtggttttccccccagcgtggggtatcatagatgaaagggcgtttgagctgcaattcagaaggttctgaagatccacttatccaatttgtgttttgctttctctgtgaatggtttgagccagagctatacagggaggtgggcagtggggacagcgcatgcgtagcattttcacaaatgcttcatagggctagacagcagtggtaacatccttagccccaccccatgttttacagatgagataactggggctcaacaaggttaatgacttaggaagtcataaacactctgagctttaagccctcatcttgtgatttctctttcatggctgttttcaggaatccttaattattagattgctgcaaaagtaattgcagtttttgccatttaaaagtaatggcaaaatccacaattacttttgcaccaatgtaaacaggatttttatgatacaagtaactgaaactgactctagataatttaagtgaaaaaggaattgattgaaaagttagcatgagttctccaaaattatggagatcttagccagattcagaggaaagaagccagggtagagtgaaaggtattaggcaacaataagatcaacagcattctcaggaaaacctggccagtagaatgaatgggctctaagctttgttgttttctatctctgtattattgctcaggatccaaaatcagagagaacaatgtctgattgacttactttgaagatgtgccagtggccacccgtttgttaggggagagctaggcatcttgatttacaccctactgtgacagcacccataagtgaagaggtaatgccaccaaaggaaaccagagtggatgaccagcaaagagcatatgtccactgtgggaatacaggcacatgtaggtaaaagaacaaacgaacactgcaagtatccgtatggataaagcaacaaatcattttgtaggcctgagttaacaaatgtgatgtagcatattttcattataatattaagtctatgacaaatatattctgtgctcagccaaagttggtgaggcataacggcacttcttccataagctatggctacttgttcctccttgtgccctctggcatgcagataattaggcaaaatttaaaacagcttgaatgtagtagatgctctctatcaaggtgtgagggttaggatagcatttacccccaggcttaaagtgttctaggacatcttttgggtgagctccctccagaaagaaaaagtgttcctgagaaagggcagtatgattaatcttacctagaggctgaagcacatggtgcatattcacgcaatcgttcatgtgcacgtgaactgtatggaaggatatagctaaggacaaaaaggagttttccagcacaaattgagcacattaggctattatgaaaccattagagatttcttttgtagtttgttccgtatacagcagtctcttgcctgacttttcaaaggaaatgtggtaccaaagtagattccaagggtaagacccagttatcttggttagagtgtcctttcttgatattctcaggaatgtgttcttctggtaatttctgtaagttttcaaatgaaatgggagttactattccaagggttttacaggtagtatctaattcaattatcacagcactaggcaatagttattcttattatcctaattctacagaggacgaaacggaggcacagagaaggtttagtaaattgcttaagatcatcccttgtgcatttcacaagagcagagcaggagtagtctccccttcatatttacgtcatgtatgcctaatatagtacctggtgcagagctaagattgaatgaatgagtacataaattagacatgttatggtacagtatgagtatatattgcaatgtttgtgcatcactgaatataatagcttacatgaaatggaaaaaaactacctagccttttaaaatgtgtttatagttttcatatccattagctcatttgatttttataagacatgtatttagttggagggtataattattattcttttttaacttaaaatcaaatctcagagaagatggaacttgcccatgtgaaacaatcataacagttcctcattataaatgatatagggtactatgggacaaagaaatcttcagtaactttcagtatctaggaatctagaaattccacatattagcatagaaggcccaaactagaaactatagataaaaaataaaaccataaagaagttattaacttaaataaacattaaatgaaagaagaaaacaaaattgtaatcatagttacttgtaaaccagtgataactgcacaatacatcaaaattggcagaaaatgcaaaagccattcttagggggaaaaaacatagccctatatgtgtttatttgaccaaaaaaaatgaaaataaaagagctaagtattacactacaaaatgtgtttaaaagatgatagtgtaaatataaagaaagcaggaaaaaggaaatttgagtctagaaaatctccatataattattagggaagaggagaagagatgagaaaaaagaactaggcttctttccaagattaagttgatctgggctaggcatggtggatcacgcctgtaatcccagaactttgggaggctgaggcaggcgggcggatcatttgaggtcaggagttcaagatcagcctgggcagcatggtgaaaccccgtctctactaaaaatacaaaaattagccaggtgtggtggcatacacctgtagtccccagtactcgggaggctgaggcaggagaattgctggaacctgggaggcggaggttgcagggagcctagattgtgccgctgctctccagcctgggtgacagagcgagacttcatttcaaaaaaaaaaaaaaaaaaaaaaaaagttgatctggaacacatgccctcttatacataataccatttcaagacccctttaaagtaaataacaataaaatagatactagaaattgaaagtacgatatggctctaaaagtaaaatcaatttaaaaaatacaacaaaaatgatttccaatggcagaagaaagaagagaaaataagagaaagaggacaaaacaaaggataaaatgggttatctaatgcagtgacaaaactggcatccttttctggaagaacttcatagggtacaggctggaagagtggttctcttgaacaggcatcagaatcacctgcaggacttgttcaaaaacagattactattcccactcccataaaatatggatttagatatagaccataagattgacttttaaaatacatgaataggttcacatttttataagacaggaacatttacagaaaatgaaatgagagatgttcaatacaatactttaagatgtaatgtatcttattaaaagtggccatagatgacagttgaagtttaagtcttgagaaaactatgtttcttacagaacattaatatacattttccttaaccatctcaacttacagtctaaacactgcgtgagtgatgataggatcaaagataactggagcattgtattaaacatatatttaatctgagtcctcaagaaagtgttgcaatttaaatatatatagacagacatacatatgtgtgtatatatatatatttattaattattaatttgttatttattaattccaaaggcatggtacagagagctgcataagaattctcagctggctttgggaggccgaggcaggcggatcacgaggtcaggagatcgagaccatcctggctaacatggtgaaaccccgtctctactaaaactacaaaaaattagctgggcgtagtggcgggcgcctgtagtcccagctactcgggaagctgaggcaggagaatggcgggaacctaggaggcagagcttgcagtgagccgagattgtgccactgcactccagcctgggcgacatagccagactccgtctcaaaaaaaaaaaaaaagaattctcagctggttaatagcacagccaggtgtacatttgattttcaatatatatatttatatctatatatataaatatatatatataaatatataaatatgtatataatatataaatatatataaatatataaatatatataaatatatataaatatatataaatatatataatttataaatttataaatttatttatatatataaaatttatataaattttatatatttatatataatatataaatatatatattatatataaaaagtatattatatatatttatatattgtatattatatataaataaatatataaaatatataatatatacaacatataaaatatatatgatatatatgatatataatatataatatatatttattatatataatacataatatatatttgttatatataatatatataatatataataaatatatataatatataatatataatatatgtgtttatatataatatatattttttatataatatataaaatatatattatatataaaatatatgtaatatataatttataaataaatatataatatataaatatataaaatatatattatataaaatataaaataaatatataaaaataaatatatataaatatacatatttatatagatagacacacaaacatatatatataggcttttaaaacactaagtgtaaagttctcatcttctttggtagagattagacatctattaatctagcagaatagccaaatgactacagaaaatcatttttaaaatacgctttatagaatagggggaaaacccagtgacataatgcataatgcctggacatcacaatagaatgtattttgtgttaatacattctgtggtttatgcccaacactatgatcagtgaaatctgcctggtttccatccactcagactacactccattgtcatttctgagaaaatagtagcatgattacataaggaaaaatgatgcatgaggatgtcttgttaactttaaggaaggtgctctaaaatatgaatcagcatatagaggtggttgtattgatttttagtattataatttgactctgaagtcacatttgcaatttgcgatttgcaaaagagagtgatatcttgcatcatcacatcagaccacatagtttgcacactttatgtaatattggggaggtagagtggggtggatatttcatcgcaaatgaaaaatgcaacagtttgtttctcgggtgagctacctatggttatttaatgtcacctgccatagcaaaatactgcttaatctatatgactgggtagatgggtgctaaagaacaattctcttttaactttgctgcatgtttaaaaattttgataacaaattgctagggtaagaactaaaagatcacgtagattccagagccaacctaccaaatttaaatttcatctttcctggtatgaccttggacaagtctcttaaggtctctgtgcctcagtttcctcacctgtaaaataaacactcattaaattgtaatgaaatttgagttaacattttcaaagtgcccagaagtgtaactggcatggggaagcactagattatgtgtatgtgtgtgtgtgtgtgtatgtaattataaaataaaacttcaagtcccacagagtggctcatgcttgtagtcccagcactttaggaggccgaggcaggtggatcgcttgagaccaggagttcaggaacactctgggtgacatggtgaaactccatctctatagaaaaaaaatacaaaaaaattagacgggcatggtgatgcatgcctgtagtcccagctactcaggagcctgaggtgggagagtcactggaacccaggaggttgaggctgcagtgagccgagatcacgccactgcactccagcctggatgacagagcaagaccatgtctcaaaaaaaaaaacccaaaaaaaacagaaaacttcacctacaatttggtaaatatccttgtggtttgtttttacttgaaattataggaatttaaattcaaaaatcttttaggactatttaattcaactcttaattccaaaggggtagtacagatagctgcataagaattctcagctggttgatagcagagccaggtgtacatctgcttttcaaattgaaagtcccctaatattgctaacacactagaatttatcttttggcagtggcagggaagagaagttagcagtttttgttattttaacttaattaaatattgtttgatgcttctttttcttttgttttatttgttttttgttttgaggcagggtcatgctctgttacccaggctggattgcagtggcttgatcatagctcactgtaacctcgaactcttgggctcaagtgatcctccccctttagcctccctaagtgctgcacataccaccacacctggctctgtttgatacatttaaataagttaaaatatgtttgaattttcacaactctgactagatgtcatgtgctgaagcatttgcgagtaaggtagcaaatatttagctataatttaagctaatgaaatgagtctgaaaagaatccaataaattataatatgttactattacttcccataagtcattttgatatatggtagaattttaaaaatgattacttgttttatataataccaattcattctattattggttcttttggatgctgagaaaacaaaatatgaatttaaccaattgccttcagggtaggaagctgatcaaatacattatctttaagattggcctgtattatatttcaaagtttcaatgggttaatctcatagttatttacttcaaaatgaaggctggtgacatgaagttaaaatatataattctgagctttactacttaccttgaaaaactaatgatgacaagatatcttcatttgctgatgatacaatggcattttaaaaagaaatggggtttccaacaaaaagtaatcatttacatccaaatacgacttaaaaggtaacccatatggaccacaagaaatgattataattatctggaaagataggaataaaggattaccgtaagagactctgtccattcttggaggggatacgttctctagattttagagaattaggttatctctagctgctgtgcggaagctctgggagataagcaatcacttcagtgacaaaactgtgaagttttaataaaggagcccattggtatgggactgaggctctaaaactgtggcctgatgtcccacatcatgaatattcaaaaccttaaatctggagaccttcatgtacttcctagagaggcaatccattccctcctacccagagagcacgtccatgcacgcaggcacgcgcacgcgcgcatcacacacacacacacacacacacacacacacacacacacactgcccagaagaaaatgataggattttttcctagcatgaaaacattattattctataataagtacacaaatgcagtttttatgttgaagataaatcttttttaaaaaggaaactctccattcctttgtaaaatattgtaataagagaacttttaagtgtatacccaatcatgtatggatgatctcctgtgtcgatatcgcattgcagaaatccatgtacgtattttaatgggcgttgctacttggatcttcagaatacatgatatatctcttctcagatatctcatagaccatcccccctctgctgccactgaatttcatttagacctcggtggctgagtttttaagctagatcgttacaaatgaagccttaccatttgatgaaaatccagcaaaaatgcatattgcatttacaacagacaaaaccaaattttattggtaaaaataactatttcttttagaataaagaatgtatttatagttttgttttgtttttaaatcttgaaagagacctgaatttataattagtacagtgtgattctcaaccttggctgcatattagaatcatctgggggtccttaaaaaatactgatgcgtaggtctcacgcctggttaggatttgattggtaagggtacaacctgtgcaccagggattttcaaagttccctcaggtgatcatcgtgtgcaatgggggatgggaactactgaaacctaatccccgcaattacagggttttatatcgtttgcctcaggctaaagatttatgccagacttctagaccagtctcctttccaattccataaaatgaacaatttcacatattgaaaaatgtttttaataattaatcatttaaattccacaatgtggctgggtgcggtggctctcacctgtaaccgcagcactttgggaggctgaggcaggtggatcacttgaggtcaggagttcaaaatcagcctggccaacatggtgaaaccctctctctactaaaaatacaaaaattagccaggcgtggtggtgcacacctgtagtcccagctacttgggaggctgagccaggagagcccgggagtccagcagtgagctgagactgcgccactgcactccagcctgggtgacagggcaagaccctgtctcaaacatataaatacaaaaaaaaaataagaataaactccaaagagcatgtttccacacttaatgcttattgctgaaaccctcctttgttaacattttaaattgtcgctctatagatgtcattagttttcctcttgaaaaggcactgattaaaaagtaaattattagcactaggtataatattagttcgaaccacagttagtaaatacagaacatgctatctaatgaaaatgtcttatgagcatttcggggcatcactttacatgtgagcaattttggtttttagttgtgcagtctgtgagagtgattttgttagttttgcaggcctcagaaaactccagataatttaatggcacccatcctgtataggatgtgtgtaaagcacttcacaggttgcctatcttggccaaatgtaagaagcaattggagaggcaaaggaaaaagcagtcaggaataatattaactgtgcattattgtggcagctttattctggcttttgttgtattttaatagtgacagctgcacccagaatttcttgtttccataactagtgcaatttccttttcctgaaagctctgtgtagttataacctggtcttttgttttcctgcattgactaaggaaactaattttttttgttactagacagataaaagacaagtgttaaaaggtgtcaattgcattttttttaatatggagaaagtgtccaatcttgtggtctgtcttcaactaattttagatatgattttatttttctggccacccgtggacttgtcacaaattaattaaatgcttcacttcttttatctaattgaggccatttctacctctgatgaataatttcataaagtttgttacaaaggaaaatgctttctgagtgatagtttatgcaaagtaaacacacagaacagctctatttgaacctttgcttgtggcaaaggctttccatacactccacaggaagttgttccctctcaaagaaggccagtgtcttccttttttaacgtacagcatgaaaatgtacttgaccccaagcttcaaagcagagaagtcagctttatctagcagggacaatgcgcattaaatcaataaaatggcaggggtatgaaaccagtggaattgggaattggattccagtcagggtcaatcagcccaaagtagagatctaatattttctgaatgaactgtttgaagcactggccttcagaatcattgtcagtttttgatgacttcctcaggcaacatagtgtcacacacagcaagagggtcacaaacccagatgcctacaggggccggatacagaaaagaaataagtgaagctggctaggtaggagatcatagacagtgatggagactcggtcaggactttggtcagtgcctgggtaatctcacacagtcagcacatagtgagttccagccagtttctgcctcctgggaatgctggagtgttacaaagcctcctgattttttaagagccgctatgaatcttttttcttttaaatgttagaaactcatttaaaatatatgaaagcagacaccagccacaaataggtatttttggagtcagagtttgcataagactttagatatgatatattccaaattccctacttttctgaaggaagaaggagggaagaagaacatcaagaattggaggacatttaggatgatggcaaggcctctgaacgtacaaaaagggggtttccatcagcaccactcttcaaaccagaaatgctaaacgcagagaggattaacatggcagaaggagaattactcatttagtatcacctctttataagcaaggagacttgtctagtcacccaactgctgagcatcagaactgggaccaggcaatactcatagtaaaattagaaaacttgtgaaaacctcagggagaatataaattccagttcattctataataaagtctcaaagaccaccaagggtaacttgtacaagtcctatcattagttagggacagagcctatctaccagttgtatatggtacaaatatttttgagcatatgaatatgcaacaatttttttaaaactcttccttcattatattaagactttttaaaaaatgttatttatgggatagtttatttatcagagggctgctgggttcatctactctggctgctaatgacagatgaatcaccattcagcatttactgaatatacattcattaaaaatgcagtctatggaggctctgtagaaatatggaaagttgttatcagtgcaaaacttgaaataaaattgtatgcacattgttataactatttttatagttgaattgcaaaaacttggaagggaaaacaccaaaagtatctgttaaagaggtgaaattagaagtgattttttaaaaagtcttctgcattattatatggtgatattaatttcaatttaaaaatatatagccacgaaaataaattattacttgaacaactattgaaagtccagcaatgtgctagttgccatagggagataaaattctattagctagtatagaggagaaaaggtaacatctttttctcacccattgcagggttcatgattaagatccctgtaacagaaaaccagattaacaacagaaaagcatacagatttatttaatataagttttatggaatactgaagcctacagaaatgaagacctaaataaacagggtgtaatgttgtaaaatatatatttggtcttcatgccatgtcctggcatatgatttctaaaatctttggaatctccaaagtgctgtttttctgtatgctaatgttgactgaccacttcaagatgggtctggtcaccagaaagacaaagtcatgcttagaggattggtactttcaaccccaacctttggggaaagaagagggactgaaggtcaagctgatcaccagtggtcactgtcttaaccaatcatgcctatgtaaagaagccttcataaaaacccaacaggacagggtgcaaagagcttccagaaagctgaacccatggaggatcctggagggtggctcacccaagcagggcgtggaagctccacgccccttccccaatacctcgccctatgcatgccttcatctgtatcctttgtgatatcctttatgataaccagcaaacattgcgttcccctgtgttatttgagccactctagcaaattaattgaacccacagtgggtcatgggaacctcaacttgaagccagtcaggcagaagttccagaggcccaaatttgcaactgatatctgaagtgggggagcagttttggggactgagtcttcagcctgtgagatctgaccaggtatattcaaaatgatatagaaggacccccaagtggtatctgctgcagaattcattgctcacttggtggtgggaagaaaccccctcccacgcacacacatttggtcacagaagtcttctgtgttgatgattgctgtggtgtgaaagcagagggaaaattgtttcagttttttctaaacacaaggaaaactatttttatgtttacatttgatgaagagtggaaagtcgtatagagatatgattgaacaaaaaggggcatgatctaaaggaaataaacgggggaacttagcacggcctgtttgttcagcttctccttagagtctctaccttcattcctttcctctggatatagggaggacccctctggaatgcaggtcttatgacctactttagatgaaggtcagaaaatcttttatgtcctgcttcaggggagaaccacaggaggagattagaaagaccttcctgcttctgctgtttgctgaagtgacaatatgccatattttggggtagcgtgtcctgaacctaatcaataggctcacttgtaaaatgagaatgttgagagataatgaaataattatagaaagaaagaaatctgaaatgaatgtacaaacaataggctttagattctcacagacctggatttttgttctcagctctgtcatttaggcatattgccttgggaaaggaacttaagtgttcacaaagtctcagatttgtgatccgtaaaatccagatgatgataataccttcatcatggttgaaatgagacaatgcatgtaaagcacttagtgagaagcctgtcatggagacatggccgttaaatgttagctattttcactaccattgtggattttatccttctacagaactagtaataataatcataatagcactagcaatctagtaattatagtagtgatcactcattattgaaatgggctccccctgttggccaggcagtgttgggacttttatctgattgttctctaaatttcacaacaatttttttaaaaaaatcagtattattaataaatattattcagtactatttataaagcaggtgagactcagagtgtaagtaatggttctaacatctcatagctagacatagaggagctgggatttaaattcagacatgtatgattccaaacagttcttcatactgttctgtagaaaaatctatgtgtagccctaggaaatgatgtgactttatataagcaagagcaagtggggaagtgttggggttggagatgtttcactggttgggttgcctgggattggatgctatgccaaaaaagaacctaagagtgaaagaggaagatagcacctgtggagtaagccaggctgccaatgccaaggaacccatggtccaaagaccaaaccaaacaagtactcagccccaaagacaaggcaattataggcaagcagtactcaatgagaaaaccaaccagaacagaaccagagacagccagtgggagcttactcagcctgtgttcattcccgtcggggttgggagtggtataggaaaatgtcgtcgtttatttatgtatttttatgttattttggagacagggtctcgctctgtcacccaggctggagtgcactggcactattacagctcactgtaaacttgaactcttgggctcaaacgatcctccttccttggcccccaaagctctggggttacaggcatgaggcaccacgctgggcccagttcgagagtattcataacattggttgggcaacttgctttggaaggctgtactatcttgctttatctgagatattcaagtgcttttaagatctttatcaactccaattagacttcaacagcatttggcagctttctacatatatcgtgtttcaaggttgttgatatctcttgtttttatctatggtagagctttcacttcccttttacattctacttgttgctttagggtgatctccaccaggaaaggaatcaataattcgctttatgtacccagtagaaaactgtatgtttctaaaaaccttctaaaggaagcagctactgaaaaacaacataataaaaggaaaatgaattgtgaaaatacatatgtaaagggataaattgtatatgtaaaggaaagtaaaagccaggagcctattttacattatacagccttataatttggaaatttcttcatagcatcattataatgtgaggcagtatggagtatgattaagggcatggatttttaaatcagcaacctctgtttaagtcctacctgttactttagcaaatcagttgtcttaaccctttatgtaaaaaagggaatatcagggggatttatcttacaaaattgttttaaggattaagtgagctactctatgcaaagcacatttcaagtccctgtcttagtcagttagagctgtcataacaaaataccataaactgggtagttcgaactatagaaatttgtttacttagagttttggaagctgaggaatacaagatcaaggtgccacctgacttcctttctggtgagggctctcatgctgacttgcagacagatgcctttttgccgtgtcctcacatggctgagacagtgcgagctctttggtatctccttttatgaagacagtatcatgtcagacaaaggctctaccccatggcctcatttaaccttaattacttccttactttagatataggcatactgggggtcaggatagcaacatctgaattttaggtgaacacagttaagttcacagcagttcacagccatccccattacatgttttaattttatttgtttatttctttttcgagaaagggtctcactctgtcacccaggcttatagtgcagtggcatgatcataactcactgcagcctcaacctcctgggctcaaacgatcctcctgcctcagcctactgagtagctgagaccacaggtgtgcgctaccatgcctggctactttcttcactttttatagagatagggtctcaccatgttgccccagctgaccattttttaatataccaattaaattcaccaaacatatacttgtttaaatttaactcaaagatataacttctattaacatttcttaatatattgtaattgagataaagcacagcattatcatatatcattattgtatattatatgatatatctaatattattatattattattatgggatttatcttacaagattgttttaaggattaagtgagatactctatgtaaagcacattgcgtagtccctgtcttagtcagctagagctgtcataacaaaatactgtaaactgggtagttcatagatgtatgattatgtatgtgtcatgtatcatgaaaatgatttacattttctcccattctctgtggcccatggcattttaaggacttcataaaaattggctataattattatttttattggagaagagatacactccatatgcctcttctattaaattttaccattttagtagttttaaaatgtataaatcagttctttttagcatatacacaattttgtgaaactatcaccactatccacttccagaatatttccattacccccaaaaagaaaccccttaccacctagtagccctttccaacaccttctttccctcatatactgggaactactagtctgctttgtgtgtctatgtatttgcctattctggacatttcttatgaatggaattatgcaatatgtgaccttctgtatctgcttctttcacttctcataatattttcaagattcatctctattgtcacatgtatccttttcatggatgaataatattccactgtattgatctatgacatttgtttatccattcatcagtcaatggacatttgagctatttctaccttttggctattattaataatactgctatgaacacttgtgtaaaagtgtttatgcagacctgtgttttcaattctcttgggtattgtgcaaaaaagagttaacaggcctgactgctgcgctttgaaaagcctggtttaaaaggttggccctttattggcatgtggaaacctggatttcagtagggtgcccactaccctaactggtaagagtggctcactgttcctaaattgtgcaaataatatggttttttatgaacaccttatttccttctgggaatctggaattttggtatatgtcaagcagaggctgcctacatgaccagcccccagtgaaaaccccgggtactagtctttaataagtgcccttggctggcgttttcacacgtgttttcataattcattgctgttttatgtgcatctcctgggagaagacttgggaatcttgcctctgatttcctccagtcttcactccatgtgtttcttccctttgctgatttttctctgtatccttttacattatgatctaataagtcataactgtgagtatgaatatatgccaagtcctgtgaatcctcctagtaaaacatcaaacctggggttggtttcggggactcctaacacaagtatatacctagggatgaaatttctggatcaactttttgagcaactgcaaactgttggccatagtatctacactattttacattaccactagcaacatttgagccttctgacttcatgtaatcactccaatacttgccatcatttattttctgggtttttttgttttggtatttggtatgtatttctttaatagccagtctactgggtatgaagtgctatctcatttgatttgcatgtctctaatatctaataatgtggagcatcttttcatgtgtttattgaccatttatacatctctgtttggagaagtgtttattcaagtcctttacctattttttaaattgagttgttttatcattattgagttgtaagattcttttcatatgttgaatactagattattattagatacatgattcacaaatattttctcccattctgtgcattttaagcacttcaaaaaatttggctataattattatttttaatcaatgatccttcaaatcactaggcttttctcattgaccaaaatagcctcatatatattatcaccatatgcatacattttcttggttttttttttaaccctttaacgtttgctatgttgatagcatactgatttctctatgttgggaaagtatatttcacacattttggtaattatctatggaatatttataaatatctctattatgtgctggatattttgcccagagtagaagcatattaactgacaagggccaactcctgaattcccttttagaaaatgttaacaactgctcagatcctacttcaggatgcttttcgtgtcaagatcccaaaggtttgataaagaatggttggttttcatttgagatagtcattacccagacaaggttggttatatttcacttaatgtttttatggcttctaacacaaccagtagttttctatttatttcctgggagtagggaaggatagttgtgttgcttgaagtgtattttttattatttttgctattaaatgagaacaacaaaaattcactgtaattattaactttctttcattttcacatttatttctgtaatttctcaagtccctgaaataccctgaagagacttatctagttaaatagttaatattttgttgtgaaagttttactataagccaaacattttactttttgtttttaaagtaaatgtagacatatgcacattcatatgcaaaatgatgggcccaaattggatcagggatttttaacctgaaatccatagattatcttcagggaggtgtctgaagcccctgaaattgcatgtacatattaactccccccatctacttatcaatgtgttctctaatttaaaaaatgattaagaactactggactagataagtcttagatctgtccagattaggttatttttaaaaattcagttactaaccatcagcttgtcagtgaagatatgttcaatgaaggaagggagggaccttgtcaatcttttttcactattgtatcctctacatgtgaaacacggtacgtactcagaaaacatttgttgaattagtcaatgaatgaatgattaaggaacaatttctccatagagtgacctaacattagaacattagaaacaaggttcataaggacaagacttcacttttttttttttttttagacagagtctcactctgtcgcccaggctggaatgcagtgtcatgatctcggctcactgcaacctcgcctcctgggttcaagtgattcttctgcctcagcctcccaagtagctgggactgcaggaatgcaccaccatgcccagctgattttttagcagagacaggatttcaccatgttggtcaggctgatctcgaatttctgacctcaggtgatccacctgcctcggcctcccacagtgctgggattacaggcattgagtgaccacgcccagctaatttttatatttttagtagagacggggtttcaccatgttggccaggctggtctcaaacccctgacctcaggcgatccgcctgcttgggcctcccaaagtgctaggattacaggcgtgagccaccacgctgggccaagacttcacttttgaaatagaatgaaaagttaatttacatagaaaattcaaaaattgactttcttggtgggctaagcctcagctagttctctcaaagaccttccagaagaaccaggttctattataaacaatagttgacaagtaatcaggatatgtagtgttcagccctagttctgctatataccagcttattctacattccaagttgttttgtttgttcattaactcattcattaaggatggatcagatatccacagtgtggcagaaagaatgataaaagctggggaacaatgaccacattaactcaagtgtctatcttctaagagcttgcaagcaatagacaagtaagtaaagtattataagtgtgactagggtaagtatcatggtgtacagaatgctttgaaagcagaaggaaaggccatttcattatagggaattttttgttgcctgacaaaaatacagatatttcctattttttgctacattacactttgcttctttttgatgtcaatgagatagagatgccatgacatcaaaagccagaaaccaaccaaagggatttatactgcttttataccctattaaatgcaggtagacattacctaccctctttccagccctgtctgaaggtggctttcttttatagtctaaactattctgagcctgaacattgagcataactcgttcagagacctggggaagattaaaggtaggttttctgggacttacacctgaatttttatgtacccaactgagccatcagttttgggaaagagagggcaaaggtggaaagatgtgcttgctcactttattactctcctagaggcaaaaaatttgtgtccatggtgatttatgttcaaaaagatcttattccatctagaccacagaaagtcacatgtgtcttcctatctattagataaacactaaacagaaacaagggtgcattctccttcctatgccaaacacttcccctcccccagcattatagactttaaagaatttaaagacattttgtgtttacatacttgtgtaagaattattaggtgccagaaactaatctcagcactttaaatatattaagggatttaacacttacatcctataaactgggctccatttcacaaggaagttgaggcacaaagtctaagtaactcactcaatgttgcatagtggtagagctgagattttgaacccaggcactgtggttttgacccctatagcttatagacattagcatattctttttttgtttgtttgtttgttttgagacagagtcttgctctgttgaccaggctggagtgcagtggcatgatctcggctcactgcaacctccacctcccaggttcagcaattctcgtgtctcagcctcccgagcagctgggattacaggcatgtgccaccacacctggctaatttttatatttttagtagagatgagggttcaccatgttggccagactggtctccaactcctgacctcaggtgatccacccacctcagcctccccaaatgctgggattacagacgtgagccaccacgcccagccaagataattggtttagaatcagttttctaattctatctgcatcccttaagagagagaaaaagaaacaaatcatggtagtggcagagtaaccaaggcttttggggcctcactgtatttgtcattaagttaggatgcagaaataatacctgccttagcttatacagtgtgggttggggaactctgccatgaacatggaagtattaagcactgacacatgatatactgatgccactgctgctatttcatgtccggcattgctcttcctgcatatggtactgaaggcacacctactgctgtgtgcatatgtgagtgtgagtgtatgtgtgtgtgagagagagagagaatttgtttgttgcaaacacactaagcaccctcttactgctacagggctctgtcagttactgctgtttttgcctgtagtgcttatcagtgatagcctcagggtttgcctgctcacctccttcaagtcttggatcagatatccttttctcagaaaggacttcactgtcaactctatttgctatggtctgaaagttttgtccccattaagttcatatgttgaaatcctaaccctgaaggttgggcctttgggaagggattaagtcatgagggcagagcccccatgaatgagattagcacccatgtaagagaagccccagagagctgcctttcccctttgctatgtgaggacacagcaaatgggtgccctctatgaaccagaaagtgggcttcaccagacaccaaatctgccagcacctcgtgcttggacatctcagcctccagaactgtaagcaataaatttctgttgttatgaagttacccagtttatgttattttgttaaagcaacctgaacagactaagacgctatttaaaattgcagtgttcttcctagattctctattccctttcttgatatacttaacttcacaatacgaatgacctttcaacaagctatgtaaattacttaatctgcttcccacagcctagaatgtgagctccttggacagtgtgtttacttctctctgtctatcctcagtgtgaatagtctagtacatagtgggtactcagtaaatacttgttgaatgaatgaaagatgttaatccattatcccctgtcagttacttcttacttagttgacatgtttctcaagcaagcagatgcttttgcaataaaggtagagaaggtcacagtcatccaccttctctgtggctagaggtgtatgggaagggatttgaggatcatttgatagcgaaatgaagaggacaggtggatgacttattcaaaagacccaacaactcaatggacgtgctttttacctcatcttaagaaagctaagaaaacgtttttttcctctcttttgataagcctgtgaattcaagtcaatggcattttttctgctgccatttatcctttcacagaaagggtttttgctttgtgtttgcccaaatcagtgtgcatgccactttaccttatgacaaaatgacatagaaaaggcagaatgcccaataattggtgcaaattttatgcttgtcattttgaaaggttataaatcccctcttttataatgttttctatagaggatactttaggacagaatatcccttctgtacatcaatatgctgctaattccaaaaaagaacaactttgtaatttgaaagaattggtaacaagtgtggcatatgatgaatcacatttatccattctgctgtctattgaagggaaatggactttcacttgtttccttctaaaccaaagtttcaagacataaatattgacaaaatagattatctctcttcctaagggatgattccatcattctttcccactatatttctaggtaaaagtggaccagttttactgttatccaaacaataaatgggaggaaacttcaggtactatgaaaaacatttcatttttaattggaaaatcaagattctggtgagagctccatcactgcgtatctgtgtgactttggatacaccacctaatctttgcaaacctttgtttactcgcctcaaaaagtggggtttgataaaaatctgaactcactcacatttaatatgccattttactcacagccttagtccatttgtgctgctatcacaaaatacctgagactatattatgcataaagaacagaaatttatttctcactattctggagactggagagtctaaaatcaaagtaccggcaggtttggtgtctggtgagggctgctctgtgcttccaaggtggcaccctgttattgcgtcctccagaggggatgaaggctgtgtcttcacacggtggaagggacaaaaaggcaagagggttgaatgctgtttgaagcctcttttatgaaggccttaatcccattcatgagggaggagtcctcatgaccttatcactctcctaagggccttacctctaaatactgttgcgttgaggattaagtttcaacataaattttgaagggggcacacacattcaaaccatagtgctcagcgtaccagaatctcatgtgttacttggtgctggtaatcatagagagcagttgccgtagtgtatcataatgccagtaagtacttggctctgatcttagaagaaaccaagttcagtccctgttctgcagcctcttataacggtggcctgtctccaggcctctcttttccatcattaaatgaggaagagcatagctcttgtctgtgggttatatgaaccagcccccaataaccatttttactttgtagagagcctaaccttattatgtactcagtaaatgatggttattattgtcattattttacatggctctaaagaggatacataggggttatcttttgaggaagggagagtcagagttgatttgtagttttgtaaacactcttttttcaaagctgagcaaatctctgcctaagttgaatgattatggctttgtttatccttctctgacaggactttctagtttcagtcagtgggtaatgtagaacatatgtctggtttggatttcccgacaaactttcaattaaaataccaatgtcccaccaggaagaaccgtatctggagccccttacctgccataaactttatctacattgtgttctcattcccaacttcactgtagacatcatgatagccctatctcctaagaaacaatgtgaaaaataattaaaatagtttcacaccagaaagaaaagcacaccaaactcaaatttagtggacctgttagaaatatgttctccaagttttgcttgagtagctttcagattactccctttcacgcttcctagtatatatattgacgcattcactatgtgccaaattacaaacctgaaacatttagagaaagacagaagtagggtactttagctgccaaagagacaggtgcaaaggctcatgaatattagttgaggagctgcggtgcatataacatgaaagtactgcctgcaggcattctgtgattgggcagtttaatgtcagtgggaaacggagggtgtcactggggagttaaaaacaacagcagttcaccccagaagggcttaaaacagatagtctccaggaaactgtgaaattatgactgaacgtagaaagggcaacctctccactttggtcgtacttttgtttagatgagaaggaggatggtttggctcttgggagcgttggagagatagctggggaaagaaacggtggtttctcccagtcccacaaaaggttggacaactctggattatagtactcttaatacatgacaactaaagcgtcagaagccaaagcagatcttctagatcatttatacctcctattaaacagaaaaatatatccctatgagcatggataatgggagacactgttcattcagagcataaaagagaggcatttccagcatttgatttcagagccatgcaagtgctcttttttccttggttatcagctctggcagccacctggtgcttaaaacagcctgatgtggttgctgaaattacccttctatgccctccttaaatagtggctcatgattgtagatcacctgcatctgtaacccagggtgcaacattctaatgcatatgcctgcaccccgtccccaaatctatgtaatcagaaagtttgggaaaggccacggaatcctatagtcctcatttttaactggctctctgggagattctttatgcgtagaaagaatacacaaatgcatattgaaggcattagcactgcttttggttaacggtcttttcaaaaggccaccattaaagtgtatgaattccagcttgaatctaacagtctccagaatgacttagattgtagttatatatatttttttacaacaagaaactgtcctgtagtggggaagggcctggacaacacacatgatggagttttccatatgcatccagaaataccagaaggggtacagttcaaggaagcagatttttagggagtagttgatcccggtggtgttcaggttgaagtacagacacaaaaatgaacagtaagtccacagagagaaggcttttgcctgccacattgctgaagaccagtcttacttgtatgtattcacacacacacaagtacatttggagaaatgtcaaaaagaaataagaatagaacgaagaccaatgacatgaagaaataactcactgaataaattggtgtgtacctttctatgcatatagtgttgatcaggagtttcttaggtacagctgataacaactgcaactcagatttgcttaaatgaaggcaatcattagctctcatatctgagaatcttagggataaagcttgcttgggacggaacttgttccagagctgaaacgatgccatcagaactcagtctgtccctatcctttaattttgctcttttctgttttggcttcattctctttttaggttctctctctctatgtgggagtctttggaagctccaggcttccttctgtaagcaattctagactacaaaagggttttttccttgtagttttatgaaaagtcctgcaatggagtctcattagccaggctttggtcacccatgcatgggaaccaatttaaccaagaaaatggaatattaattggtcaggccaattgataatgtataaataagtattaataacttatcaatgctaagcagtgtcatctgctactcctgacctgtgcagaggattttagtctatccaaaccacttgagttgaaagagtaggagggttggttcaccaaagaaagagtagaatgctcttacctaatgaggagcagtggatactgaggcaaaaatcacagatgtctactacatagttatgccagtagggaagcaccattgagtgaattagtgaccctgatatctcatttacatttctctagctaaagccaatcaattttatacatgtatgtttctatgcttttattctcatgagtaaacagtaatgcacctaaatataaatcggaaagtttgctgcagtggagcgctgggttgttagggtagtacactactctgtgtgatattgtaatggtggatccatgtcctaatacatttgccaggaccacagcatgtgcaatacgtgatggaccctgatgtgaactgtgggctttagttaatatgcatgcattcatattggcttatcgattgtaacaaatacagcacaggaatgcaagatgttaacaatacgggaaactgtgtggagaaggagtgtaggcaaactctctgtgctctgctccatttttctgtaaacctcaaactgctctgaaaaaataaagttctattaattaaaaagatgaagttagctataactattattagtcctctctagagtaaacattccatgagggcaggacaatgtctgctttgcacacggttatgtcgcctccatgtaatattggaattggaatccaatctagtcccagaaactcggatcagaagccatttgggtcagaaatgtttgagaatttaaaatgtttgtaattttagaagagaaatatagcccacaaaacatgcccagtgttacataatagcatccccagctgagtctgggtcagcactgcataatcaaacgcatttctaattctgcagcaaagcatatgaatattcacattgagtctataaatagtctcccatcagttcccatcagttcaggtcagtttttgcctccaaatgagttacaaagtatttgcatttgttggaaatgcttctttcttgtcataactagggcttggcgtcagtatcacccaattacttatttttaaaagagtcattaatccattgttcctggaatgtgtcaaggtttaagatcagggtcagagtaggatacattgatacagccccacggctgttcttttccacgcctaaaaatcctcgagcaatgcacaatttttccccaaggagagaccctttttagctcccagcacttccccgtcctaccactgtttctaagatctggcattacaaacgattagggcttcattatgtgtgggacaaatgcatgatggcggcagcattattttgttaacaagagaacaaagaaatcgtctgagaagagttcacttctcatttggatttttttcactttgtgccttcagacatacaccagctgtcggtagacttctctgtttcttgctgtttaaaatgctcatttgaggggttaaaagaaggaaggcggaagcaatgacaaatgaaagtaatgtttatcctttaagcaggcatgtctgtctcctctaatatttgctttgcctctgctctattcagctgaacaaccaaatagaatacttattcaatagaaacgctgtgtgttggccagtttttcaagtaggcacttgggtaaggcctttgaacatgccttgctgtctgtcttataaatactaacaacactaaattgtattagtaatgatagtgtgacagctgtccaatcatcatttctacaatcagtgattgaattttaaaggaattcttgcactcaggaaaatcactcttacagtatttcatttgtttgtgaatttccttaggttattgcccatacgttttatgagtaatttagatccacagagatgctgctgatcttacagttttttagccaaaatgcatttccctaatcattaggaagcctggaggagaaggttcacagccagcaggacacagtgtgccctacgtgtgcccttcttggaacatgctggtggtggaaagagtaatggttcttcccattgggttcccccttggtgtgagtggtgagggagaaagtgaaatatgagcaggacactgagagcacacccaacaacccagcttagcagaacttccccttccttttccctggtgactttgttctgcaatctgataaagcaacacgttcccactgattacacacacggagcatttactctcttgattggtcaagggctctgcaggatataggcaaagccactctggtttgcaccaggttacttctgtgcatgcataacgcaaaaagctacctaccctccagatgtgacccaggtacaactcatatctaaacccatgcagtcttccctggctggtattctaagcttctattcaagcccttgtgttccccattaggtgtcctagagtttacttcccaagtgaaaattgttgctcttgaagtgtttctacccaagaccaggtgtttaatcaaatagcccatttgatgtcatgggaagattgactgtatatcacagtgctgggttcttggctgttatggcagcacttcatacctgccattaggattaagggcttaaacaagtttcaggtgcaacacctgggaacaccacagcaatgacaagtagacttgaacctggaatttgtagttttctaagatgaaatcataatattgcatttttgttctttcccaacagagtcagttgaatttgcaacagatggaaatacttccagcaaaagaaaagggtgctgttctaagggtcatgcggcgaaatgtggccttcatcccacggagtagccgcagagtgatctagcacatagaacagaactctgcagggtagtttttcttcactgggatcctaacctgtttagaaatgaaagtggccgggcgcggtggctcacgcctgtaatcctagcactttgggaggccaaggcgggcggatcacgaggtcaggagattgagaccatcccggctaacacaaaattaacaaaaaattagccgggcgtggtggcaggcgcctgtatttccagctactcgggaggctaagcaggagaatcgctcaaacctgggaggtggaggttgcagtgagccgagatcgtgccactgctctccagcctgggcaacagagtgagactccatctcaaaaaaaaaaaaaaaaaaaagaagagaaaagaaaaatgaaagttgtctgtgctcaattcataactagttttaaaactttagaatgcataggccaggagcagtggctcatgcctgtaatcccggcactttgggatgcgaaggcaggcggatcacaaggtcaggagttcgagaccggcctgaccaacatgctgaaaccccgtctctactaaaaacaaaaaaaattagccaggtgtgttggcacgcgcctgtaataccagctactaagaaggctgaggcaggagaatcgcttgaacctgggaggcggaggttgcagtgagcagagatcaagccactgtactccagcctgagtgacagagggagaccccatctcaaaaaataaaataaaataaactttagaatgcataaagatcaagagatgcttgctcaaatgctgttttctgagtcctgataattagaatccagtaggtctgggagggactcaagaatctacctgttaacaagcactcttagctaaggtcatagaggttcagtatcccttatctaaaatgcttgagactggaggtgtttcagactttggttttttgtggggggtggcagtggattttggaatatttgcatatatataatgagatatcctcaggatgacacccaagtctaaacatgaaaatcattaatgtttcatatataccttatacctatagcctgaaggtgatttatacaatgttttaaataattttgtgcatgaaacaaagtttatactttgaatcatctagcacaggtgtcactatctcatgttggcactcaaaaagttttggattttggaacatttcagattttggatttttggatgagggatgctcacctgtttcagccgggaggtttcttgacacactttgagaaataattattttaggtatagtttgacttacctttttactatgttgctttctatgaaatgtttattttgagattagatctactgcctgacttggtccagctcctaggattgttcacagatgccctgtaaaaataaaaataaaaaccaaaaaactacatttagcatcagtggaattttcctagctccacccaccctctagcttcctgctttatgcgtgttatctttttttgacctttcccttggaatccagattttgttctgtacttgctcctgtgggcttgatatttgggcatctgcctcacttccttgagttaaccatcacctgagattcaggcttatttttctctgctcagcctcagcccagccccatccattcagattctcttgcccagcctcgcttccagcagcctgagtagtatcctgcttgcctgggagggaagttcaggaaaatgtggaagtgggccaaattaattaaaagaaaaaaaaatagagatcattgatgttccaatacagcaaataaattaagtgacacccggctgcggagaggtgctttattactctttttcttagagggtttttttttttaagtcaaaaaatattttgtttccattacagatgtggtcatttttattctgtaacctaggaaaataatattaaataatattttctaatggaaaattctatgattctgtgcatctctttcagtaatccaaaaatttcagattagcccagagacactatgttttacttctgggacccttgtttctggtcatgaaatctgtgcttttttctgataatccaaagatttcccactccttgttgaagcatgaaagcagattttttcagcctagtcttctcccttccctttatgaagatgggtttatccatcctaattcaagataattaccgtggtatggaactttgcagaacactggtagtctgatagaagttagcctagtgactgattggcaggtacctagttaccaaggagaaacaaactcaggaaatcatgaaatcatgatgtaacagtattggtgcctgcactagatcctccaagctgtgtgtcagatcaatggtctggaatccacaagactgtaggtgagctcttggcaatcttactgctcactccctcattcctcattcctcctcttaacatgatttttaggaattcctagaagggtggaaaatcattgccttcccctcctctaataatgtgagcccatgcccctaatttctccaaggcagatgatgccctggggcgactctcacccttttggggacccaagtgtaaaaacattaatcccaacatcctgtcactcaaataagaagacattcattacttataaataaatggtagtggttacagtataaatgctatgtatacaaatgaagacaaactataactataggtcagtggactattgtgatctctaaggatgcctgctctttgtcaattcagtgcagtgcttgttggggagggtggtgtctcacaattagcttctggagttcaactacaagtgttctaagaaagagttagtttatgtcagtcctaggccttgacacattcatgtgagtcagttttataactttctgttcctggatgcttccctctcaactattagtccaggcaggcatgtgctaaaattacctctctaaatcttatcaagcaaagatttgttggttagactttgcccccaaaaaaatgtgtctaggagtgggtctaaaaccggtgttggccgatgttctgttcttaggaaatggagagccaggaatagaaggatctgtgttagtagttctcaaacttcagtgtgcagaagaatcacccagagagctaggttaaagggcagattaatgcaccccagattcttctggcgtagtcagtctggactgaggtttgataaaacaagcatggcatgataataatgcaggtggtctacagtctaactcggagacgcattgtattattaaatcttgtcctctgtcatttgctgcgatgctctttacctctttagactgaaaatcacagccactcttctggttacatagaacaacttactgtgataaaaaaaaaaaaaagatgaactttatcttctaggctttgaaaacggtaaatgcagtcttttgtatgtgccttcaagacacttgaaagtcactttgtggctgccacacagagatagaacaaacttagggatgcctctccccctgtttcatctcagaacgcctctctcaggactctttgtctcacccaggcacctcaaggttttggtgaaataaagcagctcttttttctcaaaaacattgttaaccctggtccgaaggtttaaaagctaggatatctgggttttttttaataccttgatagctaaactttctaaaatttctcccttcatctttgtgagcccaaatagctcgtgcacaaaagcctgtggatttccttcgatgagaactgaaatactattccctttatgctaatgttaattttcaggcagtgagcttggttaactatgagaaaataaaaactttagatggaatgcattatttatagtgaatgcaaagcatcattattatcaattcttgttacaaaatacacagaaaaaatatctttttgttatttaaatattgcatggctacattgagaaacagtacagatgttaatccacagtctctcagctgcatcctgagtaatcattattacgttttattcttatgtggaataactagtaatagactctatatttctgtatgaaattcaaatcagggaacaccaatgaattgagatgattgatattatatatacacacacataattttggaattggggacaacaatggaaatatttctctcttagagaaaatccaccaaacttgttgctttattagtgatcttgacgaataacatgtttcatttacctagatgtgccaaaaatcacttaattctttaccattgaagtgagctcacatttgaccagtacttaaatatgttttgaaaatatctgtgtaattgttaaaaatctgaaattgaaatgtaaatatctggattttgaaatatccaactttaaacacaaattttttttttaaagtgcatgtttgtgtttttttttttttttttttgagacagagtctcacagcatcgcctgggctggagttcagtggtgtgatctcggttcactggagactccgcctcccaggttcaagagattctcctgcttcagcctcccgagtggctgggattacaggcacacgccaccatgcccggctaatttttttgaatttttagtagtgatggggtttcactatgttggccaggctggtctcaaatgcctgacctcatgatccacccacctcggcctcccaaagtgctgggattacaggtgtgagccaccgcgcctggccatgtctgcgtacttttattccatgattttattttgtgtgctttcataaatcttctcttttttggttgttttaactttttattgatgtggtattttataaatggagtaaggagagacagtggtagtggtgatatgattcatgacatctttgaatgcaaattaaatgtgtaggtacatgtgtgtttatgggaaaatattcctggctgttttccctgtctttgttttttgttgttttgttttgttttgagatagcgtcttggtttgttatccaagctggagcctgctggcaatgatcatggctcactgcagccttgatccccccagatcaagccatcctcccacctcagcttcctgagtagctgggactagaggcgcatgccaccaagcccagctaattttttaatttttggtagagatagggtctccctgtgttgctcaggtttgtcttgaacccctgggctcaagcaatcctccacgcctcagcctcccagagtgctgggattccaggcttgagccacgatgcccagcctgttttcccatttttaactgataaagaatcactggcctagtctaatcttattgatttatagatgaaacacttcaggcatgtagagactaggtgattttcctgaggtcctggagttagtatttgacccaaggcattgaaactcagtccatggtctttctgaatcctcacccatctctttctcacaacaagatcgtgggccgtcctcagtccccagtaataagatagaattctgtttggtcattttgtcttcttaacttttcttctatttcaaccttagcatgaagtgctttttttttttttttgtctgagttaaatgttaaatgccttagaaattaccttaccaggcttcacctagatccccaaaccaactttattcttttttctcagcactgatgcacctgaatgaattcagtctcatcctatcacctatcaacaaaaggctggttatgaagtttttccaggatagcagttgcaattcttgcccttcaaaataatcacatataaggggactgccagttgcagggtgatatttaatataactttacatcatagcctctggtgattctatcttaaaactcatcaggcagtgcctaagtaagctaattgaatacattaaaaattgaaaaaaatacttcaaagtaaagcagattcttattgatcaccgtgtgttatatataccactgtacttggtaccacaagagatacaaaaataggtaagatacagtcatgctttcaaagagcttataatccaaacaagggaaaataaagtgtactctatgttaggtgcacttagtagaaaaagataagcgtcttgggaaatatagttttaaaattatattaaagaaaaaggttgagggtctagcagagtcttccaggaaaaagaatttgaacttgattttgaaaaacgaaaatcacttccatgggcgtaagcggcgagatgcattttgaacaatatttattgtgtgcatagtctagaagcatgtgtactcgacactgccacttaaggtatggtttgtggatcattccagtctttgaactttgttactgctccgtgacaaaataagtctcatgcatccagtttctcttattgagagaaagcacttagaaatgcatggctgtttaacatggcttcaccatccaagcacataatcagtggactcaaatcattgcacctgttatagaccagtttgggcgttactgagtcatctgtggtacaggctatgtgacatttatgcaaggtagaccatatatggcttcataagacgttgggaaaacaaagaacctagtccttcgctgcagataatgtgagaataaagactgtaggttgttctttatttgcatacatagtcattttgaggaagtgttgtgtatattagcaatacggagctgttactcattattgacttatttacagtatcgtccttgcttctttctaattttatcatctcattacagcacagaaaaaaatgttagctttatgacactagacagccatccacaatgacagtagcacaaaagggatacgggaagcacaaagtaaaggggtaggctaaagacaagcagaacaatacatagaagagagaaagggagacgtcaagcagcctgcgcctggaagttgttagtaaaattagtgaccaatgtgaaataagagggcttatattttcacttcatcataatccacagaagattaaccttcaatgggaaattttcttctagaagctgaaacacagcctgttgtgccttactattttttgttaatttctttctattattttccttatgttgttgtttcctgttgttgttcctatttggaagggattcttcattttggacattttctcttctcatttcagatgattccacactgcatggcccgatttttattcaagaaccaagtcctgtaatgttccctttggattctgaggagaaaaaagtgaagctcaattgtgaagttaaaggaaatccaaaacctcatatcaggtttgttgatgtaaaagcatgtgtttccatgcatatagtttctgttattaaaatcaacaaatacttatacaatgctggttacataaagagcttttatttatttattttattttattttattttatatatttatatttttgggaccgagttttgctcttgttgcccaggctggagtgtaatggtgtgatctcagctcaccacaacctccgcctcccaggttcaagcgattctcctgcctcagcctcccgagtagctggaattacaggcatgcaccaccacgcccggctaattttgcatttttagtaaagacagggtttctctgtgttggtcaggctggtcttgaactcccaacctcaggtgatccacctgcttcagcctcccaaagtgctgggattacaggcgtgagccaccacacccggaccaagagcttttatttatttatttatttatttatttatttatttatttagagacggagtctcgctctgtcaggagtgcagtgtgcgaccactgctcactgcaacctctgcctcccaggttcaagtgattctcctgcctcagcctcctgagtagctaggattacagatgtgtgccaccatgcccagctaatctttgtatttttagcagagacaggatttcatcatgttgaccaggctgatcttgaattcctgacctcaagagatctgctagcctgagccttctaaagtgctgggattacaagcatgagccactgtgcccagccatatttttatttttcgagacagggtctccctctgtcacccaggctgaagtggattggctcagtcttggctcactacaacctccccctcccgggttaaagggactctggcacctcagcctcctgagtagctgggattataggtttgcaccaccatgcccagctaattttggtattttcagtagagatggggtttcaccatgttggccaaactggtctcgtattcctgacctcaagtgatctgcccgcctcggcctcccaaagtgctgggattacaggcatgaaccaccacgcccagcccgtaaagagcttttagacaggcatcatagatatcctgaaagtctaaggagatgattgtttcctgaaaagctaagtacccaacctctgtttttcgtagtgctgggaattaaatatcctgattgactttctctttgaaaacattaacaattcataaccacatatatttaacttaataaacatattttaaactatatcagtaaactggcaggaaagtaagaaatgtcagaagtctacaagtaagtgggtttggaaccgaaagaagtaagctgaacaataaagacagttttcatgttaataaactacaagtatgaattgagctttggttttcatggcttcagagaacagaggtcacaagacaaagcctagacaacccacaggagaatccaacatgagaacatctcccagaataaacctgggatacaagggctacatctttacagtaaatgtgaacaagaaataagcttgacttccaaagagactcaaaagcacaggtaattgtgtctttcaaacattaaaccttagtggttctagtagcagatgaaatacaaccgaaaagaatttgtaaactgcaagataggtctgaagaaatcctccagaggcagcagaaagagacaaagggaagcaaaatactttaaaaagaaagagagaaaaaatgtctactcaggattccagaagaagcatcaagaaagactgaggcagaagcaatatttaaagagaaggctaagaattttccaaactaattgaaactttcaagccgtagctataggaagcccaatgcacttcaagcagtacaaataaaaatgaagccacatctaaaatagtgaaatggtagaacaccgagtcaaacagattatcataaaagtaaccaaacttgtaatacagatgacattcaaagagatcacaaactggcagctgacttctcaatagcaacaaaaaatcaggagacagaagataaaatattcagtacagtgagagaaactgtcaaatgtatggatagcctaaatacttcttttaaagcaaaacaaaataactacatttttaggcagacggcaaccaaaatctgactccagcagaccctcactaaaggaaattttaaaagacatacttgaggtggaagagaaatgattccagatagaagagctgagctacaagaataaataagtaaagcaaatggtaaatgttagtaattccacaaaaaaatttattgcacagaacaataaaaataataaaaagaatactgtcttgtgaagataaaaagaaaagttaaaattcatgacaacattagaaacaaatttttaaaagatgtactagacaatggattgtctatatggttaaagaaataaaattggaaccctactgcgcagcatacacaaaaatcaattccgagtgtatagaagacctaaatgggaaatttgcaatacttttaaaagcagatgggtttacatatttatgactttggggaaggaagagattttctaaatatgacagaaaaaatacaacttataaaagaaaatatttaactgtattaatattgaaaacttatgttcaatagaatatactgaaataaacaaaattacaagctgtaaacttgaagaagatttttaagtatatttgttatgggtaagggattcatatccagactatttaaagaatttccacaaacagaatgtaaaaaacaacctagtggaaacattagctaaacactttaacaagtatttctaggaaaatgaaaaccaaaaattcagtaaacataaaaagattgtcaatatcattagtgaacagaaatatataattaaaactacaacgacatactctttcaaaactaccagattgacaaatttagaaaactgacaatctgttggtgaagatgaagagcaaacagaacccttgattgaacactgctggtagcaatttaaattggtaaaagccattaaaaaaaaaaacactccctagtaaagctaaaggtgcacgtactctatgatccagtgtatatgattatgttcatagtatattcacaaatacacataacctggtatgttcgtacaaggtaacctcatacagtagtaaaaatgaatgaatgacagctgcaacaaatgggtagatctcaagaacataattttgagtaaaccagttcacagccaaatgcatagtatgtaatttcatattcataaaatttgaaagtggttgagatggagtggttgttcaaggtatagaggaagtaacagaggaagcaaaactttacccctcctctcttaggatttttcagctaagcctgagaattaaattaacataaagcagatcaaaaggagaaaaacatatttatttaatacaagttttacatggcaaggaagccttcataagaaaatgaaaacccagagatgcagttatcgttgcacatttatttactgaattggacaaagagtagtaaattgtgaaaaagtaactaagttatgtggggagctagaagaaaatattttaacaaggtctggacagagttttctctgtctcaacttcctgtccttgatggaaagaacgttactttccttctaatatagaaaggacatctttggcatggggattttatccttgctttttagaaaaagaatgaaggtgaaagtggtcgtcttgtacctgctgttttccaagtacctttttttttcccccaagtacctttaactcaaaatagtcaatataggcagggcacagtggctcacgcctgtaatcccaacactttgggaggctgaggcaggaggatggcttgaggccaggagtttgagaccaacctgggcaacatagcaagacccccatctctacaaaaataatttaaaaattagttggccatgggggtgcacacctgtagtctcagctagtcaggaggctgaggtgggaagatcgcttgagtctaggagttccaggctgcagtgagctatgattgcaccactacattccatcatgggtgacagagcaggaaccggtctctaaataaataaataaataaaagtcagtatgccagagcagcatatttttgggtggcatgctctgaactccttcaaatgataacatacatgataaaattataaagaatatcacgggaatggaaaagccaaaattaaagattataattaaccattaagaaggagtggtataatcaaagtagatacagcagacttctaaagtaataatatcacttttaaacacagatcttcattggcttatgatttttataacttacatacatcttataaatattatgcctctattcaaatttgataatgaaaaactttaacaactactatctaatattatgtaaaaaacaaatatatatgtcatagtttaggagagactggagtcatcaggtagggttctcagaagaaatgggatatgaactgagataagtaattttcaaataggcagagggtaaaggacattgtattcaagttaaaggacggcagtattagtatagtggatattattttagaatttactttacatgctcatttatccatttgttcatttatcaaacatattcattattcatccttcaaacctcaccagtgtttttcaaacagaattccagggcacatggaattggcttaaagatcaccagagaaagaaaataacagaattttcatccaagattcagcctttgcagctctactttgaactagcccatatattaggattctgaaaaatacgtcatatagacaaagtatttaaaccactctattaagcagctgcaatgtaccagtcagcatgctaggtctgagtattcaaagattaatcaactctacaacatgcttactagtactgttaatttgaggactgcctagatgtggacgtagttggagtagaatgatgtaactacaagtaaaggatgaccaagttctaggtattctggaggaaagaaagtctaattcaggatggcgaaggtagatgtcactgaagtcttcacagaaaaggagatattttaatatatttggagggtgaatggttctttcatcacatggataaggaaaagaagtgcattccagaaagtaagaaaacaacaactctctaatggaccatataattagggtgaacatgtaatttatcatctgaggtcactttttaaagcagaaggccgctgttcataattattctaggacagcaggtgtaaaccaagcacttgtcttgggcaagccagaatgaatagttactctccctagaatatattaaacccaaggctaaatcaaagatttttaaatactttgtgtagtaaagaatgcaggaagcaacggctgttaggtacacacatgatgagttaactggtccttgtttgccttgcgtagccaagtgtaaggtcagatgttagccgtaaatgaaaacacattttgcagcagaatttggcaagtgctgctttgttttcccccaaactgtgacctttaattaacattgcttttgtaacactgtgtttctagatataggagtttgccttgttatttaaagcaagcagtgaaacagaaacctattatgtttttagatttccaggaaacactgagaacaaaactttttaatcaaatgcactagcaatttattgcagtatacttcttgcctttatgcctttggcagtgtctctgtaacataatagcagactggtacctgggagctaaagcattcctcttgttgaaagaaagagcaagacaaagaatggagagatcaagtattttcagacacctttctgcctgaactttttcagtcttcaggctgaatttgagggggaagaacaagtagaagaaattccgaagtgagtctccatggggatcttcagcactaggttctctcctcagacaccgcaactgacctctcttctttgtgtttattccctcaactgagccttctcttttcattgtttcctgcccctcaattttgaaaggattgacccagacccagaaaaatttaagaagttttaacttgtgccaacttcccttatattaaacttccctaaggacatatgacattacttaatgcactcagcatccctttccagatagaagaaatgttcactcacttggtcggagtacttttgctgaggtttgtattcaactgagttggcagaaaacaaattccaagtcataaatgccctgaccttcccttagtgccaagttgacaccatcaacaaagaaagaggattttgctacagcgaatcctatagataccctcccagcaaagccacagcattttaccctccagagtgtcacagcatcggtgtttggttgtgcacaaccccactctctggagagagtggagtcgtggttcctcaaatgattcagaaatcagcttatgagactcacaaatttctcttgtcccttgggaaaatctctattggctccaaatgagcattgcctctatattaccaacacttaaaagattcctcacacattgaaagtaaattgtgaaattttcaagcgtgtttcagtatacagtgagataagaaattcagtgcaatccacattcaattggaatgaacagtgactgcattgcaataaaacttggtatagcgctttgtaatagagactcaactgcatttcggagaaagcactttattttctaaataatcccttttcgtttgctatttgtatgtaaaagcaggcgataaagtagattaatggactttctgcacagcattttagttgagatgactagtgtaggaaaacctacagaggagctctcattatgcccacaaccacttttctaaaaagactcacatggccccactcctaaattccacactctgcttgcagctcacattatgttgcgatttcctttttgagttcttagatttgtcatattaaattgctctactatcatttgaagtaagagttatggtcaagacgtgatcagctgactcaaaaaaaaaatgtctagggcagacagtcagttctagagattcatgtgcacatagagctgctagaatataacctggctgttctgtctttattatactttcttgtctgtgtcagagcacagagaattactgtggagactaaaaacattgtcagtttctaatcccaatcttcttatatacaaacacataaagaggtacctcatgtttctatttcatgctcctggtctacctttcttacctctcttgtttctaaattgttacatttcaaagacatgaataaacatgtgttgctatgtggtagtgtgctggaatgcttcataaattgtggatgttcaaagctaaaatatccagcaaagaagtgaaatatttagttaattaaattcaaccagcatttatggagcacaatgagagtgttagattttagatggctaaagtgagaatacaaaagtgatttaggtaaattatctacagtaaaagcagcattcctacataaaggagcatggacaattccgtaggagattggacaaagctttggttaatttttgttgtttttgttttgagatgaggtctcgctctgttgcccaagctggagtgcagttgcagtggtgtgaccttggctcgctgcagcctcaatctcccaggttcaagtggtcctcccacctcagcctcctgagtagctgggactacaagcatgcatgcaccaccacacctggctaaattttgtattttttgtggaggcagcgttgtgccatgttgcccaagctattctcaaattcctgggctcaagagacctgcctgcttcagcctcccgaagtgccgagattacaggcgtgagccaccgtgcttaatcatctttggttaattttgactagaaatactaaggaagacttcattgaaaggggtgtcactgcaaaatggctttgaagtgggacagaggtcttgacaaaaagaagggattacccttctgtatatttgcttttgttgataccagacatccaaaatcttgaaactaactcacgtacatttttttcatgtaaatccttttacattatgtacagacaaccacagtacccaagaatgttataagatgatacacagtgaatgtgcatgtgcacacacacaaatatttaaatggtgatttttactatttaaaggagataaggttaatggctctcattccttactctcattatggatttggatcagttttgtttgtgctgctgtatctcttaatttttaacattctggtgtgaatgctgctgtgatactcttggtaattcacaaactcctactatgctattttcgttagttaatattctgtgtaagagttgtgggggtaaacgaatcggatagtgactgagttatattagtgcaaacgttctgaagtgtttaaatgacttctgaaaggagatttggtcaagagaagctctcactctttggaatggtattggttgtaaaatgaaataaaaacaaaaacataggtcttattaccaaaacttcgctgttaaaatgtgtgggtcccactaaacctgctttactgggctaaatactctagtcacatacataggtgatccaggtagataaacagaaggacaaaaaacaaaaaacctgtctttgccccgataacctaatagcctaatctgcagtttgctgggatggttgattgatgtttgtgtgccggtggtgaaggagctcttcaaagtgatccacggttaaagcaggtttggtccccacagcagctcaagatcaatagttcctctgctttgcagccagccattgcagtcatattaaggaccaaatcaaagcaactctgctgcaatttcatcagatacttagcaatctacctggaaatagtatatgctgtcatctgtatagacctatttaaagaatgattgcaaactagaaggacttttactgaggagccccatttgaagaaagctgcacaggtgctatgagaaatctgtggcccgccttcaaaacagtgaagtgtttgtagcatcataagtagtcagaagaacattttaatgatattaaaaaaattttaatatcattgtttactttaaaagacatgctctttccatataagcacttaagatgtcaccattgctgggtagagcatttctaacttcttaatcatgctttttacaaaagtcacaaatgatttttcatgctatttatagtttttatatattttagacaattcagaaatattgattaatatgacaagactttatctactggcatttttatactataggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttgtaagtagcaattatacaatgctgcaaatgttgctttcagtttgtgtaccattataccaataagcttttatagcagtttcattttagagactagattttaattggttacatgatcatctttactctttttcacattttggaaacaattttatttgtaggataaactgtaaatctaagtgagaagatgtattcttctacttcgataaggattgagatagttgattgtatgataatttgattatatgatgctttctttatatacaaataaattcacacactgagattgacacatgtataaatttatgtaaacaacaaatttgacacccacacacacccacacacacacattttaaatagaatgtgtataagcaagcaattgaacaaattttacacacacacacacacacacacacattttaaatagaatgtgtataagcgagcaattgagctgccagtaatttagtagagtcaataagagaaatactttaacgataaaggtgagagttggaaaaaaactcagtagtcaattaatcctacaattctctaattgtttcctatttcacagagttgaaaaaatttaaagcaactgtaataatgacaaaaacatggagacaaagtgttatccacctttgatatttccagcttaaaatgtttaaaaaaacaaataaccgtgtcttaagaccaccatttaacaaaagtccatgaatatatgaaagaaagtggaatttagaaatcacaatttgaaaataaaatccataggcaagagcaattagcatacatttgggtatagccacctttgaggattgaggttcagctacatttttaagggtttatgtatttgcatgtgattatatatttccttgtgtgaaatcccaactcatatagcagtgaattttggcattagccaaaggtttcataaagtctgctggcagtaacactgtagaatattctcattaacaaaatcctctccaggaactcaacatccaatatacctaatatccagttcctaatctattaatgccatttggtggcatttttataagttgggaaatgaattttctaagtattatgtatatgcgagattccaggattattctgttagtgaatgtctcttgagatagtcttctaaatattcgtaggtgtttagaataataggagaataatatgtgtgattgaatgtaacagaaccaaagtgtttctttctcttggtttaatacaagtcttgtatctatattgattttttagtaatgacaaatcttgctaaattaatttttggaaataaccataggatcatgtactctcagagtacgggaaaatctcattatttagtaaatcttgtaattctttgaattttggatgtcatagtgtaggaaatgtttaacacagtataacaccaaaaaaaaaaaaatggagatggaaatattgtatctgggccagcgcggtggctcacgcctgtaatcccagcattttgggaggccgaggcgggcggatcacgaggtcaggagatcgagaccatcctggctaacacgatgaaaccgcgtctctactaaaaatacaaaaaattagccgggcgcagtggcaggtgcctgtagtcccagctgctcgggaggctgaggcaggagaatggcgggaacccgggaggcggagcttgcagtgagccgagatggcgccactggactccagcctgggcgacagagcgagactccgtctaaaaaaaaaaataaaaataaaaataaaaaataaaatactatacccaaacttctttattgacagcttacatttaaaaaaaaaaaattaccagctcttaagattatccttttgtaaaagaccgggcattttactaccaaaacatcagaaagatagaatctcatattcaaggacagtcatttacatagaatagtttaaccaaaacaaaaaacaaaacaaaacaaacaaacaaacaaaaagctctaccactcagttcgtggtgggttgacctgaggacctaccaggaaatggaatccactttgctcattccacttcatgtgtgatgtaggcattcctcccaccctcaaaatccttggctgatcatcatttggtttgaaaaattctagtgacagaaagttcaccaattcatcacgaggcaccctggcccacagcagactgctctacttgttcaaaaatacaaaaacaaacttgacatctctttcttaaaattgagccaaatatctcaatttctatcacattcactcccaattcttactttaaagatgctggttactcttcaaatatgtgaagatatgatcatgtcccttgtcccataattcttttcttcccaattaattaatccacagccatcttcttcacaacacactcaattatgttaattcatctattgcagccttatggaaatgcacagaattccatatatgtgtcttaacttttgcaaaggacactggggacagtagtatctcatgatgtgaacttttttcagttaatgaagctgacaataatatttatttaatcttcatttttaagtaccagccccagattgcaactttattttaaacatataatcatgtaaaatctgagaaagtatttcttataaattcctattcatccagtgctacccaaccacgttgttttattaacctaaattcagaatattgtatttacccctaataaattcatgttctgagtagtgaccctttgttccatcatatctgaaattgctttaagtcttttttttcaatcagacataatgattgttctcctagtttagtgtcagcagaaaatttgataagcatatctccattcaaataattgatataacatgttgaccaggacagggcagcatgtcactagagaatttccactaaaatgaaattaaacctttaatttaatattatttggacactcttgttcaaccagctacaaatttagccaaatatactataatcgaactccaatttcatccacgtgtttttaaagtagtgagaatctttgctaaagccttgctaaaatcaacatgtattgtttctgcaacatccagtcctacctgctccgtctgcatcgtcttgagcctttccttaaccatttatcctaaaactgccagagtaatcttttaaaaaatgtaaattagatcattccgcttccctgctttatgccttctactgtacttagaataaatctcaaactcattaccatggtctcattttaatttctcaaaaatgacaaactattttttgcaacaggatcttgatacttttgttccctctgcctgatcagcttttctcatgatctttcacacagctgacttcttatgatcctcacttctcaatttaggtatgacctcctgagagaaagtttccgtgtcaccctgtctaacataacaagcaatttccatcatttctcctcctctctgctgaccttcctccagccctctacttttacataacagtatcttctatttcacttaccagaattttttgtttttttattttttgagactgagtcttgctccgtcgccctagctggagtgcagtggtgcgacctcagctcactgcaacctccacctcctgggttcaagctattctgcctcagcctccaaagtagctgggattacaggctcacaccaccatgcccagataagttttttttttttttttgtatttttagtagagatggggtttcaccatgttggccaggctggtttcgaactcctgatctcaagtgatccacccgcctcagcctcccaacaaggtgagattacactttgcccagctcatttaccagaatttaatacaatctagaatgattgtgtatttacttttttctcatttattatttcactcctatggcagaacgtatattttaagagaactgagactatcttgtccatccttttatttcctagccatttatatgtttgaataaaggaattcctgtgttacgtgcctgttcagtaacacaacaaagaaaatatatgtataaagttaatttgagggtgatgtatttttatatacccaaacccaccctttctattcttgtaattttctggagtttatctttttgatcattgatccatagtttctagatgtttttccctatcttttgtaaattaaaagaaaatcaaaagacattgcctatattcagaattcactttcaattgattaggataaaatccttttcttcagtgaattaataaaagtgaggcaagacagtgacatcttttgaatgttactagtttctttgactccacgtattgtcatactcattgaaggaaaaaaaaatgttgctttttggccacacttactgcactataccatgcaagtgagaatatttcttcctctttaatcatacaattttatggttaaaaaagacattaaaggtctcctggcctgtatctttttaaaaatgaaattgaagattagagtaacggaattactcattgttaatacatagttaagaagctacagagccaaggaaaggcagtcttcagctcccagtttcatgcatgctggccctactttgctttagatttactctaatttatgagaaaaacaaccttcactttatttaccatgttacaattttcaaatctcatttacatactttctataattttattcagaagatagtcttataaggtagacattatttctattgattattaaaaatgttttcatgctgcttttgtgcacagaacttagtcatgtcttgtattagcatttagcatttttaagttgaattaattcacataagcaaaatttatagctaactagagatgagaccactaagaacttgctcttcctcccactttttaaagtcaatatatttaaaatagaaatccttctttgattaaataaggatagcataatttaagtcccccttgatgagatatggataagcatacattattgtaatgtaattgggagcacattttgtttttcagtctctctgcagcattaagccatcagcaatcactcccctcactgtcacttagcctactaccataccctttctaccttttagcccttctatttcacctagggctacaaatatgattgactagatcctctgtgcctggcacttaataaacttgaaataatggttgctgaatgaataggaattagacattaaagtcatcatgccatgtgtggggcataaggaatgagttgaaccactgagtcaagcacgttctgatggtcctttggagtgaattggaggtgagagcaagcattctcaccttgaggttgatacagaagacagttgacatcttaattccttataagtgtttctattggtgtggcaggcgttggcccacattaaaaggatgcttatggccaggcgcgatggctcatgcctataattccagccctttgggaggccgaggcgagtggatcacgaggtcaggagattgagaccatcctggctaacatggtgaaaccccatctctactaaaaaaatacaaaaaaaaaaattagccaggcatggtggcgggcacctgtagtcccagctactcgggaggctgaggcaggagaatggcttgaacctgggaggcagagcttgctgtgagccgagatcacaccagtgcactccagcctgggcgacagagagagactcagcgagactccgtctcaaaaaataaaaataaaaaaaataaagatgctcatgtatggaatgaatcaaacaagccctcaaagttcgcttttaccctggaaagtcagcctgagactacgcacagcttcatgaagtgtttcaaaggaaagctcctttgagcttaagcatacctccccaaccttcattcactctacactccctttcgtccaggagcaaaaccaagttgaatacttcaaaaagttcttccatagacgaataaatcagaagataaggcctaaagaggaggggatttcagttcgttatttgcacagcttaacgaaggggatgtttccagagcttgtgtctatacagaatgaagtgctatagctccatcaccctagctgcccacttttgcagcccagcatcccggtctaaatctgcttgaggatctttgtgcacagtcactcaacacagcaacttttctctgtcatataaacactgatatttattttaaaaaaataaatttcagtacacacccctacactcataaacaatacaaatcctcatttttttttaacttaggaatgtgggcttgagaagatgagatgttatattgactaagtttagagggaatcaaatgtcgttaattgttccatttcattctatgtgtcctgtgtctctagaactccagcttctcaataccactacacttcccttttaaggttgttagcaagattacattgtaaagcatatgtaaaatcccagaatcatttccaacataggaaagttatacaataactgcttctgtgtttttttgtctgttctctcttccattcccctttctgtccctccatgtcctgtctttttaaaataactatcacttacaaaaacttaattgactcatagtaactgcatgtatttatgggttacagtgtgatacttcaatacctgtatgcaatgtgtaaatgatcaaatcagagtaattagcatacgcatcacctcatgcaactaaactatcatttctttgtgttgggaacatgcaaaattctctcttctgaaaattagagtaaattggttttttgttgttttttgtttgtgtgtttgttgaggtggagtctcgctctgtcacccaggctgcagtgcagtggcacgatctcggctcactgcaacctccacctcccgggtccaagcgattttactgcctcagcctcccatgtagctgggaatacaggcgcccaccaccacgcccagctaatgtttctatttttatagagacagggtttcaccggcctcgaactcctgacctcaggtgatctgcccatctcggcctcccaaagtgctgggattacaggcgtgagccaccgtgcccagctgagtaaattgttcttaactgtagtcaccctgtggtactagagagcacaagaacttatccctcctatctagctgtaattttttgtctgttaaccagtctctccctatccttcttcctcccttccccacctctagttaccactcttctactgtctactctaattctgtcttactaaataagaccaacttatttagcttccacatacaattgagaatatgtggcattcgtctttctttgcttggcttatttcagttagcataatgtcctccagattcatccacggtgccataaatgacaggatttcattctttttatggctgaataatattccattatgtatgtatacttcattttcttgatccattcatccattgatgggcacttaggttgattccatattttggctattgtcaatagtgctgcaataaatatgaaagtgccaatatatctttgatatattgatttcctttcttttgaatatatacccagttgtggaattgctggatcacatgaataactaccattgtatacctaagtatagttgataagagcacaagccctggagtcagactccttggattcaaattcagcttctataatttcgtgagcttgaacaaggtacttttttctgccccaggttgtttacctcctttgttgtgaggatcaaatccattaataattgttaaactcctagatcattgtttagcaaatagtcagggcataataaatgttataatgtgaatactctatgttggatattatactaagcactttggaagcattattccatttagttctcaacacaacccaatgaagcacagatattacttttattttataggtgaagaacatgaaaattaatgatgtgaaataactttcaccaaggatacagcagtgggagaagggaccagcataggaacctggtcacctgagtcttgagcagatgcctgttatatggcattttacatgcatggcttcccttatgctgtgaaaaactacactttaccagtgaaatttatgttcaatccgtagatttgggtggttggtgaaatgtttcctttgtacacaaacttgaattttttgttgcattaacaatctttgatatagtaagtacatccatcatatatttgcttttgtttttaattttttagttgtaggtattcttgatgccatcatactgttgatttactgtgaacatctaaaagcataatgttacatgcaatgactatacataaatttgtggactctaattttaatataattggtttcaggttttataatgagaataattaataacaatatttctgctctaaaagttaagatgcagatttccaatttattgcaagtaggctgtaaagcattttgaatattgatattttatggtgaataactggttggtaaactgtttatccccaagcagtaaatgaaatatttgtataagcttcttactcccatatcatttctcccctacatgtgagaaagatgaactttaaatgtagattattatgaagagcttcccagagaataatcttaatatctaatgactccagattttagcctgtcaaactgattactttataaacattgtttggggccttcatcctggaattttcactttcttgtagtagttcagatctgcaaagcaaaagacttaagctactcatcatctcaggctgtagatgactgtaagtcatacataagtacttccaaattgctaatggtaaaattaaatctttgaacaaaatctggctacctgcctgctgtagggaaactggcattatcatggtcatgggcaaggtggtattattctggaggaagcaaatgggtgatatctatgcttacctctatggatacctcacttaagatgaggaaagtaactagactaatacaccattcatgccctacatctctaccctctgagcatgtgttaaggggaagggcatagaagatgaaaagtatttttaaaaaatggaaaaatggagatgttaagtgaaaggagtgcttacgtacaaaagccacttcattttggccttcctgtgacttcaagcaagcaatctatgaataaagtaactcttctgctgttgcggaatgaagtgaaaaaaaaaaaaagaaaagaaaaaattttaaaaagagagtaatgtaacacaataaatcactccattctgaggttaatttaagttagccttatcagttaagtggcaaacattttttatggtgaaaatatcaattgaataaacagcaactgattagatagtctcattgaaaaagatctttcttatgactactacagcgagccttaatctgagttctctttaactggggcacactctgacaactgtaatgatggtggtggtagtggtagtggtggtggtgatagaaaactttattaaactgagaatgtattgtattctcactgggaattttggcaacctgatttttgagcccagatccttgcttctattcacggtaattttcaaatgttcattgcttttaatatctaataactagcttatccttcatagccaatgagtaaaatgtgcagtcgatcagaacagtagctgggagtttgatacacggctaaactcataactggcctgactactttttaatttggaaagctgcttaaacaggcaaactttttttctgagcgataaaatgtggatggatgactatttagatgaataatctgtgaatatttagatcaactgaaatgtaatcaactttagaaacatttgggtatcaaaagtaaaaatatttttcaatggaaggctttgatcttcaataaaagggtaaatacttttattggaataggtagaagaagtcaaacccaaacttgctgagtttctgaaataatgatagtttctgccactgagtatagtactagacagaaagacattaatggtgataatgggtgtctattgaaaatttcacaaggtaaatcttaggagctattaaagtacagatgctagttaattgtagctattattaatagtttattatgtatactttcttttggtcatcccacagtccagtttggggactgataaaaagcagtttgtgacataagacaatcaatgaagtatagagattgctttaaattcaagaaggttctgagagtatgatatatatatgaaaattggcgaatgaaacctgatggggatccaagcaagattcatcagacttttaaaaaacatgaaggctaaaagagaacaattaatattttgtatcaccataaaaaaaccaaggtactaaaatatcactcctttttgtttcgttgttatgagtaattcagtcaacaaatattaaaataattctgatcatttttaagtttaatttttaggcactgaaggtcaacattcatgtgttgccattcggggaaaagggagaccactttctgaatgattgaaaatgtcacaattgctctaattatatcaatatccttttcttcaagaattttcatttgagaggttatggtgctgtagtacatatattttcacttgtggttaagtcagaatctaattgactaactatagtgatttgaatggtacctgctatagactgaatatttatatctccaaaatgcctatgttgaaatcctaaccccagtgtgatcatatgaggaggtggggcctttggtggtgattaggtcatgagggatctgcccttgtaaatgggatcagtgcccttataaaagtgattcctaagagctcccttgctccttctgccatgtgagtgagaaggtggcagtcagtgaaacaggaagagagccctcacaaggcaagaaatctgctagcaccttgatcttggacttcccagcctccagaactgtgagaaatacatttctgttaagtttcccagtctattgtgttatagcagccctaacagactaaaactgtaactctcaaaaaatgtgtctacctggaaactgtgaaagtgaccttatttggaaaaacggtctttccagatgtaattaagtagatgacatcttccaaaatcacccagatggaccataaattcaatatcaagtgtcctcataagagagtgaggagaaaacacaggagagaaagagactatgttaccatggaggcagagattggaatgatccagcaggggaaaccagtgattgctgaaagccaccagaagctagaagaagcagggaaagattctctcctagagccttcgaaggtgcccagcactgctgacaacttgatttcgggtatctagcttccagaactgcgagagaataaattttttttttaagccattcaatctgtggtaacttgtttgcagtggttccaggaaacaaacaggccaacatatgcacaattctttttcatttctttcctgaccactttgatcaattttttaaaaaaatctttgaatgagatcaaaatcaggtgcttttgtaacttaactgtattagggtgaaaagtattaaagaaatggcctctatcaaatgtaggattatctgtgcaagttttgtctcacactatgcattttcccctggagagcataacagagttttgaactttataaagtatgatttgaccagataatgaaatggggactgcaaaaaattcaaagggtaacctttccctttcccgggtatgtttttacctctcacttggaacagacctctgcaggccttctctgaaataggcagaattggccctttctccatagggcaatgatttgaagtgatgcggagtagtttgttggccctgagtcccgctctctggacttcttccgttttctaggtcattttccctgaattcgacctctttgtctggcactctaaagccctagaaactggctattatcacgtttagagtgtctgacctacctgtggctgtaaccgttccactgtggtctctcaagcgatgttatcgttgatgttatgacatttctagccccagaaagtccctgtgctagtgagggccagcttccgtcctcttcgcagtcagcacctttcccggagtaggctctaacataaacaaggcatttgccttctagctgtcatgtattttatgcaccatgctagctagtttttacttcatgtctataatatatattcactttagagaaaaaagtatgcgttagggttcagaggttaaatctcaaattcaagggcatcatgaaaagatgtgtgtgtttcccaagaactaaattattctgttacatatttcaccaaagattaaattccaaactagccactaaactctcagtagatggcactgaaggtaatttatccctgaaatatgtatttagggtacacactaattatgattagagtattaatttgctcctaaatacttgcattgttatctgtcattagcatttcagatttgttcatttgttcatagcctctacttttttttcccctcaaattgaatgcagtctagtgtggtaggtaatctgttagctctacctcataaaatttagattaattatatcttaaaggcccttctttatatagtcctataagtaatgtatatgttgaggtgagggagtcaacaaatggcttttcttatttctaagcgcaatgactactttcttctcaaatgctgaataatgccgaataaatgctgttaagtgataatgaatgttgataagtgctgaataaatatttgtggaataaatgaagctgaatgaaccaatgaaggaatataagagaaaccgaaatgtcttggcctttaccagcctatgaggttatatttcctcttgaatattctatttccttaaacaaagaaatagaatattctattaggaagagccctccaataaaggtgcatattccatatagtctttctcattcacctagaaaaaaactcattatgaaggtgttgcctcttactttcaacaccatacttttttttttttttttttgagacggagtctccctctgtctgctggcgtgcagtggcgggatctcggctcacctctgcctcccaggatcaaactattcgcctacctcagcttcctgagtagctgggattacaggcgcacatcaccacacgcagctgatttttgtatttttagtagagacggggtttcaccgtgttggcctggctggtcacaaactccagacctcaagtgatccacctgcctcggcctcctaaggtgctggaattacaggcgggagccaccttgcacctagccagtaccatacttttttttagtaacatctttgttaagataccataccatacaattcattcatttaaggtgtacaattcagtgatgtttagtttattcacgaagttgtacaactgtcaccactgtctaatttcagaacattttcatccccctaaagataaaacctgtaaccgttaacagtcactttctgttccttccagacctgataaccactaatctactgtctctgtggattttcctattctggacatttcatgtaaatgaaatcgtaatatatgtggccttttataacttgtttcagttatgttagcaaggttcatctgtgtcgtagtgtgtattagtacttcatttcttttttcttttttttgagatggagttttgctcttgttgcccaggctggattgcaatggtgcgatctcagctcactgcaacctctgcctcccggcttcaagctattctcctgcctcagcctcctgagtagctgggattacaggtgcctgccaccacgcccggctaatttttgtattttcagtagagacagggtttcaccatgttggtcttgaactcctgacctcaggtgatctgcccgcctcggcctcccaaagtgctgggattacagcgtgagccaccatgcctagccagtacttcatttatttttaggtctaaagaatatgcagttatatggatgtaactccattatatttacccattcatcagttgatggacgcttgggttctttttactttttagctattatgaataatgctgctatgaacattcatatacaggtttttttgcggacacatgtattttcatttctcttgggtatattcctaggagtggagtagctagtggagttactgtatgtttaacatacagtaactgggcaacagaggagactctgtctcaaaaaaaaaaaaagtatgtttaacattttgagcaactgtcaaattattttccaaattggctgtatcattttacagtcctaccaactgtatgtaaggcttataatttctccacatcctcactagcacttgctattgttggcttttttagttttagtcaacctactgagtgtgatgtgatgtctcatgtggtttagatttgcatttcccacatggctaatgatgttgaacatattcccatatgtttattggctattgctacatctttggagacacttctattcaaatcctttgctcatttttaatcctttgcccagttatcttttcattgttgaattataatatttctttgtatattcctcatacaagcgccttgtcaaatatacgatttgtaaatattttctctatttactgggttgtattttcattttcttgatggtgtcctttgaagcacagaagttttaattttggtaaaatctaatttatttttttcttttgttgcatgtgctcttgttgtcacatcaaagaaaccattgcctaatccaaggtgacaaaaacttactcctatgttttcttctaagagtttcatggtcttagctgttaaatttagctctatcacccattttgagttaatttttgtatacgttgaagtattcgttcaaaagaatgatttttttttcagattctttcttttgcacgttatcggttttaatatcatctgttgaaaagatggttctttctctcatgaatggtctggacacttttgccgaaaatcagttgacctcaaatgtaagggtttatttcagggccctcaatttcattccattgatttatatgtctgtccctaggccagtaccacactgtgttgactgctgtagctttgcagtaagttttgaaattgggaggcagctgttaatagtaccttaagatcaaagaaatatgatgctcacatcgcatgagctatggactctatcctacattccctgcaagcaaaacatactgcctttggatatgtaatataaaattcaatatcaataaattctgggctgtctgatttaggtaaccacacatttggagccctgacaatctaatccactgtttccccaaatttgaggtagaactcatttgtccttactccttttctcagggtctcagttctattgtctgcaaacaaccactcaaacaagaatgttagtgatttcctaacagcagtcactattttacaggccaggcacaatctaaatccatagagaagaaatatttttctctaggcatgaaaatcctaggagaactgttaaataagcaagaggaccatttaacattgtccagctgggctccatttctaacttttccaagaccagtggagaggtaattgctgtatatttgcataactaaaaggcccaccttgtactcgttttctaagaacaatggacactgacccaaggtttattttaaatgggcggtttttctatctctaccagagtactctgtaataaataatttctcctaaattttcttaggtctttcagtcttcctgttggccttgtacttgctattccctttatctaggaccacagaaaggctgtgaccttcagtaagtttctatacccctctgaattttgctgccttcatctattgaatggacataatgatagtatttgagaattatttaagttacatagtatccttcagagttgtgaggattaaatatgcctggtaagtgtaacctgtgtgtgtgtgtgtgtgtgtgtgtgtgtgtgtgtatttgaacaggttttcacctagtcacatgtagatgtacattaacatgtgaatgctctgatttcttatctcttttgtctgtgagtattctagtatttattatgctatatgataattacagggtatagttttgtctggctctctcactggtccacatacaccctgagaactgaattggatccatgtttttatattttacttggtattaaacattggtacatagtagatgttcagaggtttcaaacacagttggcagttgttctgtctaggatattagcttcattttactctaaccagccatttatcctacataaaattcaaggtcagtaatcacctgagatttctaagaagggattattattaattaattactgatgctgtcaagaacttgttaattctcctctatgtttgaataatcaagtacctttgggcaaatgtgctgtaaaaacttgagttatccatactcagtatggagatttcttttgtttatttttccttcttcccataaatatttaatgaataccaactggatagcaagcaatgcgttggacacagggaatgcatcaatgaactagacagatatgaagtctacatccagtagggaagacagacattgaacaagtaacctcaagtgtggtgaatgttaggaagattgaaggtcttgaaggaacgaagggcagaataagcagtagaaaagcgggaatgaagagctgacctaaaagtagtgtttgtatataaggtaatttttcaactttttaatttcaggaatacacgtgcaggtttgttacataggtaaacttgtgtcatgagggtttgttgtacagattatttcatagcccagatattaagcatagtacccattagttattttccttgatcctctccttcctcctaccctatgacctccgataggtcccagtatctgttgttcccttctatgtgtcgatgtgttctcatcatttagcttccacttataagtaagaacatgcagtgtttgattttctgttcctgcgttagtttgctaaggataatggctccatccgtgtctctgcaagggacatgatctcattgtgtatgtaccacattttctttatcagtctatcattgatgcgcttttaggttgattccgtgtctttgctattgtgaatagtactgcagtgaacatacacatgtgtgtgtctttataatagaatgatttatattcctttgggtatatacacagtaatgggaatgctgggtcgaatgacatttccatctttacatctttgagggatcgccacactgtcttccacaatgcttgaattaatttacactcccagcaatagtatataagtcttcatttttctctataaccttgccagcatctgttatttttttactttttaatatggccattctgactggtgtgaggtggtatctcattgtggttttgatttgcatttttctaatgatcagtgatgtcaagctttttttttttttttttttttttagactgagtctcgctgtgtcgcgcaggctggagtgcagtggctcgatctcagctctccacaagctccgcctcccgggttcatgccattctcccgcctcagcctcccaagtagctaggactacaggcacgtgccaccacgcccagctaattttgtttttgtatttttagtagagacggggtttcaccatgttagccaggatggtttcgatctcctgacctcgtgatccgcccacctcggcctcccaaagtgctgggattacaggcgtaagccaccacacgcagctgatgttgagcttttttatatgactgttggctgcatgtatgtcttcatttgaaaagtgtctattcatgtcttttgcccactttttaaagtggtggttttttcttgtaaatttaagttccttatagatgctagatattagaccttaatcagatacatagtttgcgaagactttctcccattctgtgtgttgtctctttactctgttgatagtttcttttgctgtgcagaagatcttcagtttaattaaatcccatttgtcaatttttgctttagttgcaattgcttttgttgtctttgtaatgaaatctttgcccgtgcctatgtcctgaatggtattgcccaggtgttgtcttccagaatttttatagttttgggttttatgtttaagtcttttatccttcagttaatttttgtgtatggtataagaaaggggtccactttcaatattctgcatatggctagccagttatcccggcaccatttattgaataaggaatcctttccccgttgtttggttttgtcaggtttgttgaaggtgagatcgttgcaggtgtgcagtcttatttctgggttctctattctgttccattggtctgtgtgtctgtttttgtaccaataccatgctgttttggttactgtgtccctatagtatagtttgaagttgggtagcatgatgcctccagctttgttattttgcttaggattgccttggctattcgggctttttttttttgttccatatgaattttaaaatagtattttagatgtttaaggagaggtataaagtggagggatacaaaaaaaagagcaagacatttcaagtgaggagaaaacatagactgtagcattcatccattcagatatttttctgagtgcctactctgtgctgggcagataaacaaagccagacccagtccctcatcttaactagttcatgttctagtatggaaggaaaatgttcatcaagtaatcacactagaaatatgtgatcaccaattgagacaaatgctaagaaaatggtagtggttctataatgtttgtgacaaaggaaattaacatagagagcattaagaaaaacttcactaagaaaatgattgtaactgagatctgaaggatcagtaaggattaaaaaggaaatgttttctagacagaaaatacagaatgtacaaaggtgctgtggtggcatagagcatggtattttcaagggattcgaagaagacctgcctgtgtggctggagggcacagagcaaggctgaatgcagcagagcagaaagtggtgggagggaggaagaaaagggaagagagtttgtcctgcattttagctcaagatttactgaggccactatgcttaagcgtgtcactttactgacttaagattaggaaaattctcatatggtcccattaagcatgctcagtgtcttgaagtctacatggtatgcaagacagtagctttctgtaagtctaatcatcagttcacacatcgtcaaccatccacctgtaacaataacaggagctaacacttctcacttgctttgcatgtaccagccattaaattaggaattctcttttttaatacttacctcaacactagacacctgtactcttgatgttcccattttacgaaggagagaactcagacataaaaaaattaaataacttgccaaacttcacacagctgggaagttgaagggctagggtatgattccaggtaatttgacttcagtacttgaattattaatcaccacactatactggctttctgatatttttactatggtgaaaatgcatttccgtcagagggaataatttgtttgagaaactcaaaactgagtttagaatttgatggtaataaaatacccagactcaatttctaaatgccgtactgtcaactaaactccacttgcatccataggtgaaaaggtgaagccgtgttttgttcttttgccagtaagtggcagtgctgagtgtagtacaaagagatagaggatagggtttcaatatcaccactcgtacttgtcgtcactgagtttctgcacggagatgaaaggatgagattgaagatgctaacgaagtcaggaaaagcccacttaaccgacagtgctagagaatggagctcaagtaatgctgatagtgctttttttccgggttaagaagacatttctcctggctccccttcctagagtatgtctcacatagttattttaagaattagaaaacatatgtgaagtacctggtctgtagtaaaaagggaaactatttgttttcctgggattagacagctaatcaaatactgctctactagcctgctgtgtatttttaattttgcttaataattttaaattattaatcatcaattaaatatgggatagctataattagatattttatatgccttagagtttttaatacctgtgaatagctgcacatataagttcctctgtcgtctttgtttctagttataaaacaggtgccctcagagagcatcctacagattgataaagcaagtgccacctggagaaacctaattccttattcaagaaatcttcatatgccaagaaatacatagcaagtaataacctaaaactgatcaaaataaatatttagtgactgtttcttcaatgatgacactgtacccacacacacagaaactaacattgttggtgctggaaaggacaaatcaccagctttgaaaatgtatcatgaacttagggatttgggcagtgggagaggaacagccttccagaatttgatcagctgtctatagcatttccaaatgaatcctactttatgatggcccttgagaaggcatccctcatcaccactctttccaaatcagagttaaagcccagagtcacaatagggcttcctttgggggtttggttcaaaatttaaatatcacctgtctctgccactctggttaatgtggccttcttcagtgactgcctctctcaatgccctgtggatttccttcacctttctcctgatcgcatctataattttatctataagtctaccttttgctttgtcagtcccactagaaactccaccagtgcttcacacacagtgttagatacattttttagataatcaggctagtccaaatgaccatcagttagtgagtggataaagaactgtggtatacatatatatgatggaataccactcaaccataaaaagagaatgagttagtggcattcgcagcaacctggatgagattggagacgattattctaagtgaagtcactcaggaatggaaaaccaaacatcgtatattttcactcataagtgggagctaagctatgaggacgcaaaggcataagaatgatacaatggaattttgggacgcggcggggaaaggtgggaagaggatgagggataaaaggctacaaattgggttcagcgtatactgcttgggtcatgggtgcaccaaaatctgacagatcaccagtaaagaacttactcatgtaaccaaataccccctgttcccccaaatcctatggaaataaaaaattaaaaattcaggagatgcaatagtagcagagcacaacgaaataacagaattaaggacacattcgccatatgtctcttttatattgagaacacagcaatattaatgaccagatgatgaccttcaacctaaactggaagttgtgtgacaaagtccatgttggtttggaagctaaaggtggaaagtgagattaaatactatagggcatggaatggtagtgacctgcaacttggagctgatgtaaggacttgataagtcaaagctcactaggatgcaatactagaaaaaatggtcttggtgtatcacatggattaagtgagattaaaagtagtttttttattagatctcaaaaaaaatataccaggctaataagtcattccatgtaaaagcgagggtgacaaagagaagctggtaagaaaggcaaccttgaaagtcttcacactttagagctaaacatgcaaaatatattcagagacaagatgaatgtgctttccttttggaagtgatattgatctggggagagggggagggtgatcttccaaagactttatttcttttgttatcaagtgattggtgtgagtgcacccttttgatcagaggtatgtagacatgcttgagtaacagctctctctctcctcttattgaactgctttttgtgattgatttttaaaataaacgaattgtttgcttcagctaatcagggactagttagtgtatcctgaaaaaggaagtttatataagtgctctttattacctttactgagtgagtgggcttttttgtttttgtttttgtttttgttttttaaattttcagttagttgccccattgacagacaatagagataacagtgagtccatggaatacctcatggtggaaaatgcacagccgattagaaaaatgttctacttgagcgtaccaaactaatcccaaacagtgaattctgatcccctttctgtctcagattttctctatgatcacgtcttacgataataagaagcaaagtctctaatggaagttcatcagtggcaacaactgtggctaacctgacaacccagcacctagtacagtgctcacaggcagctggtgttcaataaaagcttcttacatagctcaccttctcagtatttttgtgtttttttcctttaagtggttagaaggcagaatttaaaatattgtcacatagcagtgggcgtgtaaggtcatctgctgtttgccaaccaaatggtgaggctagaaaacatttgcatataaatgttacatttggttgaggcttttaaattacagaaatgtaggtaaaatggtcagagtggcagttagagatgaacaaatgttttacatctgtggagccttcatatttattgctttgagtgtcattgccatttcctgctggaaattaaacatcacaaatgtatccttcatttgaccaggtggcctcgatgcttctgaaatgaatggcgaatccggtaatataaattgtaatcacatcacaagcatcttcctcttaaccttggtaatgatgtgaaatagtgcattttaagcttgttttgaaggttaagcaggaaatcttatcttggataattaatatttcaacaaaaatcaatgtggctacagttagcaggtaggtaatctgactaattggctcaatattaaatttgttaactacaaattgtctttcagctgaaattgtattggtagaaacaaggaaattggtgaagtatttactagatttgtagcacagtcttgttcagcttgctgtagagagcttgtgatttaaacatggtggaccaatgggagctcattctccagccacctccacagcagtcctgatgacttcccctatctactttataatggcacttaggctgaggcaggaacatttcctcaggaaattgtcaccgtgtccacagaaagtgggttggtcctctgtgtctactgcttcactttctccttaataatccaagccagcactttatgccttgaaaaaaataactaatagttaagttgtctatatcgttttcctttttagaaagtactttcaaatctgttttatcttttagtctttacaaaggcctgtgaggtatgatttatcatcatcaccatccccatcttacacatgtagaatgtgaagctcagaaataggaagtgacttcctcaagttcgtgatcccattaagggacagatccgaggatcaaaacccagacttttgacttcaagtcttgaagtcttttcattgtaccatatcttcatttaaaatggggtccaccctgaagccaaagaaacacatccttactagtaggtatctgacatttgtcttattttgtgaaaaagatattttgggagcacaccttcaaatgctggttcccaaaacttacctatactgaaatttccaccagtctacgcaaatatgcactacattattaaaataaggtggccaggcacggtggctcacacgtgtaatcccagcactttgggaggccgaggcgggcagatcatgaggtcaggagttcaagaccagcctggccaatatggtgaaaccccatctctactaaaaatacaaaaacaattagtcgggcgtggtggcgcacacctgtagtcctagctatcctggtggctgaggcagaagaatcacttgaacccgggaggcagaggttgccatgagccgagattgtgccactgcactccagcctgggcaacagagtgagactctgtctcaaaaaaaaaaaaaacagaaacaaaacaaaaggcagtgtttagtcaattaaaggacagtttttctgttgatactatctttctgtaatttttcacgttgaaaagttctgtcttttatgtattgatgatggtagaaaattgtggtggtactggtggtaacttttagtatccatagttagaaacacctatgttggtttcacacacatctcatatttccccttaaaattctattgctccattaaatccaacactctgtaaaccaggattttaaaaaacaacatacagatgatagaatgggtggcaagtaaaaatgcttcttgcctgcagcacaggcccttagaaatcatcagcggagccaagggtctacaacaagcagatcaaaaatagcagcaagacaggctaactatcttcaggaatcaatgccagcctcttatggcattccctagaggccatctcttgggccttggcacctgtgctagtttcatggttagattagttatgtcctgttgctgaagaacaaggagtgacttctcttccatctctctctgtctctttttgtttgtttgtttgtttgttttttttttttgagacgaagtgtcactctcttgcccaagctggagtgcaatggcgtgatctcagctcactgcaacctccaactccctggttcaagcaattctactgcctcagcctcccgagtagctgggactacaggcacgcgtcatcatgcccggctaacgtttgtatttttagtagagacggggtttcactatgttggccaagctggtcttgaactcctgacctcgtgatccgcctgcctcagcctcccaaagtgctgggattacaggcgtgagccaccgtttccggccctcttccatctctttctatttagctttggaggaaaatgttagagatttaaaaccatttgctataaggcagtattgccttttgcacacacaaaccttccctggtgggggagggccaagggccctcagcttccttcatcccaagagaggaagtgcattgttataaaatccctcatcagtctggctctaccaaagaaaaggtatcataaaagcttcagatctctgcaaaatagtgtctctttttctacagatctttcttgcctggcttctacacatgcatcactgcactgacccgtaaggattaaggaaagtaaacaaacagaaactatccagggctagagataatcagtggaccaggctgagcaaaggaatgtaaatctaagtgtcatgtggctaagaactgctgtttgaaaagctgacgcagtgggaatagcaagagttgacaggcaatgcttagtgtatggtgagatgctcagtgtgagaccagttaccatttgaggcatagctcaggggctctgctaccaagcatggcagataactcccagaaacacacacaatgcatatccaggtgatagtaacaatgtgttttactgtgttttcctcattttttggtttgcttttctattaaaaattcagagaggggtgcatatgtgcttgaaaaatactgtttccccttcactggtagtgtctagcatccctgagtggtctgaaatggaaagagcaacatggagcctcatgcatcttcacagagatttgtttccaaagtcagcacttaaagcaaaatgactgtcattaaagttaccctcagaattctcttaagttggaagtatacatacccatgggagataggcatgccacctctcccccgaggatggaacagacaagtaattgtttctttggttgaaaagcaggtgaagaattaacttaagtttagagccacattgcatgagaagtgggtatctttaaatactctacaacatgggaaggtactctctctatgtgaagccagtgaaaattgaaactgaaaaataaaagagatttgggtccctcatctctaatgcagtgttggaaactgatcaagcaagccacatggtgggcagaattacccacactatttacatggctacctcttctctctcacacatatcactccaatatgtgacctctggcaaatcattctacctctctgagtctcagtttcattctctgtataatggggatgatgtgagtatcaatggccattttaaggaccaattgagacaaagtatgttgacatattttcttccaattatgtaaatgtcttatataaaataaggcatgctttattgaaagaagataatagaaaaagatctaaagaaaaaaatctgaaaggagtaaaaataaataaggaagatcttgtactttagtggaagagaaagacatacagtattaattccaggatattatgtggtaaatgaaaagacagcagtgtgcacagtatgtaatgaaaacatggagaagcaatatgtaatccgtcctggggtacacagtaggctccccaagagagacagtgactgagcagagtcttgacagatggttgatagttaaagaggccaagagagctggcagggtgtttcatgcgacaagaacagcaaagcctgaatcttcatggatatgcacgggacatggaaacattccatgtttcaaggttgtcaaatatgaactggagagtgggaggctacaaggggagagagagagagctaaggcggggagatgatggaggaccttgtttgacatggtaatgagctttagctaatcttttggtggctgacgatctcaaagggttttaagccagcagagtggtataaccaggtttgcattttagaacttgattactgtggcttcattttggaatgggcatttaaggcactaggataccagcatctggaaaaacaggaaggctttccaatatcgcaggcaagaaataataagagtctatcctaagacaaaggcagtgaaagtagaggaggcatatttgaaaaatacttttgtggtgaaatcgtcaaggttcgttggatggtttgggtgaaggtagggacggagactgagagtaaagagtacagaaagaaagaaaaaaaagatcatagaatgactttaaagtctaatgtcttggatggtggggtatcattgactaactttggaatcaggttagggttggagattaagaggtggcaaatttactttaagacataccaagttgtgtgatttatcacacaaacctggattcttatgagtgtgaaaagtgccactgtcaataattttgccaggacaataaatgtaaacctcaattatttcaggaaaactagaatgtaaagtcaccttatctgtaggatactcagcagttgaatatatgagaaatactacatcgatagggctgaaggtttacagtaaatagacatgaacataaagattagattttaaatcatgagaatgtataagatcatccaaaaaagagagaaaagcaaaggcaccttggtgaaaactagtgtttgaagggtaggtgaagttgaaagagccctcaaaagagactaagagggaggaagagaagagataggaatcaggagaggatagagagcagatattttcaggaagcagttgaaaatgtccagtacaacagagaaatcagataagataaggattgaaaaatgcccactggatctggcaacatggaattgacttttgccagagcggtttcatgggagatctgaggccagtatccagatagtggggttgtagagtaataagctttagttaatcttttggtggggggggttgcagagtaaatgggaagtcaagaagtagagaaagcaagggtatacctgaagaaggaaagagaaagagaagtgcacagctgaagggagtgtagagtcaaagaagtgttgctttatatattttttcaggttgacaaaatttttgtatattttaataggctgaaagagaaagtttaaagacacaaggtttattaataagttggtagtagtactgacttgttagatataaagtttgtacaagttttattcaatgatatattaacttatttaagttttgttttacattttgctctgataagtagtgggtagggaagggaatccaacattcttacggggtactttccataacacactgattgcagcatggagaacacttggcaactggaggaagacctcagaaaagtaatgcatgtaggattctagaggaagatgagactaggtgttcggttgggttcctgctcctgaatttgtgcagtaaggccgaaattccttactgtagacagatttccttgtctatggatggcaactatgtcaccttttctaaacaccctgtgggcattacaggcttagggggttaccaaactctggcactgagtaataatgaagccttcatctcaatgtagtagacttttttttttttttttgagacggagtctccctctgtctcccaggctggagtacagtggcatgatctggctcactgtaaactccgcctcccaggttcaagcaattcacctgcctcagtctcccaagtaactggaattataggcacccgccaccacatctggctaagttttatatttttagtacagacaggatttcaccctgttggccaggctggtctcgaactttggacctcaagtgatccacttgcctcaacctcccaaagtgctggcattacaggcataagccaccatgcccagcctcgatttagtagacttttgaccaagacaaatattagtccagaaaagatagatcaggccgggtgcagtggctcacacctgtagtcccagttacccgggaggctgaggcaagaggatagcttgaacctgggaggtggaggttgcagtgagccaagattgcaccactgcaccccagcctgagtgacagagcgagactccatctcaaaacaaaaacaaaaacaaaaaaaagaaaagatatgtcagctgcattacccccaccccaatctccatttcatctgccaatcttcttgccttctgatcaacctacctttcctaccgccattgttccttctctcttccacgtcacttttatgttatggtatctcacttatctcctctactttcaaagtaaccaaacacttttctttccttgtgtgcatcaaaatgaaggagggacccatttcctctacaaataattgactgaaaaataatggttgctcttcactccattagctcctgtgaactttagaaaacaattgatagcttatgtattttcagttttggaaaaccttcaagaatagctgaactttggaactgcatactagacctagcaggatgggacagcaaatagaataacactccttcaggctagtgagtgtctctttgttttcatttggaaagactgcaggaggatgactgttacagcagttttggaaccattgtgtaactgtatcccacgagacaacatcatttggtttcaagatgtttatttaatactgttttcttatttgtattaaccatcaacaacataaagcagatgcacattgaggctgtttacaaaatagcctgttgtacttgcaagatttccaggattcttatgtcaattccctttcaaccatagcctgaacagtcctcttctttggaagcacggacagcgatttcagcttcgcaaaaggctagttgtgcttataacgttcacccagcagcctgctggtgctctttattcatcatatgctctgtgggacagtcatgactttccagcagacataagtgatggtttgcttttgcatcttaaaggcattaatcttgtatgatctgatccatatgctttgtacagtgactgtaacaattaaatgttcacatggactcttttagggaattgcattggcttatttcagaattcaaatactgcttagtgtttttatttccagccagttcattcttatgaatctgttttcaagcctcatctcttctcctcccgtgttctcccaccatggccctcttccccatgcaaaactcctctgtacatagagttcctatggaaacataccatgtctgaccaccctctaggaagttgttgcccatcatttaatctctctttatttgattttattattcttattatttttctttgagacagagtctcactctggagtgcagtggcacgatctcggcccactgcaacctctgcctcccaagttcaagtgattctcatgcctcagcctccagagtagctgggagtacaagtgcgcaccaccacagccagctaattttttgtgtttttaatagagatgggattttaccatgttggccaggctggtcttgaattgctggcctcaagtgatctgcctgccttagcctcccaaactgctgagatgacagatgtgagccaccacacccagcccatttaatttctgtaatataatgttttaaaactttgcaacagagcagttattatcactctttgattatctattttttgtcttttttactaagctattgtctgtcttcttcactacaatatgagctccatgagggcgggaaccttttataatatattcggtgctataataccaacacctagcattggacctgacccatatatgcagttaacatatatttgttgattgaagtattgctcttcagcccgaactgaccccttcttcctttgcgctttgcattttatacatacttatgtcatagcatatttattgcatgtgtcaaccttaataaccggattcaagtgaaatgattattgaacttatttgaacacaaagtttgaggatggccacccagaaggacacagactctaaaagagtggagtcatggctccaaagtggggagatttgagggcccctcttatattggcaaggtctggggaagatgagcaggattacatcattttccatacaggattggtgaatagttaacagcaatttgattggttataagtgtttctttttttttttttttttttggaaagaatataagtgtttcttttttttttctttttggaaagaatatttaggtatatttaatattccacatgaaggatgtaatagtcaaagggtctgttgtctcagtcaaggggtcctctatctcagggccatctcctctgagccaggaataaggaaataaggtaggaaattaatctataacagaaagtcagtaattaagaggtcaagctctgtgacttgatctccaaagtcaacattcctcagggcctaatagatagactatccattttcttttacacgtgaatttgtgtgacatgccctctactcttggtagaattggtagactgtaaacttcttgaggaaagggactgtgtcttcctcctctttggttccctgggtcccagcacagagcttgttattaagtcaatgatcaataaatatttgttgattacctataggttcctcttgattaaatttaactgcactaaattttatgtaataagtttttgctgagcccgtagagtacaaagtcctcagttacaaatgtgggctaaatggaaacagacatacccccttcattcaaacatcttatgtatcttaggtatacgatgcagagactctgtgtgagggtgggtatgcatataaaatacattgaaaatccctaatttgtattccaggagagacaccatgcatctttttgttttgttttgttttgttttgtttttaagacagactctcactttattgcccaggctggagcgcagtggctcaatcttggttcactgcaacctctgcctcccaggttcaggcaattctcctgccttagcctcccaagcagcagggattctaggcgcccaccaccacgcccagctaacatctttgaatttaaggatcctttgtgctttcaggaaaatcacatttgtgttttatggtatttaaacagaaattagtataacccatgattaatacccctaacatgagggaaactataagactactcaatattccatatctatctcaggttaattatgcttcccccactaaatttagtaaagaaagatggaaaacaatgagagttactcttacccatctacggctctccaactaatacttctaagagtgtgtttgtaggctctatcagggaatatatttgctcttatgttttcgactgaataaagatttgctttagctaatgtacctggcatggattacccatccaacatcaggtcaagtgaccttaccctctctggtagcagcaaaggacaaaagaccaatcaaggcaccagatcctccagttactataaactgagtcaccttaaaagtagccaggagagtaggctttgctgttctgccacacagcatgtaacaagaaaaatggagtcatgaattcttggtttatttgggaggtatctcacgcaagataccctcaagtggccagttctaatgtatgtccttttacctaggacacaaattctttccaatatggccagcatatttctccaaacatgcataaccaaataattgtatccttttctctgtgaaagtttttaaaagatatatttctcttttattgacttaacctattactatgtctttgtattataatccaatagttttgtttctcagtagacagtaccttcctaaattttaagaaataactgctgggtgcggtggctcatgcctgtaatgccagcactttgggaggccgaggtgggcggatcatgaggtcaggagatcgaggccatcctggctaacacggtgaaaccccgtctctactaaaaatacaaaaaattagccgggcgtggtggcgggcgcctgtagtcccagctactcaggaggctgaggcaggagaatggcgggaacccaggaagcggagcttgtggtgagccgagatcgcgccactgcactccagcctgggcgacagagcgagactccgtctcaaataaataaataaataaataaataaataaataaataaataaaataaagaaataactgtcccagaaatattttgtgttatccatgtatgtataagagaaaaccatgatacaattgttttaaagatcttgaggtaaattacagaatagtattcctgtaggccaaaaaattaaattatgttctcaaaacatgagccactcatgattttttaaaagcaagttctcaccagaaaatcacctaagctctaagacccaaagccactcaaatttcactactgtttttctctgtttacagcatatagaactctttaaaattcctattgctctcactcatattcattataaaaattttaatttactctaaccatgactacattcagtaagtgctgtttcagacaggaaatggaactattatagtgatgaactcctttctcctagttattaaaggaatctgttcttatcatactgattccatccaacttattataatgcatgaaataaccaattcagtgggttcagcataatgggggagagaggggaagaaaacaacacacataataatagctgacttttaatgagaattctttagggctttcaccaagcagatccaaaataatttatcttatgataatatcaaaagcaaattactcacaagattatactgttaaggactgtcacaatattcccagggctgtaatgctgtctcttacagttttagaaccaactttataacttttgctattagttgctaagaaacaaattataattgcagctcagactctttactgtgttagcctcttaatgccccatagtagcatttatttccttcagatgatgaaatgatcaacaaagtaattgttttatatatagctgacaatgaaagcattttcaggaagcaagccacgtttttatgatttttatctggtggggggagggtagttagagcaatgattttaataacatcacgatgttgaaatggcttgaatcttagaccaatatttaatggcttccttttcaggttgtggtgttgtttgttttgtttgtttgtttgtttgtttgtttttgttggttcgtttgtgacagggtcactctgtcgcccaggcttgagtgcaatggtgcgatctcggctcaggtgcacaccatgacacctagctaatttttttatttttgtagaggctgggtttcaccatgttgcccaggctggtcttgaattcctgggctcaagcaatcttcctgccttggcctcccaaagtgctgggattacaggcatgagccacagttggttattacttagaaatcaattttattttattttttagttattatgttggatggaaagagaggttgaagagtagaaactttggagtgagactaataagagtttgaatggtagctctatcacttactagatgtgatgaactttgtgtaagtcatttaatttcctcaaaagcttagtgttcccttctgaatattaaaatgaagatattaatacataccttgtgacatcacatgggcaataaacaggataatgtatttgaagtatctagaagccatacaataagtggtggtggtgatttgtatgattgttaagtcctaaaatgagggggaaaattcttaggatatccttaaaagccttcataaagataattggctaatagagtagagtagcaatacgttatttcaaattagtacactattgactctcaagaattcataccaacgtcagatagtgacataagaaatttgttaatttattcatttatttgaagaactaactgaccattatcattttaagtactcactgataaaaggataaaagtagtggggaggtcttaatcccacagctgtaatgggcaacatgtgatcaaagagaaaaagttagtgtgtatatctgatgtgtactctgacccaacagatgttacatataagaataagataaaactagttgtcctgcaaatctacattgtgagggccaaatgttgaaacagaatgatataaagtatttccaatttagctgtagtaagcaccacagtttttattactaatgccttttctggtacgagacatttagtgtttgactgcatggacctttacagtataggagatcatgtgtgcctgttggcctctgtggaatggattccttgccctctcagccctgttcccctaaaaacatgtttaaaatctctaaaaggctctggatcttccaactctcaatatagaggcatgttctcttttatgcattttctctttggcttccacataagaataaaagactatatattttttaagtagtttctccagaaaataatctggattttaagcttctcttaaagacatggaatttctggcaaccatgtctgccattgagttcctccacatggatttgttcttctactactttgatcttacatgtaatatgcaatcacgctagcctacctcactcatctaacttttgtttctgacccttaagggcaagtgggtttgtagtccttgctattccccagtacatacgcatgcccttaaaattccacgcccgtatggatgaaaaaatgccactttaatatctataataatacattttcatttcctgagaggtaaagttgtgatgctgttggtcatagagaattaaattatctttagcatccctgcattatacgttttagatattgtgaattcgttgctgattgtaaatatctctcacaattccaaacccaagttaagtagaatattttgttctacatttaaataccacttgagcacatgagactgttctgggaactctaggaaagcaggaggcaaatcaactatggtcctgccaaaaatctcaaagcagtagaaatgggaaaaataaaaagaaatatacatggagtggtgaggttcaaatgaaaaggaaagaaaccaacaaacatgccctaagaccagttgaaacagtgtatccacctaaacgaggaataaagatgcttttcatcttaattccagaaagctcaaactcactgaattcaataaataccatttatagtctttattcatctatattcttcattcctccttttgaaactatggagaaaatagttggccatcttgcaggtttatcatcattaacaaatcaaatgtaaaatgctttgcaaagtttttaaaaaatgggaaaaagagcaagcataatactatgctgtgaatgagatctaagctgtatgctaaggatatatgcgtgagtgagcaatgtcaacgaagagtcaaactctttgaagagatattatttgaatgttaatatattaattgaaatacttgaggagatatattctgagccacatataggtgactatggcctgtgacacagccctcaggaggtcctgagaacatgtgcccaagtggtcggggtgcagcttgcttttatacattttagggagacatgagacatcaatcaaatacatttaagaaatacattgtattcctccagaaaggcaggacagctcaaaggtggggggtgcttccaggctttgggtaaattttttttttttttttttttttttttgagacggagtgtcgctctgtcgcccaggctggagggcagtagcgcgatctctgctcactgcaacctccgcctcccgggttcccgccattctcctgcctcagcctcccgagtagctgggactgcaggcgcccgcaccacgcccggctaattttttgtatttttagtagagacggggcttcaccgtgttagccaggatggtctcgatctcctgacctcgtgatccccccgcctcggcctcccaaagtgctgagattacaggcatgagccaccggtaaatttaaacaatataaaggaatgtctgggttgccataagaggttgtggagaccagttttattatgcagatgaagcttttagctagcaggcttcagaaagaacaggctgtaaaatgtttcttatcagactgaagtctgtgttgatgttaatggcggagaggtataaagagtataaagaggcatgtctgaccccagcttcccttcttggcctgaatcagtctttcaggttacgttttaagagccctggttgaggaggaagtccatttagatggtaggtgggggggggccttagaattttatttgtggtttatagcaagatacctctgcatgctgtatgaaccctttcagtctgccttccatgattgcatcttttcactaaagagcttcctagtggcgatgaagacttgaaaatgtaatacatacccataactgattcctaccttcttattctgtgtgtgtgtgtgtgtgtgtgtgtgtgtgtgtgtgtgtgtgtgtgtgtgttttaatgggaaggaaaccacagtttctaaatggtcccaccttccttattaacaaagaattagcataagtcccagaacattatagctgtttctctaagaagttgtgatataccaccgggcgaacaggagaccaggtgtcatgattcagtttggggatcgaaaactagtaacaacttcactttgaaaatcttttcagtgcccattccctggggctttcaggctaagctactgcttttatttctctgctatttaatgtataacaaaagaaaaagaaggcatgtatcctggagccctgtggtgaggaaaagcaacttaatgtttatgaagtgctttcaaggggatcataatcttaggaccaatgagtaacccggaatgagttttgtgtttctcttgggtctcctggcctgatccataaatttacttagctatgtcagggatcctagagaatactggtccagttccctaactttagaggtgaggagtgccagtgcggtggcttacgcctgtaatcacagcactttgggaggcagacgtgggaggatcacttgaggccaggagttcaggaccagcctgggcaacacagtgagattttctctctactaatttttttttttttttaaattagcaggacatagtggtggtacatgtctgtagtcctagctactcaggaagctgaggtgggaggatcacttgagcccagcagatggaggctgcagtgagccataccatgtcactgcactccagcctgggtgactaagcaagattctgtctcgaaaaaataaataaaaataaaggtaaggcagattgaggccttagagataattcgtcttgaaaaaggtcacagcagttagctgcagtctgaatgctattattaggacttcctgtccctctccacactatacctattgttttcacagggtgtctctcctttatctccagaggcagttcattggattatcactgggatcaatggatcagaaggaataagggggtgaagtaggagccaaaggaagtagttagaaactaattgtgttttttctcagcaggattcaggctttttctcagcaggatccagcttttaaactttttaacttctaaacttttctctagagtaattgaaactaacagtattttagtggtgaaatgtttgcagtgcttagaaaaatctcgaacaaatttcatgtctctcatgttataaaacagcatttgaactcaagactatagaagagttgtaacgtaaagacgaatccattttcggcattttgaaatatcatttgatcactgcaggctaattgctgctgttcctaatccaccaggttgacacttaatgaatgttcatgatgaatccgttctttagttagttgaaccctataattttcttgcttcgttttcaatttacaatatttgtaataaaggtgccatgcataattccctaggaaaggtcaatatactcttttattaaccataagcctttctggtcttctgggtgtatatttgtcagggaatagactattcttttatgatttcaaatgttagattgtacagattggttatctttactatattacctgctgaaatttctacatatagacatttagaaaattgggataatagcaaccagccttttttactattctttcaggaatgagaaactcaaacgtgtgtggggaccgggtatgtaacatgaatgagtgaacggggaatggatacaaggccaaaagagacaggtggatattatggtagactggagctcatgtgttctcccttaccgcctatactgttttgaaaacaatttaatcattatgctaggcaaacacaacacattttgggctgattttctcaactttgtttattgcgcacctccacatccgtttgatcttcgaaacacaatatagggagaatataattagacccttttttcagatgaggaaactgagttttagagaagttaaggtctttgcctgaagtcatacaactaagaagtggtagaaataatattcaaagttaaaccatactctgatgcctgtaaaaccaaaactgcactctaaggaaagaaagatcatgtgatgaatgcagttcttttcagcactgaaagaacatcaagctggaagttaagttaaataatgtgggagcattacagtcacctagaaaaagcagagttgtggtggccgacctggctggattaaaatcccagctgtgcttgtcacctgacagccatctcactttgagcaagtatttaatctctgaacttcatttccccctctgataaaagagataatatgactcacctgaccagatggttttaagaattcaataccatggctcatagaaggtattcaataagcgctagttccctttctcctacagaagtaagtgctggtatgagtatagggaagattttaaactaatgagttctttctttttgagtacttggataattatacttgagtagttcctgcttggatatactctgaaaacttggccttcttggccctggacaccctaaccccctgcagtcttatttattcattcttctagtcaaagacatgggcaagtacatgtgttctatttgtatataagtacacatttgtacatgcgtacacacacacacacacacacacacatatatatagagagagagagagagagagagatttaatatgataaattggcttacatgattatggagtatgaagtcccatgaccttctgcctgcaaggtagaaacctaggaaagctggtgttataattccagtccaagtctgaatgcttgagaaccaggggtgctgatagtgtaaattccaggccaagggcaggagaagagcaatatctgagctcagtaggcaggcaggaagcaaaaggagtgaattcctcttcctctttcattctactcaggccttcagtggattgaatgatgccaaccacatagttggggggcagtctaccttgctgagtccactgattgcaatgctgacctcatctggaagcaccattacaacacatccagaaataatgtttaagctttgcactccttggcccaaattaacatataaaactaataatcacaaatgtttaacacaaacaagttacagtgaaaatacaactggttttgtgatagatgggaactggaaggaaactcgacaatgagtggtcaggaaaacccctcagatggcaggattacattgcataatttgtgctaccaccccatgtggcggctctgctgaagtgatacggacaggagacagggatatactgggtagaagggcagtccctagtgagggccacaccctcaagcctggactcatggcccaaagtgagaacatgccttcctgttttcccacccacatgttgcctttcccagaaccaccctggcccacgctgcccccccccgcccccccatcctgtacccataaaaaccgcagaccccactggcagagcagagaggcgtggcagaggagagaagaggtgtccgaacgttgagaggtgaagaaccagctgggcatcggagactacaatcggagaggatttgggctggggatggttagagaggagtttgtcagccgaactccaggggaagacaacccttcccctccatcccctttccagcccccgcttcctgctgggagccactttcattggcagtaaaagcctccacattcaccaccctccaatttgtttgtatgacctcattcctcctggatgctggacaaggacctgagtgcaggtgcaagaggctgtcacactgaccctccactgagttgttttaacacttaaagtgtccacggacagcaaagctaaaagagcacactgtaacacataccttccggggctccggggccacaggcaacccctagatgctacagcggttctgcacagagtgttgctcctgccagttgcccagaagtgcttgtcccagcctctgcacctgcttacctgcgtgctccctcaccctcaacgggttaagatctgtgggctgcgtaagcaagctaccccttcacaagtcctgtgaagggatcaagggaactgccccatttcaatttgagtttagacctgaaagacaagaaaatgattctcacccctcaccaccatctcctgattacctgaaataatgaacagtgttggtaactatcaaaacccatctctatcattttaaaagtcattatcatgttctggaaatttttttaaaaagcttctactggagccaagagtggctcagctttcaagaaagaatggtttttgctcatgattttctgtattttaaaattattagatccatttctgtgaagtgcaattgaatggtatagtgaccaccatcacaggtcagggagagcagcttttcaggagagtgaaatctggtgtcactcttgaggccaaaaataaaatattaacctcaaatgcagtaagtaacctcagtaatttatacaaatggttctattttttatttgaactattgtttcttggcactcattcatgcaaaaactgggttagaaattggtatagttggttcatgctatgaacatacagtttgatcttaatagttaagaggaataacaaaaacttgaaggtattttaagaaaatcggccaggcgcggtggctcatacctgtaaacccagcactttgggaggccgaggcgggtggatcacctgaggtcaggagttcaagaccagcctggccaatatggcgaaaccctgtctctattaaaaatacaaaaacagccagtcgtggtggcgggcgcctgtagtcccagctacttgggaggctgaggcaggagaatcacttgagtccaggaggtggaggttgcagtgagccgagatcatgccactgctctccagcctgggcagcagagcgagactccgcctcaaaaaaacatacataaataaaataaaataaatataaaaggcatctgaccaaaattagtttaccacttaaggagtaaaccgaggagatatatagtgatcattacataccggaattattgctataaaagccatagtgtttatttggtcagtgtccgaactttttacaaggtaataatagaggaagaagaatcctgtaatgactgaattgcattttctggaattggattccctgaattcagatttagtctagttcacttaccagctatttaaccacagtcacgttatttaacttctctgagtctttttcctcatctgtaaaacagggatgcaatagcgcatactttgttggttcattaggttagctcatgcacaaagtgtacttatcacacagtcctgccatattgttttgtgggtttttgttttttttttttttgaggcagggtcttgctctgttgcccaggctagagtgcagtggtgcgatcttggctcactgcaacctctgcctcccaggttcaagtgattctcctgcctctgcctcctgaacagctgtgattacaggcatccgccaccacgcctggctaaattttgtatttttagtagagacggggcttcaccatgttggccaggctggtttcaaactcctgacctcagatgatctgcccacctcggcctctcaaagtgctcggattaccgtgcccggcctatagtattaataataatatataatgtaatcataagagtaacaactatataccatcacatcatcatcataacagaaatagctaatgtgtattgggtacttaccatgtaccaggcatagttctaagcattaatttcaagtggacatttgggaagagagaagtaattcaggcacccaagggaaatggatttttgaaatgtgaattgtcttctgtgtcctgtggccttccattttgcagacacccactcatttcactgtatgatataatttggaattatttaacccaatggaatataaactgatggaatgtgtattacttcatactatcatgataaaatagaatttggagatagaaataattgatctctcatatgacacaactgcccattcacaacattcttactgaattaagatgttcaaaagcaaactttaaaaaatacatacgtaaggatctatgatatgataatttttaaatactattatttggctaagtattctccacaatctttggaaaaatatactgtcttgttaaattcttttccaattaaattgtaatcccataaagactcctattctaaaggtcaaattaaaaagcatttatcctcagaggctctaaaaaacagtcattagaatgccaacccttaaatggaaacaccattaagctcaatagctgaatagcttttattagaattacccaatccccctagccagccctgcaaccctgctgacaccccagggcctgcaggagaggataacctctgtatttgtttaagaaatgacaagaaaaattttcttttttaaagatataacagtcaaagactttggtctttacatagatgagcatatcaatcttctaagagacacaaaaacagaaaaaaagttctgattctatctgtctttttttttctcctgatgcttttaaggattcccctgtattttattttctctttatgcctttgaggatttcctctggggctctacataatcaggtggatctttaccatgtagatgctgcattcagtcttaatgaaatgatctcgggagccctaggaatttgcctgaccattcaaaataagcatagcaaatgaaatactggtctctagaaccagattgtggaggttgaaattttgacttctcctattacctgtgtgtctctgggaaggtcctttactctgaatctgttttctcacctgtaaaacagtaattcctaatccaaggagcacttgcaagaattgaagatatgacacatgtaaagtgtggaattatgtttagttattattatgcaccctcattattaggaaattgccatgcctgagaaggcttagccctgacctagttgccaaagtggatgcaactcagatttctttttttcttttgagacagagtcttgctctattgcccaggctggagtgcagtggcgtgatatcagctcactgcaacctccgcctcccgggttcaagtgattcttctgcctcagcctcctgaatagctaggattacaggcttgcgccaccatgcccggtgaatttttgtatttttagtagatggaatttcaccatgttggccaggctggtctgaaactcctgacttcaagtgatccacctgccttggcctcccaaagtgctatgatggcaggcgtgagccattgtgcctggcctcggatttattttggtagaaaatagaggataacccaaagaacaatgtagagaggtttttaaaaaaaattaaaaagctaaattagaggagacctggaaaagtatatatctgattgcaagattaagggtaaagttttccattgtttggaactggcccttaattctggttacaatagactagaaaagtgcttatggtgtttagccatttagtagagtatccaaggaaggtagctctttctttgagaaggtacaattagtaataatgatgattctaataatagcagcaattgccatttagtgctttgcatttaccacatgccacgttacacaatttacaagcataatttcacttcttatttaggggaaaaattattatctctttttaaaatgagaaaaccaagatgaagtcaaatgaagtaatttatatggagtcacactgtaagtggtgaagttagaattcaaacctgagtttgttagattttcatcttctgagtgctactgcctcacctggatgaggttccctcttctgtatttggggccatgtaaagggattagttgtggtgaagtgaactggagagagaaaggcattgagccatagtggatctcaagagatcctctgggccagcttgctgccttccatcaggtaaatgacccagccatctaggacagatgcttgctattttttctgaaagatcttcagggatagtcgtttcacaagctcctcagaagggaaaggagcagaatcagtcaagcacagcaaagtaagggcctaagtaggcagatgtgctcagtgtcactgggacccccagctgacaagcttgctgtgcagtgttctgcttgagaactttctgtttaacatgccaggcaaatcagccaccaagtcctaagtccaggaaaatcactttattttctgtgagtgttgcatgaatttatccaactgctttggttgtagcagggcaagtttgatgtctgtcatagacctatccaccttctgtaaaagcagttcagaggatgaccaatgagctatctttttctgccattcataacttgtgcatttccttgacttgcttctgttacaaggaaaatgatcttattttttatgcaaatcttgcacataaaattgataagtatttgatgataatcagcatctgccatcaccattttgcagacatgacagatattattacttttgtttagataaggttcaaatgagcttggatttggttgcttatttaatacttgtcttctctgctagcctgtaaactctgtgtcacaagagtaattacagtgtcttaaacctactatacactgaaggatgaagacaacaaaggcagaccaagatttgagtcggcagaatttcagtttccacaaggacaagccattttgacctctctgagattattaaaatgagttttatcatgtaactcacaagattactgtaaggaattatgcaaataatggtggtattattgttatttttattatttagttcagaaatcactttttaaagatgaggaaactgactgggcatggcggctcgcacctgtaatcccaggacagtgggaagccaaggcgggctgatcacttgagcccaggagttcgagactaacctgtgcaacatggcgaaaccctgtctctacaaaaaatacaaaaaattagctgagcatggtggcgtgtacctctagtcccagctactcaggaggctgaaggggaaggatcacctgagcccaggaggttgaggctgcagagacctgtgattgtgccactgcactccagcctgggtgatggagtgagatcctgtctcaaaaaaaaaaaaagatttagaaactgagctctatacaaacatagtaagagttcacccaagttcatggacaagaagaatgcaaacctgatgcctgatgtattacttttctcagctactgtaataaattgacctacatttggtgacttgaaacaaaagaaatgtgttcttttacggttctagagactagagatgagatacccgaaacttagtaggaatgcactgcctctaggggttttagggaagaatctttgcgtcttccacctcctgatggctgccctagcattcctgagcttgtggccacatcttcccagtttctgcctctgtcctcacattgccttctcctctgtgtgtctgtctaatctccctctgcctcactcttagaaacccttgtcatcggatttagggcccactcagataatccgggatgatctccttatctcaagatccttaccttcctatgagatgggttgataggtgcagcaaaccaccgtggcacacatttacctgtgtacctgcaatcctgcacatgtacccctgaacttaaaataaattaattaattttaaaaactcttaaccttatttatatctgcctaggtcccttttcctagttaaagtcacactcatgcatcccagcacttaagacatggacattctttcggggggcccttatttaacccatatttttacatgatccctatgttttcctgacaaggattctaatttggatgtttttacaataataagtgttatactgtctgaatcaaataataggaatttctactacacaacaatcttcgtgataatggcttaatatataatctttatttcacagatgaatcatttcaagatccatgatcctcctagtttgacagaaataacataatttgcttgaatattaatgttgctcttagttttgagtgagatgtttttaaagtatctaaaactgattggtacacacatcttttcatttgcagctgaatatgtactaattctggctgtgagcttcctaagcaagaatgctagaagccaattgaattagcaaatgcactcagatttttgatagcattattccactgaatgtggaagtccttcagaaagaatcagctacagaaaccgtcttgctaacagacacctgtcaaaaccaattccattcacttagcactcacttctaatattgaagggtgttttgttataacttcagtatcttcccacccttgtgagagagaatagggtgggagagagaaatccttagtttaggctgttttgaaatgggtatagtaataataaatccctcaaattttatataagatgtatttatactttgcattttcaaaatacacattctcaaataccagtatttatggaaacattcctctgatgagtgaagatttgcaaagcagagcttagctttcataaaagatagggacatctctgtcacaccacccatgacctgagacatgtaacctccttggggaagtattattgtttccattatggttgctgaggagcagcaagttcagttgctgaattatttccacatgataggcaatgaaatgaagaaagctaaccttgtataaaatgctcaaaacaggaagacagagttcaaatgaaaacaaattcacaattagcttcatccgaaatagaaacaggtttgcttgctggaaagaaagttcacactcttcactctcgattcctatcacgcttctgcttgtttctccaaagctatatgaaggctggttaatcaccttatctattcataaagtctattaatctttcttattaacttgtaagaccttgtcagatgaggtccaaaaacaagttttaagaccttgctattactactggtaatgtagtaatgtttctccatttctagcttttacccacaaccacttggtttatttccatctataatggaacaaagaactttgagttttactggatttttgtcccttaattacggatgtttgccttcatgaaatatgacgtggttttggtttaatgaaagagcatcgaagctgtcaagaacctcagtgatttttcttttcagttcttaatcactgctatttgagggatgttttgatagtatcatttcttaattgcgttttcgaaaaatgatttgtttcaatagccacatttccagaacttgacaatcacctcactgctgctaccagtatcgtattaccttattccatgctacctaggaaaaataacagaaaaagtaaccatttcttgccttgattacagttactgactacagaataaggagaagaaaacaaaatcatgtggaacttcagattctgagacattaaaagggcccacatagcattcagttagtaacccattcctatgaaagaatctttgagaatgaatcactcaaattcctatctgagaaaaatgaccaactactgcctgccactttactagtgggccatgattagttggaaataccaaatgaaaacatgtactgccatgcatatttttcttggtggtgacatttgtagcataaagtttacagcataaggaaatttaacatgtttcaaattcaccatatctgttaggcatgctttcctgttcattcatctcttttaatagtttggaacaaataatgaaaaccatgtgccatgttttacagattctgagcctcaaagataattaaatcatgaaagaaatgtttctacatctgcaaaaaatgtctggtgcccgatccatcagtagaaaaagacttacaggcaggaagctctgctgcagcagttctcagggtatgcttaggaaggacactgattctcagagagatcaacaattaacagttcacatcttagttttctaaaagacttctgggagtctttgatgctgtaatgtatgttggatagtcccaaaaaggagatacaataaatagtaactcccagtctcttgataataaatccctttttttgttcatagaaaagcactgtttttagaacaaactttgcaaaaactgttaacatagcataagacagtggagtagaagaagagtgaaagtatcgacttgggttctaaccctggctgtacctcaaatagggcatgttaagcatatcacttgaccgctcaaggcttcaacttcctttagagatagaaataagtcatctcttgagtcctttgaaaacttacatcttccattctgtttaggctgctgtaagctgccattgactgtgggcttacaaagaaaggaaatacatttcttacagttatggagcctgggaagtactaaatcaagacacaagcagattcaattcctggttagggcctacttcctggttcacagactgctatcttgtcactgtgcactcacgtggtggaaggggcaagggagctctgtcgggcctattaggggactaatcccattcatgagagccccatgctcatgatctaatcacttaccaatggccctacttccagatacactttggggttaggattttaacagagaatttgaggggtggggtggggacaaacattcattgcataacactttaaaataccataattctctgtccatggttaagaaggttcctgtgtaatatatgtaattccattctgtaagttttattatggtctgatagttttagtaagagttatcaaacccactggaatatttaaatgattaaataacccgaaaaagttactgttttgaaagtatcacagtcatgagcaaataatctaaattaggcagattaaataccaaaattggacctgacaggctgaccctgatcctgaaaggctctgaccttttcctggtggcattggttcaaacatccatcccctctcttctctccaaaaaacatggaaaggaacttgtgtaactgggatttggtgagctcccaatacccttttctcacaactccagtgacattcccacggaggaagggactctataatctattctgttaaatggtgagaagcatcattttttcgtcttagcagtcttatattagagtaacaaatgggtatcttttttttttttttttctgagatggagtctcgctctgtcgcccaggctggagtgcggtggtgccatctcggctcagtgcaagctctgcctcccgggttcacgccattctcctgcctcagcctcctgagtagctgggaccacaggcgcccaagaccacgctcagctaattttttgtatttttagtagagacgtggtttcaccgtgttagctagaatggtctcgatctcctgacctggtgatccacccgcctcagcctcccaaagtgctgggattacagacgtgagccaccacgcccagccacaaatgggtatcttttgattcaaatttgtcttgtatccaaaataggtacatgtgatcaaggcaaaaagaaataaaaatatataacatttgattgtgagtaatcttttcattacacctaatgttaatgtgttcatgattgcagaaggtgtaaataaccatttcttagatgtctagtttattaatcacagaaatatctggagaaaagaacaggattttttattctcacagagaattgttgattgggactttcttgacccgtaagatgtaaaggttaaggttgtctttgttgctttcttttaaattaaatccaagtgcatcttaattaggttaaatacttggttttggaccaaaaaatagggacttcaacaagctacactataacttataccaactgaagttggtagcttttaccttccttcatcattgcagttcttactaaaatggaattagtgggagatgtttcttaaaggattatatttgaaggttttctggaaaccaaagtgtgaaaagttgaagcactcatcagtatggcatgacatgaatttgaagttttttaaaggcaagcaagcagaatcttttggcataccctaatctaaaaatatcacttgattagattcacttttcaatattccttttaattctatggtacggtttttaatgtgcccttatttctctaagaaaaaaatgaagagctagaatctaaaaataaaacccgtacttaatacacaagctaaatatactcccaagttttctcactgctacattaattcaatgaaatctaatttaggctagtaccactgttatgaataaagatgaatacacattaccagttcacattgtgttgtagcatttttctttgagacttatcggaagaaatgttaattgcttaagtccttacataagatccggtgttctttaaagttttcttgaagagagattaagggaaaggtgacaactaagtttgcatttatttttagcttcatcctattctattgctgtattcccaaagtagtcatcctgactttatagcattccttaagagttaactttccaaaacccagatactataatgttgctcagtaccccacccctacttcatactcagattcctacagtagcccttgttgcttataagagtattcccaaactggtgaattctgctcctgcccaatgttttgttattgttgttgttttcatagagatagagtcttgctctgtcacccaggctagagggcaggggcatgatcaaagctcactgcagcctacaactcctgggctgaagtgatcctcctgcctcagcctcctgagtagctagaattataggtgtgcaccaccatgcccaactaattttttaattttttgtcaagctggggtctcactatgttgtccaggctggtcttgaattccaagctatcctcctgcctcagcctcccaaagcactgggattacaggcgtgaaccaccactcccagaccagaatgttaatttagaaagctacactgggaatggtggcttacgcctgtaatcccaacactttgggaggccaagtcaggtggattacctaggtcaggagttcgagaccaacctggccaacatgatgaaaccctgtctctactaaaaatacaaagattagccaggtgtggtggtgggcgcctgtaatcccagctactcaggagactgaggcaggagaatcacttaaacctgggaggcggaagttgcagtgagccgagatcgcgccactgcactccagcctgggcaacaagagcgaaactccgcctcaaaaacaaaaacaaaaacaaaagcaaactccaaagagttcagtgcccagatgttagattaaacaagtccctttactgcaaagtttttttgtgcagaatgaactgaatctccaagagttcaatatagtttttaacctttcacaacttaatcataaaatatttgtaaggcattcctgtttagtaagattattctgtggaagacaaagtaaaattctagggtgttaacaatgtctgttacactatgacccttactcacatttcttgcttcatgtcttttatttttgtgcagataccttactactgtttgatgaccacactgagtattttttttttttttttggtataaatttagaaggtaaaagtgcaattttgtttcatggatatatcctgtagtggtgaagtctgggattgtagtataaccatcacctaaataatgtgcattgtacccattaagtatttttttttaatccctcccaccctcccactctttcaactctccagtgtctattatttcacattctatgttgatatgtacacacgttttagctctcacttgagaacatgtggtatttgactttctgcttgtgggttatttctcttaagataatggccttcagttccatcgatgttgctacaaaagacaagattttattcttttttatggctgagtagtattccattgtgtgtgtgtgtgtgtatatatatatatgtttatatatttatgtttatatagtctgtatatatacatactatatctatacacacataaatctatctatctatctatctatctatatatctatctatctatctcccattttctttatccaatcatctgttgatagacatttgggttgattccatatctttgctattgtgaatagggctgctataaatatgtgaatgcaggtatctttttcttttctttttgagacagggtcacactctgtcacccaggatggagtgcagtggtgcgatctcagctcactgcaacttctgcctgctgcactcaagagatcctcccacttcaaactcccaagtagctaggaccataggcacgcaacaaaacacttggctgtttttttgtatttttagtagagatgcggccttgtcatgttgtccaggctggtctcaaactcctaagctcaagtactgcacccacctcaacctcacaaactgctgggattacaggtgttagccactgcacccagctggtatccttttgatataatgatttttttttcctttgattatatacccggtagtgggattgcctgatcaattggtagttctattttcagttctttgagaaatctctatactgttttccatagagttgtactaatttacactcctaccgatggtatatagatgttcccttttctctgcatcctcaccaacatattcttttttgactttttcatagtagtcattctgactggttgtaagatgatatctcagtataattttaacttgtgtttttctgatgatcagtgatgttgaacattttttcatatatttgttgtccatttgtatgccttcttttgaaaaatgtctgtttgtgtcctttgccttttagtagggttatataggtttttgttgttgttgttgggttaagctccttgaagatcctggatattagttccttgttggatgcatagtttgcagtatttccttctattcttcagattgtctattcactctgttgattatttcttggctgtgcagaaacttttaaattaagtttcatgtgtctattttggcttttgttgcatttgcttttgaaatcttactcatggattgtttgcataggccaatgtcctcaagagtttttcctaggttttcttctagtatttttacagtttcaggtcttttttttctttgagatggagtctcactctgtcacccaggctggagtgcagtggcacaatctcgggtcactgcaacctctgcctccggggttcaagcgattctcctgcctcagcctcccaagcagctgggactacaggcgcctgccaccatgcccggctaatttttgtatttttcagtagagacggaatttcgccacgtttgccaggctggcctcaaactcctatagtttcaggtcataactttttcacatgtatttttagaaaaaaattttaattttaatttttatgggtacatagtaggtaatactaagcctttcacatagctcgagtttatttttatatatggtgagagataggggtccagtttcattctcttgcatatgacaatccatttttcccagcaccatttactgaatagggtatgctttccccagtgtatatttttgtcaattttgtcaaacctcagttggctgtaggtatgtggctttaattctgggttatctattctagtctcttgatctatgtgtctatttttataccagttccatgctgttttggctactgatagccttgtagtagaattcgaagttgggtaatgtgatgccatctactttttttttttttttgcttaagattgctttggctattcaggttccacaggttgctttattggttccacattaattttaagatttaaaaaaaaatgagaaatgacatcggtattttgataggaattgcattgaatctgtagattgctttggataccacagtgcatatttttaatgccttttcgtcattgtgcatgttgttctttaccctgacattcgatttatttcttctttcttctctcaaaatcttaatttttttcgggtctagactgcatgttatgtactttcttattattttttatcctgcaagaaaataatttgctttctcatttgtaatctcacagcattttgtttacataccactaaagttcttattatctgttttgaatctggtaattgtccacatcttcctacaagatgaggagttcttcaggggcaggagctttatcttaattcatctttgcaactttcatttcttagttctctgccagacatgtaataagcaatcattctggttgaagagaatcgagttgaataactacaaaactgtaagtcaaaccatgtcactcctctgttcagaaacctgcagtggcttccatattgactcagactaggaactaaagatcttatagaggtcccctctctgtcccaatacctccctgactccatgtcttaacttttatcttccttattcattctgttccagccaaactggctctgtgatattcctcaaacatgttcagaatcctgtctttaagagccctttcttctacctgaatgttttcccgtaaacattcatctggctaaaccccttgccaccttcaggtctctactcaaacgcacctacttcctgaaacttacccagagtccatttttaaaaattatagccttccttcctactcccagctctctcaatccctctgattctactctgtttttcccattaccactgcatgaccttctaacacactatgtcatttaactttttatcatggtattattttcctgcctcacctgatcagatgtaagttccacaagggcaggagtatttgtctgctttgttcattgttgtgttccatgaccttaaagcaagatctggactctgctttatgaacatatgttaagagaactgaatgaatgaatctggtttttatcccattttctagttcagtgaatttgtgatgtctgtttgtcacagtatttccatatagaacttagtaatatcagggtagcttttgttagttttcattattgaaaaattgttctctgtacttcagctcactcaagctgtgaaagcagtgaaacattgcatcaattaaaatattccaattaacactaatcaagaggagcaatagtaataacatagctgaaccaggttgttgaatctttgtagcctcacacatcactgtaggcacagtatgtcaattaaataagataatttttccctattatgcatcttggtaaaataatgaagatattctttggagaaaaataaagcattattaaaacatgggtccctgttttaaaatagcatgcttctgctcttcaatccagtatagcattgcttgtatcattgtcgtgattaagaataaaatttcatggcatgtctactctgtcagacagtgaggtaggttttgggagcctaggaaatatgagatgttgtttttgccctcaaggagattgtagtctcccctgaaagtgtttttttattctggtcctagataatgtacttattagaggtttaattctaagcaaacctcttaacttttctgagtttcaaatattttctacaattaaagtttatacttaatgccatccatgtctgcttactgagatgttttcttaatcaaatgagttattagtaaaaatgttggagttttctctatttgctaaaaataagtactataaaaatgtaaggaaacatatcattattggtctagttgctgctactattattattacaactacttctaattttgttcttgccattattatcattttaaattattattgttaccatcattatcatctttttcataatcatttttatgcctgaagcatgggctaagacactatatttaccagtaacatgtatccagtgcccaccaagtgcccatccctgaaatttatcgataaccctcacatcaatccttttggagtctttgtggtcatttgtggacttgtgaagagcagcaaaatatttaagtcacccaacacttattttcccagctgaggttgaacaaagtgacactctgccttctcgtttgagctctaggtgtacaaacaagtgagctttttgctgtctgtttagtggcacgttgttttgccttctttgcttttttgttggtgatttcactgtttaaaatagcccaagggaatagcaccgaggtgctgtctagtgttcataagcataagaaaatcgtgccttacagaaaaaatacgtgtcagatgagcttctttcagaccacgaattcaatgtcaatgagtcagcattatgtattaaataccatgtcttcaaacagaaacaagtaaagcaaggttatgtattgattggttgatgaaaatggtgtgaccagagactcgcagaaacctaaccctgtatttcccctacggtttagcagtcactaattcagtgcttggggcaactttgcagagaacataactacagccagtaatgtaaattgactgtagacacccggcagtatggtgctgaggctgaaagcaattgagaacacaaattgtcttaaatgacttgacttaaatgagaacacaaaactttaatacttttagaaaaaaaaatgtaggagaatatctttatgacttcaggataaagacgagtttcttaagtaagaaattaagaatgttagccttaaagaaaagactgatgcattcataggactgtcgtttatcaaagaataccagagagtgaaaaagacagagatatagtaggaaaagatatttgtaaaaatgtaacaaatagaggttcccaagtgaatgaagaactccaatgagtcagtaagaaaaataaaaatcctttatataactgggtaaatgatatgaactggcattttcagaatgattaaatgtgaatggcccataaatatatgaaaaaccaactttattaatcatcaaagagatacaaattagaaatcatgaattatcatttcagacaccagattgacataaactaaaatagtaagtattgttgaggaacaacaggaattctcatttagggagaaaagattgaaaattgtcccagccattttagaaaacagattgtgtaaatatcttgtgaacttataaatctaaacttgtattttccactcttaaatatacaggctgtagaccaaagaaactcttgaaaatatgtgtaagacacaggctttttatatcagtttagtttataatagcaagtaagtgggaaaagaactattgatggacagtggaaagaatatattaactatattaactgtggtaaattctttttttttttttttgtttgagacagagcctcgctctgtcgcccaggctggagtgcagtggcgtgatcttggctcactgcaacatccgcctcctgggttcaagcaattctcctgcctcagcctctagagaagctgggattactggtgcctgccaccacgcctggctaattttttgtatttttcagtagagacgagtttcaccatgttggccaggttggtctcgaactcctgacctcaggtgatccacctgccttggcctcccaaagtactgggattacaggtgagagccaccaagcccggcagtaattcttatgaagaaccgttaccacacaattaaaatgaatgaaccacagctacacccattgagactgagtctcaaaggaatcatgttgagtaaaaatagcaagtgttagaggaatgcatagtacaattccatttttatgaagtagaaattaatttcaaggctgaacaatacattatttagggatatatatatatatatgtctgcacacacacacacacacacacacacacacacacgtatgataaaaaccataaagaaaaaacacatgacaaacaaaataatcagcagtgggggtatagtcagggaggaatacacagaagcttcaacattactggcaatgcttcatttgttacagtgggtgttaggatcacaggtgtgcactttagtattcttgtaactctgcataaacattatttgttttctttgtttgcctaatatgtcacacaataaaaaatttaaaatgaggaaaaaccatcaggttatctggagcaagacagcctgggttagtattctggcattatcgtttactaacaatgtgtacttgagcaaattattttgctgttcagcaatcagtttccttatctataaaaaggaatataaaattacccactttagggattgttcagaggattcgattttatgtattgttaatatgtgaaaaacacttaggataatgcctagcacataggaagaactcaataaatcttagctctaaatactactattcaacctacaagtggctgaattagctaacatacaactaagcaaggaaggtgtgagcattgctcttctatcacttgaggaccaggatacctcatctgagatctggaatatcttcactagctcacccaaccacacccacatattttgagcactttttttttgagacaaggtctctctgtgttacccaggctggttgcaaactcctgggctcaagcaatcttcctgcctcagcctccaaagtagctggaattataggcacacaacaccatgcccggctattttagggacactgaaaagtgtctttatcggccaggcgtggtggctcacgcctgtaatcccaacactttgggaggctgaggcgggcggatcacctgaggtcaggagttcaagaccagcctggccaacaaggtgaaatcccatctctactaaaaatacaaaaaaatttgccgggcatggtggcaggagcttgtaatcccagctacttgggaggctgaggcacgagaatcgcttgaacctgggaggcggaggttgcagtgagccgagaccgcaccatcgcactccagcctgtgcaacaagaacaaaactctgtcttaaaaaaaaaaagtatcagttgctgcactgtgtagcatcctgatcactgttgcttcatctacaatcttttaagaagcctgtggcaattcaagtgccacatgagctttgtagctgtaaagtttcttgtgatagaagagcaattggagttgtgctagaattcagttgctgaaaactgcactaggaaagttgcaaggcaaagacaaacccaaagaaatcagaatagaaaatgatctcaggagcaatgttgtgacgatggaaagatgacaggccagtgctctgacatggaaaatgagaatgtagctggatattagcttggctcatatttttgaaacccagagcatgagtagtctcaatattgatagcctgggtttgagtaactctcttaaactcacttgatgccaaagctctcatgagaatccagttgtgccttgtggtgaggtgaggctgtaccttggcactgtctgtgcacactgacctgcattgaaaacaatgggggcagtgagcagggccgaggtggagattgagaggaaccaggtcgtggatgccaaagggggagaaattggccaggtttttatcccggaagctaaactgaaaactcaagtcccttgatcctcattgttctgggtccacagtctgtgcagatggaatgttgattgggtgatcaccgccagcaaaaagtacagactgttttttctactctcataacactttttgttttgttttgtttttgtttttgtttttctgagacagagtctcgctctgtcgcccaggctggagtgcagtggtgagatgtcggctcactgcaagctccatctcccgggttcacgccattctcctgcctcagcctcccgagtagctgggactacaggtgcccaccagcaggcctggctaattttttgtattttcagagagacgggggtctcaccttgttagccaggatggtgtcgatctcctgacctcgggatccgcctgcctcggcctcccaaagtgctgggattacaggcgtgagccaccgcgcccagcctctcatagcactttcttatactctacagcatttactctaaacacttttacagcaatgctctacatactttctttacaccttacagtagagccactgatgtgcgtatcatatctggattgtaaacgtcttgagatcagggaccatgttggattcatcttcacattcctcacaacatcttccacacatggcaccacaagtaatattgacgaagggagggctgtcaggccgcacaaaggatggtaaggtcttcctaactgaaatcctctggcttcctaggatttcagaggcagaaaacagtaactatccatcgctgacacagatgatcaccatgctagtttgttcattgtcttctcttatcaaatcagtgtggatttcatatgtctcctcagttgtttctcccacttcttcagcagcttagaagttttgttttgctggggagctgtttttaacttttagatataaggtgaaaatgcttatttattagtttcctcaggtgttacatgaactaagatgacttccacatcagttataaataagaaagtaccaaactaaatcaggactgctgtgtcacttggcactacttcacgtccttcttggcagcctcgatgggggacgagagctgagttggcaaaggggggagtgatttatcctcccacacttagaagtaggatggaaagcagaaaggttctacttttatattacttcttcttttcaaattttcatattaacatcccctatccggtttctctagcttatttttctgtagtgggcatcaacgacactatgtgtgatttgtttattttatttgtcatctcttacccacattaagctctttgagaagagagatttttgctttgttttgttttgtcagtgatatatccccagtgtctaaaacagtggctggcatcatgataggtgccgatagtaggcatactgtaggtactgaatgaatcttcgttggttcttaactaccacaaagtgcacttaagagcaaggggcatgagcaatggcatttctaagaactgacaggtttaacacacggcagccttatctctgattcttctttgtgaaaatgagaacagggaaacagcacccattgcaaaatctaaatcgatgatgaatgaacacgtagcttgcgtgtatatttgacgatggttttattttcaaaactgtaattaaatgagataaaaatatatggttgaagttgccgaagcaacttaaattcaacataaataacagctgctcctcatctgggaatttcatttatatacagaacttttttttttttgcccttaaaaatttttaactggtatacagctaattcagcatccagtatcccaagatacactttatactcaaagaagatggaaaagagaagagaaacagccctcgttgagccagtgatgaaacaaagctgttactccccatacctttgatttccctaaaatagctatgatgcaaagcatgtccagtttcttaggagcaatgagtctaagcatgactggcattttttaatgagtccagcaatccctactttaatagttcaaaatcctgaaactgagtacagagtgaagagtcttctattagctttgaaagcaaaatttttctgcagagcatggatgccaggaagtactgataacatctgcctctccttgtaaagtaaggatcagtgcagtttcctcccaagcttcttggaggaaaaaaatacctactctttggatagaattaagagaaggtataattacttgaacatcgatctagtttcatttgcgagtaggaagtgagaaactgcgcctctttcctgagacatcgtatccactaccactaagtgctaggcaaatttggtagtgagttcactgcctcggtttatattcctgaaaggctaataaaagaaaagaaattgaatgaaaaagtttgagatgaagagatttctttcactttgaagcagggtttttcatgaccaattgtatggctcgtagatttgtagtctctggggtttgatcatgaactgtggtccttatgtctccatttagtaatatgtttccaaggcttttctgtagattactgactttatcatggcctcttgatgcataacttttcagcattttcttcagagaatattcattctggtgttacttgaatgtatctgatttgccttctaaggtgcctatttattaagaagattggtacaatgaattacaacctgctaattttaattttcattggggagaaaaaaaggctataaagtaaaattcaaaatgaagaatcatatttctttctgtcaaagctataatgagcataagtctatcagttataaaattatcacactagatgaagaaaagataattgtatgatatatcactgactggctgataacagccctaatcacaaataataggcccatgcaatttgcaaggagttgtttcatgttttcatcatctctggcattccctggggcaggggtgagtgggcgagtgggtgggagagtatttattttgcaaagcaataactccagttcatatgttgattacattccaattttaatttatctcttagctttccacttaaggatggggatgcgggaaagtaggtggctccatgcccttgattggacaccttttcttgaagttattctccaaagcttccctggctattgagcatacaaaggtcctttgtagccaagatgctggaaagcagtgtgtcatgaggacaaatacaagaaagttcaccctagtccaacaggtctcaccaaccaccacagcctgtgaaacaggaagaacagcagtgctcaacaagtactaattaagtatctactatgtatcagacactgttttgggcattggctatagcctcataaaaactggcaagattcctgccccacagtgagcttttatttggggaggcaatggagacagtaaaaaagaaagtacacaaatgagaaccgtagttgcagatggcggcggtggtgatttctgggaaggatgtagtaaagaggggatgtgacagagagtaactggagtcaggtcacggttgactttacttaagccctcaggtaatgctgctctgaagaagggtcatttgagttggttcctaaaggctaaacatgataagccaaagaatggggaaagagcactccaaacaaggggaacagcaaggacatgggtcctgagactgggttagctgcaaggtgtttgaagaacagaaagcaaaatgtggccattacggtataactaagtaaggagggaagtggcagggagcaaagctggggacgtaggcaggggctggatcctgaagggcctttgcagagcacagtgaagggtccatattttattctgaaattgaccaggccaaatgccttctgaaacctttgtttctctttgtgttgtgtaagtatgaaaccaaagataaagaatgcagctgcctaaccattaacactcctgagtcaggatgatatgagaaaagagatgagctcccgtagagaaaaatgctggtaataatagcttgcatgttagggcacccgtctccgaaggagaacaacattattaacggtgccatatctcactaattgtagtaacctcatgagttagataggtgtacttttttgtggaacacacagggaaactcagacattttaaattaagttgttctttggcctcttaaatagcacaaaggtctagataaaatagagtatgtcaaagaaatgaggaaaaggaaagaactaaaatgagaaataaaaatagccatcaggaacgctgtaagctcccagagaaaagggcagccaagcaacgtttattttctgtaaagtcaagaaaataatagttgaggggtgaaaaactgtgagagtctcagacagtcaaacagaccatcaaaaagtatggtttcatccctgttatttaatttgatatagaatagaagttatatatagggacttctgggtcgggaaaatccggattctaatctaagctcttggatgtttatttttctttctattaaatgagaatagtaatagaacccacctcaaagagtcgtggtgaagaccgaatgaataaatacatagaaattgagaaattgtgtcatttagctaagctggatggaactggccttagcattcttccaaatagataatatttataaagtggttaaattgccaaagttaagaagccttcttaacatgtaatattgattatgctatttttaattcttgcctaggttttgttcctggaaacaaagagtgatatgtgatctagtaatgtggtgcaagaagagaaagaggagaataacctccaattttgctaaatagaggattgctgaccctaggcaaatttgtctttggcagtctccacacaccactttcctcatccagttttttaagtcattatccttcttgaactttctcagcgctattttgccttctccactatttcatagattaaattttcctttgattcttctttggttattcaaaactcacatttgaagactccatactgctcttacttacttgttaagtgaaagcaacctgattgaattaattcactcttcactgaaagtgattaatagcaaggtcatacttttgaagaaggtatttatggtttaaaatgatatttttgtaattccaaagtaatatctaaattgtaaggttttatttggtatgaccgaagagggtgacaaaaaactcaggcagttggagagagaacactgtgagggctggaatcagcacctgggacagctctgaataagctttcccttttactctgaaataagtgtattaaggatttccatagtgatgttcatggctgcagaattagaggctctgaaaaaaaaaagaaaaaaaaaaagatcagaagtcatttctgtgaatgagtcatttgtatctcaagggtacattgacttaggaatattagacctagcataagattttggtcccggccaggtgcggtggctcacacctgtaatcccagcactttgggaggccgaggcaggcgtatcacttgaagtcaggagttcgagaccagcctggccaatgtgggaaacctgtctctactaaaaatacaaaaattagctgggcatggtggcaggtgcctgtaatctcagctactctggaggctgaggcaggagaatcacttaaacccaagaggcagaggttgcagtgagctgagatcacaccactgcactccagcctgggcgatagagcaagactcagtgtcaaaaaaaaaaaaaaagttttggtcctttactttatttttattttattatttatttatttatttatttatttgaggcagagtctcgctctgtcgcccaggctagagtgcagtggcctgatctcagctcactgcaagctccacctcctgggttcacgccattctcctgcctcagcgtcccgagtagctgggactacatatgtgcccgacctcctagtcccttactttcgactgccaacaaactggggtaattaatgtcaggtttttgtttttgtttttagacggagtcttgctctgtcacccaggctgtagtgcagtggcgcgatctcggctcactgcaacctccgcctcccaggttcaagcaattctcctgcctctcagcctccagagcagctgggactacagcacatgtcaccatacccagctaatttttgtatttttagtagagacagggtttccccgtgttggccaggctggtctcgaactcctgacctcaagcaatctgcctgccttggcctcccaaagtgcggcgattacaggcatgagccactgtgcccagccaaaaatcacatatatttacatcctttaaaaaaggtaaggccgttatcctcagcaaattgacagaaaacgaaataccacatgtcctcacttacaagtcggagctaagatgagaacacgtggacacataaaggggaacaccacacactggggcctgttagagagtggagggcgggaggagggagaggatcaggaaaaatagctaatgggtactaggcttaatacctgggtgatgaaataatctgtacaacaaacccccatgacacaagtttacctgtaacaaacctgcacatgtacccctaaacttaaaagttttaaaaaggtagacaaatatcaattttactgttgtatagaaacaatatttttaagtaacacaagcattctcagaccagaagattataggaagaatttctcatgaagaattatctgaatccagggtatagtgcgtatatcttaaatataagtgttataaagaatacagttcatgcaatataaaggataagatatctgattcacttcagcatcaatcttgacttgaaagcataattaggactagcagaagaggatatattttaagtcttatcaggtttgttttttttgttttgttttgtttttttgtttttttgccacagtagtgttgacttggccactctaatgttactttatccggtggaagttctcccagtgagtcactttctgtaaactttcctttggatgctcaaaagtcatactgatagtgctaacatttatagactactgactttggaccaggcagcatcttaagtgctttacatgcatgatcttaatcttcagaaagtcctatgagacaggaattattgtcctgacattagaagtgagaattgaagttcaaggagattaactaactcacctacatcatacaggtagaaagtaagagtgctaagtttgtactcaggtccttctgactccaaaaccagggtgttaaaccatcaggcagttcttcctcttgctatatactctcttacagggaagtccagtcttccttcttcctaaatggaaagaatgtcaaaaatacgactttgaaactcaggttttgtaaatttcgatttattttcactacaagtctcttcaatccaggaaaccataaagtgtgcatccacacacacacacagggagcaaatggcagagagtcaagacataactttaaatttgctgcatgatagtgagtttttaaagttactctccaaaaatacttctttttataaatggtgcagtcatcattatggagatcatattcataacaaatgtatcacttgaccatttttccaagttgatgttcatctccttactgattgcgtcttttaaaaggaagcaataacaaagggaactggtgctgacaatttcttgttctaaggccaacctgggagaattaatagaatccaggtctacccaagtcaggaaaaaagtgaattggtatttttttacttgcattaaataatacatgtattacatgcatggttactgtatcatttttcctttttttcttttctcccttctctctgtggattcttaacaaactatgatgtgtgatattatctcattaacctttcctggccattttaaaactaaactttttataccttcctctgagtcatcccaccctgtgaatagcttcagctcttcctgtccatatgtgtaatggctagtccattaattatgacctaaataaattactctttcttatttactgttattacttctcaaaagagatcttggaccctcttgattttatatcctctagactataatcaggtatttatggtaagatacttcttccccagctctaaatatttaaaaatttcccagacaaaaaatacgtggacattttccccttgctctctaatttactccatggcctgaattccaaatgttttcctatattaagactttttattattgatagcatattgcagctttaaggcttttgtacacgtccactcctccaggaatgtaactgctaaatcacttcctctctggtctcaatgaggtaacacattccaaatactatagcatgttttctaatctcattttaaaatgaaattcaggtattacattccataggagaataaaggacagctgttttcacaaatatgatatgaaaacacatctgccacacaattgtacaatccttagcacatggctgttggaaaaagttatgtaaaatgctgacaaatgaaatcaacaccaaaaagtagaggtatttattttttaaaaatctacacatcacatgtcaatgaaccacatataaagcttgaaagacaggctattttgagaaacaatggtgcacggatgttaattccttgttttacatacacattatttattcaatactatctttggtgaccaattgctaaacggaatacaagccaagtgtaattgtttagctaccttcctaacaaggcagcaatcctgcttcttaatagagttgtttctgtttattttctccttgttcaacttcacactttgcacctaacatttacaatctccatgttgagtgcccaaccacaaagaaaagcagaggaatagaagatttgaaaccaaagtacttataccaacccatcacactatgtgttgaaatgtggatttctttccatattcactgagtgtaaatgttatttaaatgaacgtttttgtgtcctggcatggcaagtaactgatttgaaagctctttttcactgactttacgaaatcagtgaagatgccacagattatggtgcttcagagcagtaactttggagagagacaaaacatgagtttgtatcttctggccacttcctaggcacgtgaagaaggtgctgcacctccgtgagcttcagctgtgtcacctataaattgggagtttaaagtgtaatggaattcaatgagatcaaataagaaaagtacttggccacatggtatgactgcaatatagtctgcaagtcaattctattgttgctattagtgtgatggccacagtgacagagcattatccataatgtatattccgtctcataatgcctgctgctactgatcattacccaagtaccaaggctttggagataaaatgactctggatcctcatctctcaccttatacaaaaagcaactgaaaatggattaaggacttaaacctaagacctgaaactataaacattctagtagatgacattggaaaacccttctggacattggcttaggcaaggatttcatgaccaagagaacccaaaagcaaatgcaataaaagcaaagataaatagctgggacctaattaaactaaagagcttttgcatggcaaaaggaacagtcagcagagtgaacggacaacccacagagtggaagaaactcttcgtcatctatacatctgacaaaggactaatatccagactctacaacgaactcaaacaaatcaataagaaaaaaatcaaacagtcccatcaaaaaagtggactaaggacatgaatagacagttctcaaaagaggatatgcaaatagccaaaaaacataggaaaaatgctcaacatcactaatgatcagggaaatgcatatcaaaaccacaatgtgataccgccttacacctgcaagaatggccataatcaaaaaacagtagatgttggtgtagatgcagtaaacagggaacacttctacaccactggtgggaatgcaaactagtacagccactatggaaaacagtgtggatattccttaaagaactaaaagtagaactaccatttgatccagcaatctcactactgagtatctacccagaggaaaagaagtcattgtttaaaaaagatacttgcacatgcatgtttatagtggcacaattcacaatagcaaaatcgtggaaccaacacaagtgcccatcaatcaataagtggctaaagaaactatggcatatatatatatatatatgatggaatactatgtagccataaaaaggatgaataaacagcatttgcagtgacgtggatgagattggagactattattctaagtgaagtaactcaggaatggaaaaccaaatatcgtatgttctcactgatatgtgggagctaagctatgaggacgcaaaggcataaaaatgatacaatgaggccggatacagtggctcacacctgtaatcccggcactttgggaggccaaggcaggcagatcatgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccaggaggcagagcttgcaatgagccgagatcgtggcactgcactccagcctgggcgacagagcgagactccatctcaaaaaaaataaaaaaaataaataaataaaataaataaaaaaagaatgatacgatggactttggggacttagggggaagagtgggaagtggggcaagggataaaagactacaaatatagtgcagtgtatactgcttgggtgatgggtgcaccaaaatctcacaaatgaccactaaagaacttactcatggctggacacggtgactcatgcctgtaattccagcacttttggaggctgaggcgggtggatcatgaagtcaagagatcgagactatcctggccaacatggtgaaaccccgtctctactaaaaatacaaaaattagctgggcgtggtggtgcatgcctgtagtcccagctactcaggaggctgaggcaggagaatcacttgaacctgggaggtggagcttgcagtgagccgtgatcacaccactgcactccagtctggcaacagagtgagactctgtctccaaaaaaaaaaaaaaaaaaaaaagaacttacccatgtaaccaaataccacctgtatcccaataactgaaggaaaaaaatttaataaataaataaaaatatatgtggaaacattgctggtaaaggcttaatcatgagtgtacaaactttgacataatacccatttacacacatagctcttgacttagaaaagtatcatgttgttaactgttaggatctggatagatattcatacctgaaaagaacaatttgaggcatgtaatctttccctaaacatgtgcataagtatcatgtcctttgattcacatctacagcttgctctagtgtgcgtttgctattagaaacctttccttagttgcaatgtttgggatatgctttggcactaaatcacagcattcgcaatggacagaagaaacataatgactacatacttgaaacaaagaacattcattctcgttacatttatgagaaaattaagacctgcccatggtatgtagacctgcccatggtcaacacagctaataagtggcagagatggttttcaaactcagatctacccaaatacagtctttccatttgctgtataggtagggtttatcatctggaatctatttcaattaatgactaataaacgtttctgattattttctcaaataccagattaatgagatacacttcaaatgcctaaaacttgtagaagtgaatgaattcataaactaagaaggaaaaaacatgaatacagttttttaaagctcaggaaggatagttaaaaatcattgcccatatttctcattttctttctcatttcttaatactatttctctaatcagaaaccatgattggttttacctagatgatacgtgatctctactacctatcagctcttaatttttcatgcaactctggaaattgaatgggatatctgtgcacaaatgtagatgacttactctaagaacctatatgcagaagtgacaattcagactgattcagtgttatttttagggataatggtttaaaatattaactccataacacagtttttaaaatcctggtttaattccttttgaaggaatctcagaccatttccataaagacaagaaaaataccatgttctaccctcacctggtgtccattgaataaaaagaagtttattacatcagaaatgtaattcaaatcatagcactgatttgttttgtgcagagtatgtgtgtgtccttcatgttcacttttcacagcccaaacctggcagtctttggtttgctctgattaggtgttatgtgtcagacctgcctgcttgagccccaacaggacggaagctgtgttctcacaatgcttgccttctgagttggcaaaatcagatggtacttaatggagtttttatgaatatataagtgatgaagacaataatgtacaaacttaaaatgtccctaattccagaagaatctggtaattaagacatgtctatatgtaactttttaaatatccttagcactccttgaaactaagcctgagtgtagaaacattccaatttgtaactgcagccttcccaattgttgttaggagtacatgagataatcatcataaaatacttaccaaaatggccagcatggaggaaatcatccacaaatgttactctgctctagtgtgcacagccagatggtttgcaaccctgcacaacatacttgaattggaagtccccgaatccaataaaatgttattaaatcaaatgtaatagacaacaaaaaacgaaatggcacttaacacactccttattgagaggatttacatctgggagggtggaagaaaaaaacgtttcttgaacaataatatgtctcactttattagacatatttcttatattaactcatttgtatttgtaactgcctatttacttatactgtgatctttgggtttataaatgtcttatctctctaaccagacttgacctttttgaggtaataaaacattcttctaaaaagaaccatgaacagtaccttctaaatatttcaaactacaccacaagaactttaaaacaattgtgtgtctgtatatatgtctatttatacattttatatagagttgtgtttgtatataaagagagacagtcacactctgggtatatatggagagacaagtataattatatatgatagaatggtttgtgaagtgaacagaattgtatcagaaaacaagagtttgcattctgataatgatatttaaatacagagaggtcttgggcaggtcacttaacatctttaaacctcagtttcttcacctagacctgcactatccaatgtgatgtcctggcatgatggaagtcttctgtgtctgtgctggccaaggtgataatcactaagtgcatgtggctactgagcacttgaaatgtgactagtgtctgaggaactgaattataaattgtatttaattttaattattttaaatctaaataggcacgtgtggtaagtagatattttagtggacagtataaccataaaatcaaggaggatgggacaatgtcatatgaaaagaagctctcctgaattcccccggtatgggtgctaccaacgcagttttgagcagaatgattctcttttgaaatagtggtactctcccttgatatcttaggactttaaagtttaaatgctttttcccatatttctcccaacagatcttgacaactttaaaacaagaacaagaagcactgtgtctgtccgtcgaggtcaaggaatggtgctactgtgtggcccgccaccccattctggaggtacatataaatgaactgacatatgcatgcttcactctctgttatttttcttcctcaatgttctccctcctgacaccagctgagtgcacagtgtcatttatagagattcccaaagcccctccatgtggaggaaaaaccacggtgaatgcctcccatcattaggacaggaaaataccagattgtgcaaattttccaccccactgcagtgtacctggcacaagaagaaagacacctgagtcgatcaaaatcataatgctgttgcttggtaaagcagtgtaattaaaacgactcatacttcttacaacttgattgggttaaaaaagatggccctacttcatttcatctcctggttggtctgggaactgtctgtgaactgtgtctactcgcaatacttctgacaccaaatgtatgggttttttccacactaacaaccaagtctccaatcttctggacaccaactggctgtccaacgattcaattccattttgacagtaactaccccattaactactctgggatggttagtgtcagaactcataggataaaggctcagtcccacaaggctgcctccacttcagatgccactttcaagtccttgacctcacacacttctgactaactggctataaagtgggactcccataactccctccttggcttccataatttgctagaatggttcccagaactcagggaaaacagtttacttacataccagtttattataaaagatattataaaggatacgtatgaacagcccgataaacatatagagagagtgaggtctgaagggttgtgaatgcaggagtttctagacttgtggatcctccccacatgtagatgcattcattaaccctgaagctctccaaacgctgtcatttagggtttttatgcaggttccgttgtgtaggcatgattgatcgaatctatggccattgtaattgatggccattttccagcccttctcccatccccaagagtggggaatggggaggctgaaagttccaaccctttaattatttggttggttcctctgacaaccaatcaaggggcctcaccaagagtcacctaattagcataaactcaagtatggttgaaaagggcctatttatgaataacaaaagacattcttctcagcaatatcactcaggaaattacaagggttttgggatgcagaccaaatatatatatttcttattaatcacagtatcacaggatcagaccaagaacaaaagttccttgaccatagaatctacgatcactttgtggagactcatagcaactagatcagttaggaatgcacttgactgcaactaactgaaaacccagctcataatgttcttttatattctttttctcacatgcaacattttctctttcttttttttttttttttttgagacagagtctcgctttgtcacccaatctggagtgtggtggtgcaatctcggctcactgcaacctctgcctcccaggttcaatcgattctcatgcctcagccttccgagtagctgggattacaggcacccaccaccgtgccaatttttatatttttagtagagataggatttcaccatgttgaccaggctggtctcaaactcctgacctcaagtgatccacccaccttggcctcccaaagtgctgggattacaggcatgagtcactgcacctggctggcatgcaagattttcaaagatatacaatctaaagctagcacagcttctagaggatgtcttccaggactcatgcccttctctgattcttctctgaagtgcttagcatgtggtatggatgaggcatgaagtctgcattccaaaccagatcaaatgggaagaagcaaagacaaaaggcaatgatttgtttttgcttgtttttgtccatttcaatttacctttattatcgtaagttttctttgcctgaggactttgcctccatgtcattgatcacctcagtggcaaaggaggttgaaaaatcaaatattttacgcagatgtgttatgccctggaaaatatcataattttactagtaagggagaacatggagagatgtgtaggcaacttgcagtgtcggctaaaaggaactacgatgactaaaaggcaaatataactgcacataagggattcagtagtgtggaggtttaataagtagtaatatttattaggattccactaaggtctgtaatgacaagattgataaactctacccttggaaatccaggctgaagtttagttcaatatctgctattcttgttattgccttaattttcagtttgactttccacatgtttaaaagaacaaacttttagatttggaatttgaaaaacactgttttatttttgtcctctgttcaaaagttgtaatgttttctttctcatctaattctgagctaacatttccagcagaaaataacaattagtaaaggtgctaaaaggcatgtacttcaagcatcctgaatacgaaggagaggtgggagaggtaggttcccctctatgtctggatcagggacaaggaattgttaggatttctggtttttgaagactgacagaaaatctaggtttgatttcagaggtctgtgtttggaaaatgggattattcttcaggatttcattttcctttcaagttagtatcagaagcactgaatttggactctgggatatgagttttgatccttgttctgtttcaaatcattatttgatactgggaaaatatcttcaaattctttatgcctcactctgcctgtctataaaatgaagagattaaaagaagtctctcaaatccctattgattctatcaacacataattataactcgataagggctaaacatcttgtttatcaagtgtgtttgcattattgaaggcctgtcctttatatgagaaaaccacttcactgtggacatatatttagattcaggtgaagttcacttagactaacacttctctttttaatatggaatctgatcaaaataaaaatggaagattttactaatttcttctgcaggctaccttcattgcattaagttttcatcacatggcagcaaccctaaaaattaatcttgtaggtatattaagaaaaacaccaccactgtccgatataatgatctctttaggaaaggcaaaacacatggagtgatgctgtgctgctacgcaatgaagtacctgactactttccctttcccacagagaaatagattaaaaatttccatagacatctactgaaatgcagttgtctctgctggcagcagtcagcagctctgaaatccagttccttgagctgtgctgacattcctgacaatcttgatggtgaaagacaaggaaataaatattcttattataagctctattagaaatggcgtgcacattaacgctgtgggcaaagcaggcacggctaagaaatttttgagaaaagaacaaagaagatattcaaggttataaaagagcatctcagacatccatcagttttggacaagggaaacaatgattatctgatgaaatccttccaatttctcaaaagcctccaatgcaactgaacggcagtgattctctcactgtttttccgggctgtgtgtcaccctaaagcgagaagaatcactgtgagctgctggacatactgagcattttagacccagcatatggtctcctggtttccattgtaacagatcatgcagaggaagggaaatgagtcagccttttattatatcagtggggtactgagtaatggcatgaaatccattgtaagggatgctgcatgtcctatttcgaaagctgtgcggtgtcagaccttcttagggtagcagagaaatgagcagcaattaatctgttttgaaaagcatttcagtcagcaggtatttccagcactctaccaatcactatgtgtggcctctttgtcatctcttggtttatatgtatgaattcagatgtgatggttttgcatagatttttaccattaaatataagaaaacaccaaaaaatagaaatcactttgatggactctggctatccttggtgctccttcctattagacacagaaattattgaggtccagaatgtccactttgctttctgccaactccagggtcactgggcaccaggaattcatgacctttaaccaagctctcgttaaataggaatagaacagaggaactttgagattcttccttccaatatacgaaaatttctagtttattcctcaataaaatcctcacaaactgttcatcaagagaggtttttgttcatgccttcattttatgtcaccaagatgcttgcgactcaaagggtggtccaagcaccagcagcattggcctcacctggaaatttgataaaaaggtaaaatctcagaccccactacagcctactgaattggaacttgcattttaataagatctccgagtgatcatatgcactttgaagtgtgagatgccctgagtcatagctgtggttcccacgcacaccccacctctgggcagtgagggttgacagcttgagaatctggagggaaaattgttaaaaccataggtgtccaacctgttcacaagcatattccgattccataaatctgggctagggtccccaaggctgttaaaaaaaaaaaaaaaacaggccaggcgcggtgactcacacctgtaatcccagcactttgggaggaggccgaggcaggtggatcacttgaggtcaggagttagagatcagcctggccaacatagagaaaccccgtctctgctaaaaatacaaaaattagtctgctggtgtgcgcctataatcccagcaacttgggaggctgagacaggagaattgcttgaactcaggaggtggaggttgcggtgagtggagatcgcgccactgcactccagcctgggcgacagagcgagactctggctcaaaaaaaacaaaaacaaaaacaaaaacaaaactgtagctgactcgctcactctgaggcagcaccagatttaaggtccattcacacggatcatctacagaactagcccaggtccagccctgctgagatggagtgcttcgatttccacatcactcaagccgaagggctgagcattccttatgtgaaatttttatttaaaataattcatctatttacttattttttgaaatggagtctcactctgtcaaccaggctggagtgcaatggcacaatctcggctcactgcaacctccgcctcctgggttcaagctgattctcccacctcagcctcccaagtagctgggattacaggagtgcaccaccacacctggctaatttttgtatttttagtagagatgaggtttcaccatgttggccaggctgatctcaaactcccgacctcaagtgatctgcctaccttggcctcccaaagtgctgggattacaggcgtgagccactgcactggccaattgaaaataattcaaaataaaatgtagttaccttaggctttagctttgactttatatgtttttgttcataaaggaaatgaaaaactaagaaaagggtggcttttcctaggtactcatactcagaagtagcattctggtcaggtgcagtgcctcttgcctataattctagcattttgtgaggccaaggtaggaggatcacttgagcccaggagttggagatccacctggcaacacagtgaggccgtctctaaaaaataatttattttattttattttatttgggacagagtctcgctctgtcgcccaggctagagtgcagtggcgtgatctcagctcactgcaacctccgcctcccagttcaaacattctcccacctcagcctaccgagtatctgggactacaggcacatgccaccatgcccagctaatttttgtatttttagtagagacagggttttgccatgttgaccaggctggtctcaaactcctgacctcaggatccacccgcttcagcctcccaaagtgctgggattacaggtgtgagccatcgcacccagcctaaaaaaatgtttaaaaattagccaagtgtggtggtgtgtgcctctagtcccagctatttgagaggatgaggtgggaggattccttgagcctagcagttcaaggctgcagtgagctatgatcacaccactgctctccagactgggcaacagagtgagatcctgtcttaaaagcaaacaaacagacaaaacccagaagtagcattttctattcagccagctttcctacattgttattggtgaatgtatggcttcccagagtatatttaaaaaagaaaaccacctgattctgattctgcgattattttcattattacgggttttggagaaactagctaaaattttcatctttagatttttcttttacacagaacacatccccactagagttggatcctatccacagggcatcagacccagggaccttcgaacacgaacatctgtagagtcctttatagtgtttatagtgctttaatttatattatattatctttgaatcctcacaataatcccataagaagtaaggacatgtgtttcatagataaggaaatagaagcaaagagattatggagggcacactctaatcaatggcaggaataagagttactgttgcctagaatgcgcccttttatttgtatatagcagaaaaactggaaacatgtactgtactttctgtgtcagtggttctttggcgctcaccccaggtcaattaaatctgagtttcttgatggcaggggatcctctggcatcatccaggtaattttaatatgcagccagggtggaaaacttgagtccctgcattacaaaatcaagtaggacttatcccagcaaaacgtctctatatgcaaacctctccagggttccataaatgtaattttacgtggacatacccatacagattataaccacagcccttaaaagaagcaagcatgcctttccacagcatggttatttcagctggaccatgctgtatttactgtaggacagagataaaagcgtgaaagtaggacatctgtgttctagtcctagctctcccatcaacttgctatgtggtcttgggccaattatgtaacttctctgagccctatttcttcatatgacttctgtttctgtcttcccacacctactcagctttcgttattaagatatcaccttcagagttagactcacccagtttcttacttagtccaaactatgctgacaggtcactgagccaggacgaatcttactgtgctaaaagtgagcagcctctatgcccagaataatcttcaagatgtccacattcaagtcaagttgccaactctgcctaactccacattcaataccttattctcatcttcttccccaaactggttcctgggtttaccagttttatataattttagattttcagctgcctccttagtccagacacttagcttagctgttgtcctcatttcttacccaaaggcgcatgaaatcccattttaaccccactctaaacctccaaccataacatggtattctttgcattctaagtattgcttaagtctaggaagtctagttactgggccccacgcatcatatcagacctccttggctattgacatttgcctggctgggtcctaggtttgtcaactgtgctttggacgactggtcactttcctcaggaagcagtccctgtacttccagcttactccctctactttctctcattacctttttcaggctccctctccttacccatatctgggttcctagcatcactttcaagtcctcaaacaccactataatgccaaccaaattgaattcatctttgttctgtaaacttttcaaatctgttatgaggatgaaaagacataacaaatgtggcagcaatttgcacagttaaaacttccagacactcctgattttattaattaggctgggtttgattgttttcatttgcttaagcttgaagtcaaagttaaatcagagaatttctcatctttggagatatgtgattcttgatttacattcatgtaacaacttttatgtaggcagatacttttcggatatatctcccaagagatttatatggaatttacatctattattaacataaattggttatgctctggcattgtggctttattagccattcttctaacatttgaaaattgctattaaagactttacagttaaggtaaactctaccaatagtcttctcataagccaaaccctgtgtgattctttatatttgcattttctatttagcgtgtacagtatgtgcccggacttcatttccttagaaaaacaaggcactaggtagacttaggcggatgcaggactttaaaaatactgctgaaataatgctgagaatatttttaatagactgaagaatgttgtcttaaacatatttttatatggcagcttaaaaaaagcaaaatgtgagatttttaaatggttacaaaattaacaatcacttaattgtcataaaaagctataagaatagtgctgtaagtattgatcaccttttctggtcatattgggaacatgattgaaggtacatatgggaacaaggaagggcccagcatttcacttgagtcatctcattctctctctctctctctctctgtgtgtgtttgtgtatgtgtgtgtgtgtgcgtgtgtgtataatgagagaagtgcccaaatataatcctagttttaaaaacacacataacaaatgatagctaatggttttaggtcctgagtctttgtttcttggccaccactgagagagctgcattttgataccaatttcatgtcacctgagaagcgacttccctgagagatgccttatcacctgcaagtaaattaaaagccacaggtgtccagtaggttaacactgaccgtcttggaaatcagtgattcagaaaaggtcctgtaataaggcaaaatgtaggatctcgtcatctggtcttggaacttacaaaatgatgtttaaaatgttggttgggagtggcattgaaatactgctactatgccattttccaagaatgttgaggtcagccaaacttggtttaaaccaccttttataatataatttctatgaaacatgcattctgatttccatttcccaacagaggaactttatatattcacttaagtagatatctatctcaattcagaggggaaagcttaacatttagttagtgataggttaatcaacatcatagactactagataccttttttaaaaaaatcaggaattaaatattcttctgtttgtttttcttgtgacaggatctcactctatcacctagtctggagtgcagtggcacgatcatgggtcattgcagcctgaaaccgggctcaagcaatcctcccacctcagcctcttgagtagctagtactgcaggcatgagccaccacaccaggctaattattttattttttgttagagatggggtcttgttttgttacccaagttggtctcaaactcctggcctcaagcgatcttcctacctcagcctcccaaagtgctgggagtacaggcatgagccaccgtgcccatccaggaattaaatattcttaaggcgatcttgtctgttgcctcttgactgtgttcctttgaaagatatgaacttggactcctttatttgaaatgtaatcagccagttcctcccttttttctcttccccgtttgccaatcagagggggttacagcgcattagttgatttaatcagcatagaataatgtaaaacagtttataaggtgatgcctttctgcattcattaagcctcctgtttcacccattgaacagaaaaagagagccacattgatcagggactacttgtgataaactatctgacccacatggcctgggtggagtgtttcgtgtttaggaggataggccactgggagggagtgcttgccctcactacaccaaaggcaggctccacttctctcatccatgagatcatttagctcaaagaaagaatcagcaaaagaagcaaaagggaggaattggggcctggcatgtctacaggagtgacttgcttctcctctaccagatatgacaagaagaagtgaggtggatatttctgatttcagttatctctgaaattggtgaagtatattctgtgatgctactgacatactttttgcctttgaattttcctgtcaactctttttaaaacaacttgaatgtttcatgactatacttttgaatgcctagatgtcaacaactatacacttatgagtagaaaaaaataagttgatataagtaacgaacgtttcctggtcatagaaaaattatagtctttttatagctgagcttccagtttcttaaagtaaccttgtagagaattggtggtctggttttttaagaagagttccctaggagtagtagctacatactttctactttaattctttttttagttctagtaagagagatgcttaagctgtttttacagctatagcaagttcctggccatagcacttagaaatagactcagctacttaataaataccagttaattaaatatcttattgttcagaaaaaaaataataatttggctaaaaaatagcagaaataaatttcaggaaattctttttctgtctccttttttcctcacttgcttttgtgcaaacgtttctatgtgctttattgggcagaaaccaagaacttaatgatgcccctaattacccagcttctctcctgacagttagtttgtgtgtactttaatgataggcactatgtaactgtatttgtggatacacagatttcaattcaagttgagtacatctctattttctttttaaacatccaaaaaaaattaaaaagattatctccaggtttgatccttagaactggaggccactgatgtcagagtaagggccaaacacattagtaccgaaaggaaataatgtttggaaaatgagaatggatccataaggctaaatgatctacaaactgtgatcatttgacaaagctggaccacatgcagagctttttcttttggagttgtcctgtcccagaaagcagtgaaggatgacattgtgttagaacataggttgggacatgaagagtctggagatgtgaaaaacacattacacatccaggagagtgctaccagggatgtactagccagaagagaacaaatgatcaacactgagctttcaacaacatgaatctggctgagcgtttcataaataatccagtggacattcactacaggatagacgggcaccattcttgttttaatgcctgctggaaatataccctgtgaatctcattttttcagctgaaaaaggaatgagtggtgctttggctacatttttagcaatgaataggtattctctcaggtcagtgcattaagcaggatgttacatggaattaagcaggataatgatgcagtacatagaataaggaaatgctgactgagtcctggaaatttggaaatagactctggttaggagctcagaaatcgaaggctcagaaatggatatttaccactctcagggattttgaacctaggagtcttaggcacaaataagaagttgttaatttttctgatatattttttaacatgttcagtttggttttcagacattaggaacaaaataactggaaaaagccaaattgaagaccagagaaaactatacatttaggcaagtgaagttcagtttcacacacaaaggaataaatcatggcattttgtatgagggtaggattaaagcttttgattctatgtaatatcaaaatactgatttaagaggaagtgatttactggagtatctgtatattaatcaatgacaaacaatatggataaaaaacttttcaaatcaatcaaactgattgcagttctccatatccactaatgattttgacatttgcagatatatagaataaatacaaagttccaaatgaagcataatagttttacagagagaccaactctgtctgcattatgaactcaaagaaatgtttaatgtttaattcagagactgagagaatgttcgtgatatctgaagtaggtggtgctgctaacaaaacaatgggcagccactttgtaccgagccaagagagctcttcccatctccagccgaaacacaccctctttttctcccatcatctggtgcaggttaacacattatcacaatcttcactgtcacaattaacccctggaaaggagttgtgtcataaaaacactccataggacttcacaaatccatatggcaggcacagctgggaagacagttgcagttgataacgtagcatttcagaaatatccaaagaatctctactttgtgaagtagtgtggaatttacacatcctctcattccctcaaatcagcacatacactagggaacacctgggaaatgccaagatgcttcagttttaggtgtttgaagcccagttcttatcatttcacgcaaaccagagtatgctttttgaaaagatgaaaggacttttaaaaacaaaaggtggctgatttaaggattatgtttcttccttctccacttactgcaaactgaggtagctatgacagctctctaacattagtacccaaatatgagaaagacattcatgtaccttcttctcttgctaccctgagaatttgttcactgtctctgcaagccagcactccttctaaatgtacaactccagtttacttcaatggacacagttgtgatgaatgaaatttatgattggattctaatggattatgtaaattaggatttcaaggttaaaggaatagatttcttttaaaaagtaaaaataggagattttggcagaacctttcagataccaggccttgtcatagacagggcagatataggagtgggccaaaacaaaatgttttctcctgccatgtagcctacaggtctgctagggaggagcggggtaatgaaatcatcatactgagatgtgtgctcttggttgtgaggtgggggtgagggaaaggaaaacagggttcagtgaccatgtaaaatagaaggacatcatgtggattggggagtcagagaaggcttccttgaagaagtagttctgtggcttagatctgaaggacaagagagtagaaggaaaggaggagtattatagacagaacagctgtatgtaagtctggagtggagaggttgtcaaaagaagccaacatggcacatgagtatggacatggggaagggtgtttcagtttactgtgaaagtggtgactgaagcaatagaaagctccatttttgttcctcaaaatcttatgaaatcaatgatagccagacaccagtaagttggaaacagaaaatgttatcaaattgcctcaaatttaagttttaaaaattgagattctgggagccccgtgcagtcaatttatagaaatggtgggatgcacccattcttagctggtgaaaccaaggctgggatagaattacaaccgatgtgttaaagtcatagagttaaataaaaaataaaatatctacactatgtaaatgaataataaaataagaaatctacactatcatgatgacttgagaaaatacttagtgataaaaaaaaattacttggtgatcgagaaggaggggaaatgtcagacattgcctaaggatgcaaagcaaaacaaaatagaatgaaaatgctttggaaggaacgccttaagaaaatataagaaaatgaatggatgcatctccactgtgcttttggtcaagtacaagaaaacatggattctatgaaacaaagatgccaatgttaaaagagagttgccgccaatgcagattgaggtttgaagggagctggcaatgatgagaaatggaaatattaaaatctgcaatgcagactcagtaaaaagccaaataaacattgtagcaaattgaattagtgataagcatggctaactaggtaagtttttataaagaacataaaatgaaagtataataatcagaaagcttcataaatataaaaattaggtagtaaagttccaacccatatgtaatcaatgtaattggtaaagacaggtcatcagtgtgtatgtattgttttattgtttaatatcatcacatacttaccattccatgtgagttcatcatccttttaatagtaaaaacatattgtactttctcatgtttgagcggaagaaaaaaaattatggtattttttattttaataattaaagaagaaaggatgtttactgggagctgccacaaaaacacttggtgttttatacatggtgttacacacagttccagagatatattcaaaggatttggaaaatttttaaaaaataattccaatgacataactttacttgggttcagcatatgacctgtactcctagtagctcatatattctgttatgtttgtgtatgacacataaatttgttaaatataaacaactgggctgggcgaggtggctcacacctataatcccaacacttggggaggccaaggcaggcggatcacttgaggtcaggaaatcgagaccatcctggctaacacggtgaaaccccgtcttactaaaaagaaaaatacaaaaatttagctgggcatggtggcgggcacctgtagtcccagctactcgggaggctgaggcaggagaatcacttgatcacgggaggcagaggttgcagtaagccgagatcgccactgctctccagcctgggcaacagagcaagacttcgtctcaaaaaaagataaataaaaaataataattaaaaacatatcacaatttttgttaaaaaaataaagaaagcatagatgtaagaaataaaaatgggatatgtaccatctaagttgctagagacaataaaatcaaagaagttgtggccaggcatagtggctcacgcctgtaatcccagcactttgggaggccgaggtgggcagatcacttgaggtcaggagtttcagaccagcctggccaacatggtgaaaccccatctctactaaagatttaaaaagttagctgggcgtggtggtgcatgtttgtaatcccagctacttgggaggcttgaggcaggagaattgcttgaacccagcaggcgaagtttgcagtgagccaagatcatgccactgtactccagcctgggcaacactgcgagactccatctcaaaaaacaaacaaactacagcaacaacaaagaagctgtaatctatttaaccagagactcaaaataaagatgagcaaaaaagcatacatgaagtatagaaatatgacagatatgagtgtgtgtagcttatgaaatataaagaaatgcaacttattttaaatataagagcctcagattgagttaaaaatatgatctaaacaaaatgcaatgatacaaaatacctagactaccaacaaaacagattttaaaaagaaaaataaatgagggcagaattattagttttagaccaagcattattcaaatacaaaagcattaaattagataaaggcaaccttttttttttttttttttttttttgagactgagtctctctctgtcgcccaggctggagtgcagtggggcgatctcggctcactgccagctccgcctcccgggttcacaccattctcctgcttcagccttcccagtagctgggactacaggcgcccgccaccacgcccggctcatttttttgtatttttagtagaggcggggtttcaccgtgttagccaggatggtctcgatctcctgatctcgcgatccgcccgcctcagcctcccaaagtgctgggattacaggcatgagccacctcgcccggcagataaaggcaatttttattattaaaatacacaaaccacaatgaagacattccatttacattattttaaacaccatgaaacatagagtcatagtatataaagctaaaagtttgggaatacaaggagaaattactaatgcatatttgttacttaacttgataggtcaagtcaataaaaataagcatataaagaatttgaataatgtaataatgattggcctttcttaatgtaaacatacatacttatgtattttctctttaagcacttccataaatcctatttcaattgtttacatgttcagccaaaaaaaatttaaacaaaattgaaattatataggccaggccttattttccgccataatgcaattaaataagaaattagttataggtcaattttatacaacaccacaaattttttaaaaaccgtcccatgcaaatttcaaatcacatttctgatacctactgggtcaaagaaaagataaaacccatattaatatatttttcaaaagtgaaaaaaatgagaacaaacatatctacacttgtacaatttatgaaaagtataccctgaaacaaattaataaccttaaatttgttgtataaggaatcctggaaatcaaaatcagtaccttaagtattcacctcatgcaattcaaaggaacatagcacaaacctaggggaaatggaaagaaagaagataaaactcaaaattagtgaattagaaaacagtatatagagagacatccaagaggagctttgagatatgagatattctctccaaatctaatcaagaacaaactagagaaatacaaataggcaaaatgataagttaaaaagagcatataattttctataaaatatttaaaatcatttaaaaaactacagacaactctatgatcatttaaacatccggatgaaatgaattatctattaagaatatataaataacaaaattgaaccaagaaaatgtagaagatatgaacataccaattattatggaaggaattgaaagttgtcaagatttactctctccaagttctctggtctatacattttataaagaaaatattttaaagttttaatgtaattctcttgccaaataatttgtggcacagcaaagacaagatgaaaagctaccagtttattttatggaatgagaataatcctggcactagaacttgacaaagacagcaaaaagggaatgcctctctcttatttatgaatgttggtaacgcttacatagtgggtaatacatgtaggcactattttaaaagttttacatatattaactcatttaacccttacaaaaacctgatttaggtgttatgtattcccattttatggatgagaaaaatacctgagacattaagtaaatatggcattactcaacaattcatgaaaaaacactttaggacatgtatataaaatgagatagaagttttaaaagtacaggtaactcaaaataagccaaaataagtatttgctcaaaatataccatattacagattaaaaatacaaaaacaaaattaaaaaataaaaacataatgaagagtaaaaagatacttctggggtggggggctgggggagggatagcattaggagaaatacgtaatgtagatgatgggttgatgggtgcagcaaaccatcatggcacatatatatctatgtaacaaacctgcatgttctgcacatgtatctcaaaacttaaagtataataataaaaaagatacttctataatctgcttaatgacagccaatattatatttaacagaggacgtaaagacaaacaagaatgaaacaaggtttataattattgggtgatgatacatgaaggttcattataccatgatttctacttttgttatttgtaatatgttagaaaatatatgtaacaaaaatgttaaaagaatggtttctatggttgaatttagtgatttctaaggtggcttccagctcagctcttacatggttctctgttgttaattacctctttttccaaaaaaagcattttttgtactagcctttcggggaggaagatgtttgcattatgtggaggagtttccaccatacatggacacattggtctcctgcaaaccacgtagttcttttattgcttcttttttcatttgaaaatcattccagatactgaagttaaaatagctgtccttgctttcctgcctggagagatgggtatcactaaaaatgcctggattggcagtaatccgctttgctcctgcctggagctgttctgaatctccagtggcaggccctcacggtgttactggggcaagtgtgcagtgacgtgcatttcatctgcacacagcaacggtcagactacttggctttctgcagggaatgaaaaaatacacatataaccacccccgttcccaaatggcactgtagcctagttaagaaaattgcttgagggggagtgcattatgctaagagggctagttcattttcaggttacaaaactttaaattcaagttgacacagcttctattttcatttccatacttatctcaactggggaaatgtggtgtttgtcactaaaaaccagccagtaaaatgtagagggaagatggagagtcagtggtccgcagcctgcaagtggctgtgatctgaaatatgtcatgctttagttggtagcagataccataccaaatttgcttcccactggtagactttctccttttattttcaacaaagtcccatgtacccagcagcaatctttaacagcaaaaatgcaattaatataagtcatctcatcatgtactagcattccagatagctcataaacaattaagaatcgagtctgaattaaatgcagaggttcagggctaagtgtgttacaggaagacagagaatgctgttctgtcagttttgtgaccatgagcagtttcattcaagaaaccacatggaaggtgttccactgttaagtaccacatgtgacctctctggtttgaatatctaagtagatccataaagcttaaagtacataagctttcgtgcggctatactgaaatgtaaagaatgcgaatgaaggcacccattaaaagataaaactgggtaagactaaaattaatcctccataatcctagctttagaaactctcatctttactgtatacaggtatctttaatgtgagttattgagtaagtccaagggctcttctggtcaccctttcacatatagtctaccacattcctattccaatagaagctgggaagcattccaggataaattaattgtagaatcaatttgcttttatagagcatggatgagagaaatattgaagttttaagagtttctgttgccagacttatagaatatatttgccattcagaccctatggtttgtaaaaaaaaaaaaaaaaaaaaaattaagcattttgggtgttgaccctgggttgtgtaatttatgcatggctctggtaagctgttacctcttaatcacccaggagccccagctcttgaagcagactaatgattccctgctgactatctgctctgcttgcagttctgccttcaacacatctgtcagcaccacttcccaaggggactgtatgaaagttgcaaagtctgacatccgtacattaactactctatgactttctccattaataatggactgtcccgccgtaagctgtgagtttcctccccaacaccgaccgcttttgcttttatgtgccactaggcctgtcatcagagagacagccagagaaaagacatctggcatctgtaactcatagggggttcatgaaaactaaagcaggtagattattatctcaaatgaagttcctggaaatactgaatgatgaatgtcgtactaatggcctccttcctctagcttggtgacagcctgtaaccagttacaaaaaaaaatcttgacatacaccttcaatttttatttaagagatatagtcctaattgttatgtcaaaaccttggaaatagaggccaattattttgaaaacgttattttttccaaatctacaaaggaattgccatatgatataatagctaaaggtgttttcaagatccattttccaattaattgctttaaaaaagaattctctgaagtaaatcacaagtgcctttaagattctggctggattgtttgttaatataccttagatgcagataaaaagcgggggcaggaaagagaaaattggaagcccactgggtcagaatggcaagttttttgcttttaccaaaaaaaaaaaaagacagtgggaatcacaacagaaagaggtcggatgctgttggtgatttttgtacctctgaagcttctaaatatagaggggtttattgcttctcttgataggttccttgtcaagttactgtagaaataacttacttaccccacctggaatttagaacagggcttttaaattttcaaggactgcactgcagttgaattgaagtgaaccagatgtaagataataggggttgggaagaccctgaggaagtaaagagtacacatctcatcaataaggggcagggcattgttggttacagtgcacccaagggagtgctcttagggtcaactagacaatcaaactgacttgatttccatgggttacacttgacatctcattcacttacagaccgagcacagtgtatgcccgcagagcagtactaggccttggtcttcaatgggaatccctggaacagtccgaatagcaatctagggacttttttaaaattttttttctctattcccaagtgttatttcaagagcaaagaagttaaacttgtgtagctaagtgtagagtctcctgatttagaaggtctatgtcttaaataggagccaagatctctggtgacgttcctataggcacagcttccaaaatccccaggtcaagcctcctcattatgagtcaccacactcagggaagcccaacccaataacttctcaacagatgtgttcatttgcagtccttccagccagattcagcttaccaatccggggtcattcttataacaacatagcctgcttatgtggctgacatttcaccttaccaggtttccagggtaacaaagccagaaagttaacccaagataaagttctccatagagagagagaattttaacccgttacccactgttgtcatatgggagtataaactcagatcttttcttttcctttgttcctgcttgcccttctcctcctctttctcctcctcctccaccttcttccttcttttagaaaagctggggccggcgcggtggctcacgcctgtcatcccagcactttgggaggccgaggcgggcggatcacgaggtcaggagatcgagaccatcctggctaacacggtgaaaccccgtctctactaaaaatacaaaaattagccgggcgcggtgatgggcgcctgtagtcccagctactcgggaggctgaggcgggagaatggcgggaacccgggaggcggagcttgcagtgagccaagatcacaccactgcactccagcctgggcgacagagcgacactccgtctccaaaaaataaaaaataaaaataaaaaaataaaagctggacgactagatttttaaaaaatgtttagtctcccaatttttaagcgagactactggagtaagaatactggaccagagaacagaagacctgggttctattaatagtagtctagcaatttgctgtgtgacctccctgtgttaagtgaaaggcttgcataaggtcacctgaaaagctatttctgtgatactgttaatcttttctaattgctaaagaggtgatgcttcctgtttctctgctcattgccagggtacttgtttctcttccatcagcttttctccttctctattctgcattatcatatgaaatcaaagagtgaggaaaaaagtcaaggatcttcaaaatcatacatgactgataccaatctcatcattggactagatttctcagtgaagataatctgagggttaatgctaactctcatagaatttaagtcaaaatatctgtctttgtttgcattgcccaaagaagttggatcaaaagagttacagctgggtggattttaacttttaacccagtttttcagatgtgttaatatatagtgcaaagtttccaatgtagttagagttactacaaccctaactgaaattgcctcatactgtgacattattatatcctacaatcactcatatatctttatttttccaactctaccatcacaactgagaaaaggtaatgtggtacatttacaaataaaagaggattaggattattttcattttaatattcccactataattatctacagatttatgaagaccgagtcaagggttccatttgtagccatcaataaagagattaatttattattcccaatcgggctccaaccctcaaactatatttggccattggcttcgggatttggttatttcctcaaccctttgtgaagaaatcttttaattttttgtgggtcagaggctctttgttatatggtagaagtatagtccgtaaggaatagaaaggacgaggttgaaagtagctgtgccttgaagttattaaaaatatgtttcactcatgataacatgatcattttcaggaattttattcttcctcccttgaccacaaatattaaacgtttcaccagggaaatggctggtaagagatttagtcctaggagtaggatctaatcttttatatcacagtaagaagctgatcaaaggtgttgaaagctgactgttaaaggattaattaggtcacattgaaatatatgattttaaaacagattgaaaccagaaataaataaataaatgaagctagctgcccccatttttttcaagaacatgttattgaagagaaaatattgagccttcatcaccatttaaaatattcttaatgagcattgttgaagccattttaaggagtgtgttcttcaacataagggcaacggaaagccatgagctcttcttctaggaattgagcttatatatcactctttctttaaagagtgcaggtaatgggttgcagcagaacagggctgtgtgaagagaaccttgaaacagatgctgcaataatccaagtaagagatattggtgtctttatcttgggcagtagctgtggtggtggattctttgtgtttcccactcaacccaaacacaaaatcttccagggctccaatctaagatcaaccccatcctcttggtcactggattgcattccctctcacccactcaagaacttcactctagctatcgttttactcctctctcctgcattagatacattttctttccctgctacatcactcctacctgcatcggaacaatgtggcaacatctcctgctttaaactagtaagaaactcccactgctcaatttctatgctcctcttacggcaaaactgcaccaaagagtcatctctacatcttctctttcacggactcttaccctcagtccattgggacttttccccagaattgcacaaaagtagctctcttcagtgatgtccacaatactaaagctgatgataaattcttagttctcacagtatttgacctatcagcagcattcaatacagctgctctctctaaacttctcaaatacttgcttcttgtggcttttgggctataactctcttggtaccccctttaaatccctggatttccattttctttttttttccatttttttcttttctggcttctcatttccctgtcatctactcatattcttaaagtaaagtataagtgtcctcaggctcaagacccaggcctttatctctctgtatacttgctctctagtgatttcatccagtccaatggcttcaaatgccatctttatactgatattttataaatacctactgtcagcccctctccctcctaaatacttgacttacatatccatttcctgctcatcttctcacgtggttgtccagtaggcatctcaaaggtaatatgactaaacctgagcatttgatcttcttcctaaatcttattctcctatagttttcccagtcacaggaaagggcacttccattcatccagtggctcaagactgaaatttgggtgatagtctttatttatttatttatttccatgccaccattcaatctgtttgcaaatcctgaccactgtgccttcaaaacataccctgtatcaaaccaactctccctaccttcaaccattgcaaccccagtccaaactcccatcgtaagtggcttgatcacaagagcttcctaactggtgtccctccttctattcctgtttctccagccttttgttacataaaagccagggtgatagatagagtttgaattatttgtccctgcccaaatctcatgtttaattgtaaccccccaatgttggaggtggggcctggtgggaggtgattggatcatgggagtggatccttcacggctcagtgccgtcctcacaacagtgagttctcgtgaaatctgattgtttaaaagtatgtggcacctaccccccatctcttgctcctgcttttcaccatgtgaagtgcccgctcctgcttcaccttccaccttagtaaaagcttcctgaggcctccccagaagcggataccagcactgtgtttcctgtacagtttgcagaaccatgagccaattaagctaattttcttataaattactcagtctcaggtatttcttcatagcaatacaggaaaggcctaatacagtgactcttttaagtgtaagtcgttcacatttctccctggccaaaagccctccaaaggctttacttctcactcagaaaaaaatccaaacctctcaccttggccagaagcccccataaactggcccctggccatctgtccgtcattatgtccccacaacccccatccttctgttccatatactgtttctcaaagacatgaaacacgtccctcctagcaatggggcctttgtgagtgttgctcccatgccttgaatgtgagtcccccagatacctcgtggcttgcaaccttctttcatttcaaatctctgctcatttccaccccttcccgatatttttcaaatagtactcaccatccttctccatcgctttcactgctttgttcttaatcgcatgtagtactgtgtgacataatactcctttttgagaattatatttattgcagatttgcagaatttcacggttgtactttaaagcattttatgttaaggtcaccatagatatattgtgcagtagaactcagaagtagaatgaatatgtaatataagtctcaaggcttgcagtaggctgctttggggtttgccttctgacccttcagaagtgtgtgttcactcagctgttccggtaaggacgcctcgatggaaaagtttaaaatgtactggttcatatggactgggcaattacccatattatgtaattgagggacacctacagaaacgatctctttccccttatctatctgtattggtctgccatcatacctgcaaaattccaccattactctctcttaatggaatcaactacaattagaagtcaaccaacaatgcctgtataggaagcatatgtagagacttttagttaaaattatatggtctaatcagcaagagtctatttaagggacaataaagcagaatatggcttattttaaagcattatagaggctctctcaacccaccaccctttaactgactttctggataaacagtctcttcattccttccgtaatgcataatgactgttgcctgtggcaagctgaaggttcatggctggtaggctacgctcaggtgaatttggagcactctgttcctaggtgttgagttggacactgccaaggatgagttgtttttattcccaaaccagtttatgccagtttcacttacaattataaactttaaatattatataaactaatgaaataaaaattcaaaaggcaagagttgtcatttccgcaaaaactaggtgcaatcctttggaaaagactcaagaaaaacaagccaataaaaaaattaaaggttctacggacaattatacaagtttatttttaaataaaagacaattataattcatactctagtataattctgtactcagatcttgtcacaactcttttgtaaggaaaccaaaactgtaaatgagagttgtcaatgcatgatgaacgtagcttatgtgaaaataacaaccctagtccactgtcaactttaaaaataaataaaaggtaagagttacattgttcttacatgaaaatattgacaaataataaatttaattgcctaaaaataaattactttattagtaaataaagataagttatatataaatatataaactatatgttatgataaatttcataaaatgtttatgacatacatatggcattactttatggtttcccacttctagcaacttttaaaattaccaactaattctaggtcccaaaagtgtaggacaagcgggtttttcacatggtttgaaaacagttttcaagagtagagattgcagtttcattacagacatgttgagaacagcaaaggaggtaaaatactcagatcaatcctggaagtaaagtaaaatcagcatgcccattctacatatgaggctaacagagagtcagtgacgtggagttgagctgttttcagagaactaagatttgccttcttcaaggttcatgctgttagctttgatgctacaataccttttcaaacctcttctcctatacatctcatttagatctttcataacttggctttttcaaaatagatgtcaactaaaggcagctgagctaatcaggtattttaattaatggcatctgaattattatgacagtgtgatcatagagatgccatttttgtcttcagtaatcaacccttcttccttaagaaggtgtgggagcaggtccttgattaaatagatctgggaaatgctgaatattggattctcctcttggagattttacaatgctaataagatttggagaaatcctgtagtaaagaaatctgcccagcattttcaacccagttgatatgatttggctgtattcccagccaaatctcatcttgaattgtagttcccataatccccacatgttgtgggagaaacctggtaggaggtaattaaatcataggggcagttactctcatgctgttctcatgatagtgagtgaattctcatgagatctgatggttttataaggggctttccccttccttcgctttcattgtccttcctgccaccatgtgaagaaggacatgtttacttcccctaccaccatgattgtaagtttcctgaggcatccccagccatgcaggatggtgagtcaattaaacctctttcctttataaattacccagtctcaggtatgtctttattagcagcatgagaagagattaaaacactggttatttcccaaacatatttgtccacatgattttatcatgtatgcctctttatgttggactaaaccagtattcagtggcacacatttaaaaatattgctattctcaagtaaatttggactcctctgttcatagctgttgagttgtacactgccaagaataactgatttttattcccaaaccagtttatgccagttttacttagagattattactagggaggccgaggcaggccgatcacctgaggttgggagttcgagaccaccctgaccaacatggggaaaccccatctctactaaaaatacaaaattagctgggtgtggtggtgcatgcctataatcccagctactcaggaaggctgaggcaggagaatcgcttgaactcaagaggtggaggctgcagccgagatcgcaccactgtactccagcctggggaacaagagtgaaactcggtctcaaataaataaataaataaataagtattatataaatgaatgcctttcatatgtccattcctgttcttatatattctcagcttgttgaccacagttccctgggctgaattttgtgagtgcacccttactttgttcagctttttgtcattatcaggagagaaaaggcaaatgttgcaaaaaaaaaaaagatagacttggcagttttttctaatagctaaactgtgaccttggcacccatccccttagaggtcagtaagaggcccttgtaatcatccacaagcagagagtcagctaaagactgagatcaccccttgctcatcagatcctggttaagaagctcatgaagaggaaaaaaaagttcagactccttccacaagctaaataagtgcctctagggtcaggcatcatcaaagagggtcaactaatcaatgttcaccaagcaatttgtgatctgaagtgttgcaagaatgctaaaattatatgtatcttgtcctttacaactgaagatggcacatcaggaggtgatagctctgtgttttgatgctggctgtgactttgtgccagaccttagccccggccctgctgcaggcacacgtccttctttacaggataaccaggcaatttgtggtttactgcctgctgtgtgtgtcctgtgcaaactcacagtgtgctgacacatgactgcctagtaaatatcaggggaatattgaatgctcgtgctcagagcttttattgggaaacactttccctcatcccaccctttgctcctctcctgaatgtccaccaccatgcatcagaacagatcatttatagagatactcttagggaatgccagtctgtgccagtctgcctgtcttccctgcccacatgctcttaccggggccgacttgacacccaaaacaactcagagagttgaagtgatttgcccaagaccacacagctaacaactggcaaatgtggtattgtatctaaaatactagcacagggttgggcacagtggctgacacctgtaatcccaacacttcgggaggctgaggcaggaggactgcctgaacccaggagcctggtcaacatagcaagacctcgtctctactaagaataaaaaaaatattagctgggcatagtggcatacacctgtagtccccagctactcaggagggtcacttgagcccaggaatttgaggtttcaatgagctatgatcatgccactgcagtccagcctgggcaacagagtgagaccctgtctcaaaaaaaaaataaaatgttagcataggcttttaaatcatgtgtttttcacttacagtgaggctgagtagaaatctggggaagaattaaagcagagattccagggatatgttagggcagagcaggactcatggaaggacaagggggttggttttgttttcaatagaattgagaaggtagagtttgaaaacacatttccagaagtccccgtgttggttcccactggatgcttgttaagattatgtaatactcttcagtgctatgtctgttgtttaagtgttctgttcattgggattcttttggttgcaagtgccaaaatccaattcaaatgagcttaaataaacacgggaattttttggcataaaagtcctattaactacaactagattttagttcccaaatgatagtgttaggatctctctatcatctcttgaatttgcttttcacaagctgcctctcactgcaaggtaactcagcgggaaggagaaaatgcttcatttccagtaattttagcaaaagcttcaaaattggcctttatatgctaacttgagtcatatgcccactcttaaaccaattatggtgagtggaggatatgagggtggtgctggatagaaaatgctgattgggcagccagacgacataggtctattcctggagccagaacggagattagcctcactcgtatagcatctactaagagtcggggagaaatgattcctgattttaaaaaagattagaatgaggttaccaagtcaggagaagctaggcacccaaaacaaatgatgtctacttgtcatcttattgtaaagtagggttgcaccccaggatcccatcccgaagagttatttctagatgtgagaggtgtataccatgtacaacaagatccactgtcctggaaacatgagcaggattcaagaaacttgattctcctaaaactgtatctctgctgaatatatcccactatgtccctagtgccaagaagaatgcctgaacctaataggcccacatgaagcatttgttgaatgagtaatttaaaaccaggcagaagggatacagagtttcagtttgggattatgaaaaagttctagacatgaataatggtgatagttgcacaacattgggaatggatgtagtggcactgaactgtgcacttacaaatgattaaaatggtaaacttttatatgtattttgccacactaattttttttaaagaagaaggggaaaaccttaggcattaaggaaaacaagattttggtgacttctggatttttgctttccatttaagcttgccttagtgagtcattggacctcaacggctaggcagtcactgatgggagcagaaagaagtacttatccagcacttctccactgaagttgagcccaaacattggctgttccctactttacagaagaagatcaagggatacaataaggttgggattgatggacgtcaggaggatttgctttaggaatgcacgtgatatatgaaaagggttcagccagaattcacaaactctgttgtctcctatggccagccaggcaggtaagaatgtaaatgaatcagataatgtgagtcaggtggagatccacagccttcctttaaacaggccagtcactgctcatctcagaccagttattgccttgaagaaatacaggttcagtagtgcctggtctcatggtttttcatgagaagccgtatgtgtggaatcttatatgaaatgtttccattttggaaaatgttagcaatcacttttttttcttttttttttctgagacggagtcttgctctgtggcccagactggagtgcagtggtgcaatctcagctcactgcaagctccacctcccgagttcaagtgattctcctgcctcagcctcccgaatagctgggattacaggcacgccccaccacacccagctaatctttgtatttttagtagagaccaggtttcaccatgttggccaggctggtctcaaactcctgacctcatcatccacccacctgagtctcccaaagtgcagggattacaggcgtgagcctccgcgcctggccagcaatcactttttaaatgttctacagtagcatggtaaacagaacacagctattttccagatctttccacttacttccagtttctttccaaggatagactcttcactttttaagaaatgacagtaatgatctcatgtatttgtttatttatttttacgtttttcagtttaaggtgacacaaatggttaggacagataccatcaccccaattttactcttgaagccactgagactttacatggagggacttcagcttgcacccagatcatgcgaaaccatgttctgtgccatgtgagactttaagaggttgctttcaaaactcccccgcaggtttccttatttatcatttatctagatgaattcttcctcccttacattggagaaaacagagtttctcaatttcccatgactctctttgttagtcagatgggagagaaaagtcattacctatgcgaacctgtagaaatagatttgtgtatttttcagtaataaataaaataaccagggaatttaaatcatataatattttccatcttgccagagatggatttttttttcccctggggaaacttttaacttaagaatgtgtttcaatctccttgatgtgttggaataatcattaatgtttacagttgctgtagcaactagaaatgctggcaattgagtaggaagggagcctgagagaggaagataagctgtatcaattattgaacatctgtcaaacagttagccaatttaaagtgacagacaaaaagctagaaatcgaaggtgggtacaatgtatttgttaagttaacaacatcagttatgtattgttttgccactattacagagggataattaacacttatttgcatccacataaagggagcattttctatggcgaatatacagttgcaagtgtaaatttttatgtcataatcatcttaatccatctctcgtggatgttagtttgcagtttcaatatctatttgacagacttttgcattttttaagagcacagaagtgaaacactatgcctctgatcatatgcctctccaggcactctcctctccttatcctaaaaccactactcatttatgcagaagcagtggcctaaatattggccacacgtgtctccagtactctgtcttactctgatggcagttatcatagatcaattaaaactcctttttcctctgagtctctggcattctcaaaaccctaacacagcacctggatagccaatgccagttaggaaggactctgtagtggagtctatttgcaatccctgtctgttaatgatttctcaccttcgcttggcgttttattgtttacaaagtgttcttacttgcatagtctcatttggtcatcaaacctctaaggtgggggttgttatcccttctttacatgtgagaaaactgaggcttagaaagattaagtgatttggccaagatcacagagttagacagaagatacctacttacctactgccttttccactgcactgtaaaagaaaagatcatcaggtaaaaatccagggtgatgggtttcagtactgccctaatcacttactaactaaaaagaagaagaaaaaataataaaacaagaaagtatttaatccttctttagatagttctctctgcttctaataaaggagaactgaacagattttttcctaggatgctttcagctataatctgtaatacatgaactctaagtaaaatctagttgctaagtttctcaattacagcatttgtttattaccaggccacaccctacctcgtggctgcactcccagtttcttcccagatctcagttttttgaaagtgagagagcatattaattttataatttttgctacttctatttgttagcataataagcatgctaacactgtatacatgatcacaagatttaattttctggcctggctttgtttaatgttaagttttaatgagtcaccttttctctcttcctcattttcttttctggaaagcaggattattagctccaagagatgagtcaaatgaagtaacataaatggaaataactttaggaaaataaaatactgtctatgataagatattagggtagctttattccttataaattctgacctgatctgataatattaagtagatgatgatttagaatgggtcttcagaataaatttaaaggaacatgtaagtcatcaaatgattctattcaccatctttgccttatcaacaataataataataaacattaacatttattgagtgctaccatgtgctcgacactgtgctgattataagtagcaatttggctacagtattgcacgtgatcccccaaccctcctatggtgtgttattattatctccatttttcagatgagaaaattgagtcttagatatgttaagtaactttccatgctcacaaagtagtggtaaaccaaggtttcaagaccatgtacgtctaaccccaagttctagagtagatacttgaccggttataaataatacttcacacacccaaggtaaagatatttattttaaaatagaacaaagcatggtcttgcctagatgtcccataaagagctgtaatcatcagatgcccacttttttcctttaatttttcttgaagctgacttttttcttgcaagtctttgtgttattgtcttcaaagaattacaagagtcattgggaagaatccaccatttctaagaaccagtttttacgcagaactattttaagtggtaccagatggataggaaattagtatacaactatttttcaagtggggcttaggaacaatggtaagaaggggccattagtaaatggaggaaggtaaaataagtctctaaggagaaaaagaaatgacaagggtttatattatattaagaaatttttcagatactttttatcacaggggacggaaaaaaaaaaagaacagtgtccactagggagttttttataaaatgaatttattgtttttgttttgttttgttttgtttttgagacggagtctcactctgtcgcccaggctggagtgcagtggtgcgatctcggctcactgcaagctccgcctcccgggttcaagcgattctcctgcctcagcctcccaagtagctgaggctacaggtgcccacgaccacgcccagctcatttttgaatttttagtagagatggagtttcaccacattggccaggctggtcttgaactcctgaccttgtgatctgcccacctcagcctcccaaagtgctaggattgcagccatgagctactgtgtctggcctaatttattgattttttttcaaagcatattacctgaatagaatatttcttctgagtagattttcttgaggaattcaaccaccacatgtactcacttctctgcctgtcagttctgagtcctagtttcttctcccagaccagcttgtcaaaaatacattagacatgagcatggacactttgcgctcgctctctgttttggcgtcttgaaaccagaggaaaaaagacctgtttgttcagtttgaattttaaaaatctctgattggctgatttaagtcatgtgatcctcactgaaccaatcactgtgtcctgaggtatgattggtctcctgtgactcactcccatctctatgctggccttgggggaatgatgactgccgttccccaaaaaccaattgacgaagcattgctaagaagatgaaaagtgcctttctggcaaacctggtaataaagccaaactcatagatgattaatctttcatctagtcctcttcactgcacctcaaggcagaaccggaccattgcagccagtgatggtcttttttgtttttaaaggtccaaataaaagaacaaaatacctttattttgaaaaggatagttccattctttacagaccaacagaccgaatgcttttgttattggtttcacaggagcattagcaagacgcagggaagcggggaaaagcatcttgggccataatgaaaactggcattttatttttctttcttcttctttttttttttttttttttttgagacagagttttgctcttgttgcccaggctggagtgcagtggcacaatctcggctcattgcaaacttcacctccccggttcaagagattttcctgcctcagcctcccaattagttgggattacaggcgcctgccaccacgcctggctaatttttgtatttttggtagagacggggtttctccatgttggccgggctggtctcgatctcctgacctcaagtgatccgcctgcctctgcctcccaaagtgctggcattacaagcatgagccaccctgcccggctgaaaattggtattttcttagcacatttgattaagggttaatttgtgctcgtgatttaaatgtcagttgtctgaattttagatcacaagtttaatcaaggagaatgtggaattgtttaataatttggtgaaaaggttgtgtgttgttaacttgtgtgggagttgattatattacttgaaagcttgctcagtcagtcatattactgcttgaagccttaaagaaagtaaataattagagttaaactgacattttccaccattcaacatttttttcattattcctgagaatccattttagttcccatattgaatcctcttttttctttcttcacagaaattgcttagcttaaagtaagaagacagattttgattatgctgtgagaaaaagcaaaatttctattaattatgatttgtccagtcaaaattttcctacgaaatatatttaagtgctgatggtacgagtgacccgtacaatactgatatttcaggatttaactggtcacctagttccctgaaattctcagtactcctgaatgttgctatggggttaaatactgtggcatacaaaagaaaacaaggttgtcctgatccctaccacagtccccctcaaccacaggcctggcacatcagtcagggtaatcactgctggactgccatgtcattggcttagttaagctggaggtttcagttgcagtggctcctggcataggaaaagaaatctttgtcatggtctcaagagatgtctgttttaatcccaaatctaattccactgatagtctttgtggtcttggaatagcttatgtaattttctatatctcactttccctgtctctccaatggaactaatccttattctacttatttctaaaaattgtcagaggcaccaaatgagataatggatataaaagtgttttgaaaatgtaaagaagtaggaaagttgtggttctgctgatggagatggaggcttacttagtaaggtgaacaaaagtatctggctcactggatccagtttaactttccttgtgcatagagatgtcttattcagtccaggtgttcctgtcacctttgagtaactgtgatctgacctgtgtccaggtcacacgggtgtcatctggtaactctagttttcatcaacatatgtcatttagcgtaagtcacatcaggtggactaacttcgctgctgcatgctttcctttctgcctttactgagtccttctcattcttggccagtcagtcatattttctttctgtcttagtaaactcagcaaaactgcaccagagtcagaaataaatggaaagggaaggatttttaacgaaaggggctcactcattctgacttaaaacatgtattttgatagtccagaggttttttttgttgttattttttccctcctctgatttcagtgaatttgatttaccattaatggtctgatgaaagagatatactttcttatttacaagcgacttctttctcaactaacactttgggcctggagttcagcaataatactgttgctccaggaaacttctggcatttggaattccacttcgattcaactaatgcttagtaagttgatttcacaaaagtaaagtgtatgttctctggccatatgtattcttgtccacaagcagtcttcaagcctggaagatggaggagagatgagcaactgaactattctaatacagttacaaacaaatttcaacgtgtgaaataatgggctggttgctacgaggcaaaaaagaaacaaacacttattttgttgttgaggagagaccacatgtaattttcctggtcaggaaatggctttttgcaaaaggtggtggctgagataagtaaagcagggaaacacgtcctgagaagagagtgcacaagccttgtcagagggactgaaaagcacccggcacacaaggggatcagtgactatttttccactataccttaagcaacccttcttagcagtataaacctttcttaaaatacaatttcgtggggaagtgcaaatttcaaaaacagagctctctgcttaaagcccagatggacgggcacagccctcccactgtgtcttctctttgcagctacaagcgacccctgcaggaatactatgtattgtatgaatccattaatcacggatgcccttactcagcctccctaaagttttgcaactcctcgcttgagggatcctccccaagagtatacattaacaaagagtaaagagtagaaagctaaaattaagtaacttggggtcctgttatggaaggatttgaatgtgagctggatgcattttactttatccaggaggcagtgggactcacagaggatttgtgtgggaaggaaggacatgactcaaagctgccctttggtaggattaatctgacagcgttgtatgggttggcctgcagtggcactgaacctgacacaggcaaaagagcaggatgttcttaggccagtgacagatgacggtgagacaaaaaacctctatggaattcgaatccacaggacttggatgctgattttctccccagcaatgggacccacactccttcctagagagaacctgggatcaaaccacagggcttgtatgaagcgggcataagtgtggagctgaaagagttgtatcatgtgattttgttctgttctcctgctacttgagaaaaagccatattctttctgagactgggcattgaactttgatagttgtctctttagcttttatgtgctttccacattatctgaaagtattctatacttggctgtcaaagggtatccatgcttcaagggattaacacttttaaaatgagctttgtgtgtttgagctctttgtaaaatatggtgatacctttgatttcttaaaataccaaatttttaacaaatagctgaaagaaacattctttatcccccatgaacagtgtttccatctgcccatcatagtccacttcagctgcatctctctgccatggctttactggtttgatggtttgatcacactgaacagactgggccatctattttttgttttgtttttttgagacatagtcttgctctgttggccaggctggagtaaagtggtgcgattatggttcactgccgccttgacctcctgggcgcaagcgatcctcccacctcagcctctccagactcctgagtagctgcgactacaggtgtgaaccaccatacccagctaattttttatttttgtagagatgtggtcttattatgttgcccatgctagtctgggccattctttgtcacagtcaggcaagggtctaatgtcagttctgtatgatttcagcaccccacttttatcccatcaaaatactcatattagcttatatttgttttcttcagcaccattcttataccaacaaaagtatgcaactaagggtcagttccatttatttatctttgtgtctgtatcctaaagcaggggctacaacctaaattgcctatagattcatataggactggtatatggagtagggaatggtagaggctatggcaaactggagactgagtgcctgttcctcagtggaaagctgctattcacctttgacaatcatttgcctgatggaatgagagcctaatgtatccaaaccttttaaaacagtgtttctcagagtgtggtcttcaggccgacagcatcagcagcacctagaaacttgcaattcttgtccctccctgttccacctccagaataagaaattccaagagtgagatccagccttttgtgttgtaacaagcctttccagtgattgtgatgcttactcaaatttgagaaccacttgttatagtggacattgtgttgtatcactcagactgcttttgaggactgatatttgaggactatgtttgtttcaagaaaagcccaatatcaaggccaggcacagtggctcacacctgtaatcccagtactttgggaggctgtgatgggcagatcacttgaggtcagtagttcacggcaagcttggccaaaatggtgaaaccctgtctttaccaaaaaatacaaaaattagccaggcacagtggtgcacgcctgtggtcccacttgggaggccgagatgggagaatcacttgaacccaggtggtggaggctgcaccccggcactccagcctgagtgacagagtgagaccctgtctcagaaaaaaaaaaagaaaaagaaaaagaaaaacccaatatcaagatatatatttgatttttagttttttattatttatttttaattgacaaataaacattgcatatatttatggcatacaacattttaaaattcgtatacattatggattggctaaatcatgctcattaacatgttcattacctcacataccattttttctatggcaagaactttgaaaatttactctcagcaattttcaagaatagaatacattattagtaactatactcaccatgttgtacaatagctctcttgaacttattccttctgtctgactgaaattatttattctttgaccaacattcctccaacctccctgctccccagctagcttctggtaatcacaattctactctctgtttctatgtgttcaacgttttgtgattccacatgtgagtgagatcatgcactgcttgtctttctgtgcctggcttatttcactttgcataatgtcctccaggttcatccatgttgttgcaaataacagtattttattatttttatggctagatactattccactgtgtatatatatcacattttcttcattcattcatccactgatggacacttagttgattccatatcttggctattgtgactagtgctacaataaacatgagagtgcagatacgtctcttcaacatttcattgcctttggattttcagtttcataatatagggaaactataacagacacatccacttgtcagtctcagtctgtcctgtgcactgtcactcttcagcctccactccagtctgaacatgctaacaaaaaggatgctttcctggtttttttttttttttaatgacttcttcccttgcaggatgcaaagtttactgactccagatctaggcaatatttctcaaactttctcactgatacagttctgagagcagaggagagacagggaatgcagaattatatgctgaagccattcactgccaaatacaagattttgttgaagcctttccatttgcctttaaaaatcatataagttgtatgtcctattttgtcatatactcatatttggcttattgtctaaacaatgagttaaattactttcaagttaaattccgtaacttccacccacaatttcttaaagaaaatctgcaccctagaaaaatgctcaatttacccccaaaaaatagaggcaagaaaataagaagttacatgtaagagggggaagttataagtcatactcaaacatattcaagagccatatacctgaccagaaaatgcaccttttgccatcttgcttttccatacctccactgccacatctgagcgagtaaatagcatgtactaaaaatatcttgaacaaagcgagtagtctcttagttggaaggcttatttttagaaatacctggcacaaggttggatgagatttagtactaggccttatctaatccttgcctcatatgggcaccatttcatttctccaaaatcagtactgcaaagacggtgaaaagctttcactttatgtgccaacacaaattgattggaggtaattgcctgaaacactgtactgagaatgattctcagtctgtgtctggcagagtcaattataaatgttagccatgggtgtaggagtggcgactggtggtccaagtgacagatatctgtcatccctgctctactcagcactaataaaaaatgaaagcagtgtctgaaccctggatggtcctgctcattgcttgggacctgtctaaaccaagttctctggaccacagaatattcctaataggggtcctgacagctacagtcatgatttcagcaacctaagctgcaaagggtcattaccgtcattataggtttaaatacaaattagtctgtcttctaattaatagaggtacaatatctctcccatttccacaccttcagatctcaactcatctaagacactgcccctccactcttgtttcccaagcattgttcactggatgacagctcacatatgactttatatttatcattctgtgtcttagtataattaaaatgtcatccagaggccccctctctcagaatccaaagtctattggtcattctcttcttgagagagctctttcatatgacatgagtggttttggtttcttctgaaaccaaacactcttgccttctcctgctacctgtttattgtgcacaatcatcagtgctatttaattcttgcagttcctggtataattcttactttctcagggaaatttttgggttgctcgcaatttctaacatttttttttcgcaaaggtcagagaaagacaaggtatcaatccatttacgaaaagataatttttgttgaaaaaaatgccaaaagaaactctaagaatttacattaatatgtttggtgatcggtgtaactcttggtttaggcagggaaggtattcttttaattatcctatttttcagatgagaaaactgaggaatagaaattactttcctgctgattaaatcccgaagccaagactcaattcatgtctcttgacaccaattccagagatctttccatggacttatgccatttttccctttgctcagcacactgataactaattccaacccctgtctttgtaactgctctccagcacacctctccatctcagcactgagctcagtgcttttgcaaacaactgatgctttgtaaatatttgaccaacaaaggaaccaatgaatacattcattttacccatttcatttgtagaaatcacttaaaatacacttttcacatctactttcttagaattatatatccatttaaattcaacctcacaaacactgtgtaaaaaacaggatacatattgataaaactatctaaaggtaaggggactctatcatgctgttaaaatcatttattaaagccaaaatttgttataatgcaaagactaccattcatgtctcctgacttaactctaatatcttccttctacaaaacacaacgcagcttaaatcaaataaataagagtgtgtgtgtgtgcacgtgtgtgttccagttcttgaccttgccagtaactacccttgtgattcctagcaagttactgggtttccttggatctttctttccttatttgtcaaatgagcatgttggatttgatgatctacatatagaatgtacggaatgatgaaagagactgagacatcatgtaatcccactcccccaatttatagataaggaaaactgatttcttctggctccaaaatacatttttaaaggaacatatggcttcctaacagaatcagctcttctgaatactggggctaccccacagtcccatccctgccacttgtcaaatgtgtgatcatgatccactcatacagtttctctagacttcagtttcctgatatgtaaaattgaaaaagttggactaagagccctttcaggtttaaaactttgaggttaagaaaggcatctttgaaaactgacatctttgccactactgggatatgactcagaacataacgaagcataatatagctctagaaataaattggtgtcaagaacaattaaagagcaaccatccagagaattctgattgatcatttgtgtaatctgttcaatgagtacctggatttgaaaattgcttgattggtgtcttcttttaaaaataagagccatacatcatttgttgttggcttagagatacagaaaaaagaaccaattaagtgagcttcagagttaatttccaatagatttggatgctgcaaaccaaaaaaaccattgctaggcctttcttctttaatgagtatcacaatacaactagcctcagtatttttcagttgagccccagaagtttcacaatccatttaatatgttgcattccaagtatctgtttactcagttgttaaaaattgccaatgggacagaaactgtctgtcacttccagagcaattagtgtgtgaaaacttatcaaaagaaatctgtcaagtttgagtaagtataaatattgcatgaaagtccctaaggaaatcaaactgagtaggatacacttttgcgagttgcagcacagaaaagtttattttgttttatttacttggctttatttttcagaatgttgatagtgcttcatgtaacccaatggattaatgttttgctctgataaaaacagattttggttcttaagggaaatctcaattgtatattgagcgatataaaaataccagatcttggtttcaaatatgaagagctcttactttgtcctagatgggacactggaatgagagttaagctagaacgagtaggttatagtccgcctcacccctttttggtgctccagcctaaccctttctagacctcagaattttcttatctttaaaatgaagaaataggacaagcgatttgttgggtatgttttagttgtactacactttttgcctgctttgatgtctacattctcattacattatattcctcctgctccttcctgattgccctgaagagataaacaaataaaaatacaatattccaggtggtgatatttgatcgtgaaaaaaactaagttaatatcttggtgagagatttcccctgttttaggagcttagtgcttaggccaacatgttctcaccagtacaccagccaagacttttctgctgaccttcccacttcaggactccacagtatttacaaatgtcagatgttgaaccatgttggttaggttccttagcatcttctgtttgaggctcttcttggcatctatggtttcttcttttttttttttttttttttcagcataagaaatggttacgctgttatattgttattacaattggggaaacattacaactttaattcaatatttgttgttgttttctgttgttctatttaatattaatgattttgtagaaactgaagtaatacagttaataatccgtatattttacttattgttttttgaattgaactaattggtacagcgtttcccaaactaggttttttgagctgtgggggttagatggttgtggtggtggtaattccatgagcaaataagtttggatgcttaaacactctctaaggagtttcaaggacattggcatgacaaaatctcttgccagtcctgaaagaaaaaagttgaaactccgttttactttgtttaatccagtacttctcaaagtaatttgatcatgtaaccctttgagttttagggaggtgggggtagaaaacaaagaattaatcatcaaagaccactgtttaggaaatgctgcaggaggcacttccggttgtttgcatctctcactaagttactttagtcacaaaagcagtgaaaccaaaggaatcaacctatttttaattagatcaaatagcatgttaattgaattttcaaaaaagtttttacttctataatgattaacctgttgaagtgcaacaccaataataactaacatctgtacagccctttagagaattcaaagtgctttcacataatcggttgctcaccacttacctgcatcacatttaaaattgtcctcattttatggaccaagaagctgaacatgaagtttaaatggcttccctaatataacgcagatttgaactttagtcttactttgttgttgttgttgttcctctccaattagaaaaagaatgaagcagatgccattttcccaatatcgactttctggttgctaaatgagcctcccgcagaattcagagagccttgcagccagtagctactactgagagttctgaaaaatattgcagggaaaaaaaaatcatttcctagccaggcgcggtggctcacacctgtaatcccagcactttgtggggccgaggagggcagatcacctgaggtcaggagttcgagaccagcctggccaacatggtgaaaccctgtctctactaaaaatacaaaaattagccaagcgtcgtggtgggcacctgtagtcccagctacttgggaggctgagacaggagaattgcttgaacccaggaggcagaggttgcagtgagccaagatcgtgccactgcactccagcctgggcaacaaaaagcaaaactccatctcaaaaaaaaaaaaaaagtttccggtatttgattccaactctccttggagaaatgtgagttgattagtattgtgctggtaaattacattctaacttccatcatgtgactttggaggtgctaatttatacttaaaactctcttataaataattaggggataggtaatcttctcattttgcataggagaaagcttaggtgctgatagattactaggtttgcttgaaactcacctgttgagtatgtaaggactgcattgcgatgctgtttgttgaaagcctgccatacgggatagtacttcttcacaatgtattataggggcttttcctcccccagattttagtttcttgaggaagctttctggaaagcacttgtatatttacactgagtatcctcttgacaccagcatggggttacttgtaatgacatgcacatgcgtaaataaaatgattagccattctcatataaacataattatatctttctaaaataatacatgtggaaatgttataatccagtgataaagggaaagcaatgtgcatgacccctcctttgtgcgtaaacagtggatttaaggcagaatatgtttcctgttgcacattcagttgttaaggtcaagtacaattgggacacattgaaggattacagtacaaaaaatgccttttacagtaattagcgttctctctacaaaactgaagtgacctttctgctattttccaaggacactttatacatttagactttagctcaggatcatatgaaaaagtgacatataagaactcagtcaactagttctgaaaccagaggccccattgcatttagttgttcccttaccctcccctcaacaaagtaatttttgaagataaagtgggacatgttggctactcagtgccagtagctagtatatcacttctccagctttggacaaatctggaaattacactttaaagagaggaatcgtggaatgcctggagctgaagcagtttgatttccttggagcacaatagttcactgcagcaaatcatttatactcactgtcatttagtggtcttctctgaaatggaaagcatgggctcatgtggtccttcataaaacatttacctaattcttataaaagttagaactttcaaaggaacatttttgatacaactgcctatgaaattcatcccactggtcttatgggataagggtgtgtgaaaatgttgctgttttatcactatctcatatccactccctcgtggatctaattttttttaatatggatgtatatttgtggaatcagtcaactagtcagtcagtgtatacttaatgagtgtttgccacagtgttaaactgctctcttactaaaatgatggaaaagtattcaacctcacaagtgagaagaaaaaatttgagttgatagtaggaggcattgggagaagactgcattgacactcaggaattattctgtttctaactagagctaagaatttgaataagttactctgttcctaggtgcccgtttctcagttaatggaaataaaactatcaaatatattggaaagcataaagtgctatgcaagtatggggcattatgatgtaatataatgattattatctataaaacaaaagaaatgatctaaatagtttccagggtggcttccagcattactatatcaagattataggcaccctgggtctgtaatttgagcattactcaatacatgttacatagtgcctgacacctgattagcaaactataaatgcttagcccttgacttaaagaggttggacatcgcttaatcagctatcagtgtatcttttacttctctggaaataaaaccttattgactgatagtagaaaggctggtaaaatgccacgggggactgtgattacttcctatctgtatttagtgggctgaaaaagagtcattggacaacaatgtatacatttttaacctgatcatttctttcatgaaaacagtagagttccagtgccaaaagacatatttgtaatgaagatttttttcctttcagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggtgagttttcaagtaattttgttaattttgtttctgcaatcacaggatgaatgtggaggtatgttatgttgttggcacatgaagctttgttgtctaaattaaatgtaagaaaagtttactgcagcctatatttggtacccatattttctccacttgtgtaagagataaacccatgaatccattttggaaaactaattagaaatctaattgctaatctcaacaggaatagaatgaggatttaggtgaatataaataacaaaggaaggtatttcttgtttctctcccacttaaactgtatacacagtcagaatgaagtgaaaggttgaacaattagctcattaatcaattctgtgtaatttagtattctgtgtccaattatccaaataacttctggatgtacagtactgaacgcatagttcccaccacagtgaaatgtagacataacaaggcttgtttgagacagaaattttaattccccacactattagaatatttcaagaaaatatatgaaattcatatattcttaattacctaaatgacttaacaatgtgtagtaaaaatcactgtgtactttgtaaagacggccgtgtatgccagactctaggagtaccatgccctttcccaccacgggtttttatatatgctgttccctcttcttgaaatgctcctcctttccttagtcccatcctctcagcttctcccttggataaactgatactggttcttccagtttctttaaagatgtcactgtttccaggaagccatctctgcttgctcaccctgccacccaaccatgctgcgtcaggtacctactgtatcgagtctacgaccataccccaaaagatctcataattctgcatcacagttgtctgtgttcttcactgtctgtcttactagcaatttgcctttttaaagcatatgtagtaccttattcacagccacctctgctgcacctggtttcgcaactggtacatcgaagattctcaataaatatttgttgaataaattcaaacaaagacataattaagcccttcaacaagggctgatatcatgatttaagcagtcgttgtagacatgttcaggtttctattctttttaaatccttttactgtctagtacacattcagatcttctattatgaacaggaatgacgagacccatcacacaagtgaggataccatcagccaaaaacattaataggaaacatctacttgacacttaatatgtgcctagtcactgtgcacagaactatatgtgaattatctcatttaaatctcaatcaattatatgataaacattttcttttgcagacggggaaactggggctcagccacatttgttaaaaattaatggctccaagatttccacccagcacccatgtcttactgactccagagcctgatatcttaaaccctcacagtgcttcgttgcattatactgtaacacctcttatctgaatttatacaagaaaaacttgacaaatgcaagacgggaactcagatttctattccccaagtttgttactctttccctgtgttttgtcagtgaactttgtgcccaagtgatgctctgaacctgaaccttccagaacaaagtattttatatactaagcagctctgaagagagggtctgagcatcctttctacatagactacactgtggaatttttgagcaaataatttagattttaaccattcatttattcatccatttaacatacatttatttagaacttcctgtgtgacagccactatgctgagtgctggtgaacaggaggctcttgcattctcctgggggatgcagacacaaagaaacaagcaaacataaacaaaaccaaaatcctattattttagatgccagtaaaccagtatgataaaatagcagctctgtggtgggtttggggggtggtgggtgtctactttagacagccatggaaagcctttctaaggaggggacatttgagctgagatctgaatagcaagaaaccggccctcttaagatcagagggcagagctttccaggctgagttaacatcatatgcaaaagccctgaggcctgaaaaaaagcactcagcatgttcagaaaacacgaagaacagttgagcgtggttgaagcatagtgagcaggtaggagggtggatagaattaaggttaaaagagagttttaatcttaattagaaataggagaaattagcagattttacttcgagtgcagcgagaagccgttagcgaattgtatgcaaaagagtgatttatgtttttaagaagattgcttagctgctatgtggaaaacggactttcagaaaacaatagtgaaaactggaaatccaatcagaatactactgcaattaattcagttgggaaatgatggggggtgaaactagggggtaacagcagagaaggagagaaatggattcaggatatagtttgctggtaaagctgcgagaacctgatcattccttaaatgtgggagacagtggaagagaaaatcaaggatgacacataggtttctggcatagcagctgagtgtatgggaatgccctttactgaaatggttttactgcacaggttagcaaaggaaaaatcaagaatactattttaaacattatttgtaaaaccaaatacataacttctcccttggcaacaggaggaattatttgttttgtgcttttttggccatctttctataataacattcatctggtatattcatatttgtccgcttgccttccccaccttgctcacattatgatcaaggaaagatcagcgttttcatccgactttgtactgcgctccagcacggtgcttgccacatggcaaatgttaaattaatatgttggattaagctacattatattcaataaaactgaaaattcttatcagcttaaagagaaaagtaagtaaggtactagctctgtcaaaagctatcagtgctatctctccagactgacagatgaagaaagtttcaaaagatatgctccagtggcattttgtaagaaatctcttaaaaatacagcccctgtggcttctacccaaatgcacttaggccagaatatctgttcagtggtattatctgttttggtctatcaagtcatggatgtaattacatattgactttgatatactgtgacatagccagggacagacgtcacacagaactgcctcttcaaaaaacaagaaacaaacattcaggaacacaagcactccagaatcatcatgtacacttcaaactggcaacaactctgccttttccctggcttttagatttatcttgatttgtctggtatatcttcatagagatgacaaatgttttgtattaaaatattttatcacaaagttagcagactaaagatctcattcttcagccattaatgcccactcattcttaatttccatgagtgttgcatggtgaaaattcatgtcttttccatttacactggagtatataaaatggacactcaaactgtgttactaagcacaaaataggttattaaattagctgttttctgaagatgagagaaaaggggaaatacaaatcaagaagagattgcaaaataaagaggacattcttgttaaaatctattctgtgacagtaaaatcaatgaaattctctctcctcaagatctgggatttggtgactgtatattagactggtaagtgcaaggtgagtatagaatttgtacaatcattttgatgattgaagcacactcaaaatttcacatcctctgtctgcctcagaaaagggaaaaaaagcaaggcaaaggagtttgaagcctgagctgaactaattgctagacttgtcatttactttgctaagagcacatgtagctggcagaactgtatttccccaatattcagcttgtttcttgggcatttcagctaagcagtctggactatgatttcttatttgtacccaaaaggccacagtgagtcataaaagttgaacagtgaaccttggctcagttcctaatacaaatgaggtgtgatgagtctcatgtctgttcactgaccatttaccactcacccgagtcctgcaaaaccctggggctccctgttcccttttccccagctcttcacatggctcactccttcctacatctcagatgatgtctcctatgtggggccaggaggtaaggacacaagccatgaggatcccgaagccaagcagtccaggcagagttcagccccaccatttattagccacgtggctttgaatgtgtcagtttaacctcattgtacttagttttctcatcagtaagataagggtaacaacatctacctcagatagttattttatgtgtcataattgaaagtactttgaacagtgacaaaacagaagtatatcatcaataactttcttacctaaaatatgctcaacaaattatatttttaaaagacagattactatagtgtatagatcatattattcttcttttttaaaatagtggataatgacagggaaaagtggaataatactctccaaagtgactaacgatgttaaactctaaagggtttaacttttagtggtaaattttgatttatttttttctttttgcttgtcattatttttctcacttttctaaaacatagagttttcaaatttttagaacattgtttgataaagattattggacctaataggcacttagagatcatgcaattttatatctttattttttgagaaacaagggaactgaagatcagagaattcggataagaaaaatggcatcaggacagattcctggtccctgatcatcatattatttcactgaggttcagaaaaggctgtttgggctctagatttagacatttgcttcgtttcttttgctttataatttttgataattttatagtgagaattatttcaaataactatattactttgcagtattcacttctgggacacataaaaatatgagttggtagatatatgtgagaacagattttatcagagtttatagttatttatccagatatttttaaatctgctttgagaagataactgatttgggaaagtacacctgttgcttaggaaccatgagagggagaaagtataattgggaagaatacatcatggttattattagtacaggtactaaagtagtccattgatccttattagcacagctgttggttataaatagtgatgagcctgctctgttatatgcttcctgcacagatctcaaagagttatccctaaatttccataaacaaaggtaacagaccactcatatagcataactactaaagaaatagtagccttcgatgataatcatattggctcttctgtctttagccacttacatggctctctctaaaatggcttaagatgaaaagaattagcagagattaggacagtcttgagaagatgagataatgtctgttacactgtttatgcacattacattacacacacagggaaatcatttagcatgaaaattcattgtttagcctttgcctttttttctgttttcctggagactggttggggactggtttggaaggtttggaaggttttttttttgttttgttttgttttttaaattttgcttattagaacaaagatgaatgttgagcaatttatagcctgtgtctgtctgataggtccatgcattgcacagtaattgttaaatatttttgaatattaacccgaattggaactccacatagaagagatgctacaaaacaaggaacaatgagattatcctatcttagagtttcaaattctctctttctctgtactctgtctctctttccctttctctcctccatttctatatttacatacattgttaatcatatacattttggatataggtatgtatatataaaccagatatattgtctttgggggttcaaatgtaaagttaacttctctaaatgtttattatacttcagtataaaattaaaatgtttaaaatgtttatgtatgttctcaaatataactgaaatacctgaccatgttttcccaagtcctcactcatttttcacagcctaatttagccatgaaaaacagtgaataagagcagcattgaagtatttaatcttctcatcttaaatcaagctttcacccagtaggaaaaagcccaaacgatgacctcagcatccttcagtttcacaacttttagtcatgtccaggactaaagtcaagagggcaagtaaagggattctggagtatagtcccagacgtaccagcagctctcataagacaaatcattaccatttctttggtccttagtcttctcagctatgcaaaatgggtgatttataataagttctatctaaagtttcttcttcttgtcttcaaggattccagtcacaactttctagcctacttaactccaatctcaacatttgcccaagccagataatatcaggtttaacagacagatgctgctcattgaatccgatttctcatcaatgctgacagctgatccctgcagaaaactaggtgcattcagtctttcaggccacagtgcgccattttgtgagccttcacctctgtgaccattatacctcctagtggctcagaagactacattccccacaaacttctaaatttaagaccaaaggagacctttaaaatagaaagcagaaaactaaaagattctgaaatattcttgttgcagcatcatgcatcctccattatggtcttgccaactggtcactgtaaactttcctaatactgctccatgctacattagatcctcaactgggcatcaacagccactatttttcttcatgaaaagggagctttatttgtaggccacttaattaacctagtgggtttttgaacccagtcatttaggagatctcttctagattggagacgtgatctacaaccctttattgaagacctggcatttagacaggcaacaggtagagatatgccttccacttagacataattttatattatttaagatctagagtttataccaaaacactgctttattttactctcacttctaattgcaacctttgtgtggttttgtcacagcaatcatgtcttgattttaattctctgacaacatcgcagttgaggatctgtgggcgtaaaacatgttttatgaggagaacatctaaatgactaaaggatgtgagatattttgctaaactgccattgctaatctgatttaatagcatcttaatggctctgtgtattttgaaggtttgacaagcttaggaacttggcagtcatctttagacctctagcatagccaattccatttcaggtccatgggggctaaaggtcttggatggccatttggctactcagttagaaagcatctgttaagtgctcgttgtgtgtggcacactatgaaataaaaagacatgatttcagcctgtgggaacctacagtcttagagaattccaagttaatgaagggtctaaagtttcattctttactggaattattgaattgagttctgaataatacatttatagagggacttgaaatgaaagagggaagcagaggtgtttagcctagaattgagttgacttggggcattcttttgatcatgcatttaaccaacgaatactcattgagtatctgttctctacttgtctctagagatgcaaaagtccttctctgccctcatggattatagcctggctgagaagcctaattgcagttagaagcaggagtggggccatactcaggggagaatagagaattaaagcagattcacttcagtttcaattttggtaagaactaccttggagcagtgaagtgtacagggaaattaggtgtagaatcacagcttaagggtgaagaaaccgggcctggtcttgggaatcaacccaaacttccatgaagagtcagacaatctaagataaaataaataattccaggcagcaggcagattatttgttttaactaggaattggcaaactctttcccacaggccaaccttgcctgtggcctgtttctgtaaataatttttctatagaaatgttgggtattcttggctaattcctagattctctatcatttttgctgttacagtaagttgtgcttatccgtttgtttttgtttgtttgttttttgagatagagtctgtctctgtcacccaggctggaatgcagtggtgcgatgtcagctcactgcaacctctgcctcccaggttcaagcaattctcttgccccagcctcccgagtagctgggattacaggcatgtaccaccatacccagctaatttttgtatttttagtagagacagggtctcaccatgttagccaggctggtctcgaacttctgacctcaagtgatcctccaatctcggcctcccaaactgctgggattacagatgtgagctaccatgcccggacagttgtatcttatctttaatcacattatctaattagttgttgcttatatatggaaggtactgttattcttgtgattcagtatttggcaagcttgctgaaatttcttgtagttctaataatttgtctgttgattctattgattctctcaaactttgctatcttctgcatttcctctaagccaaggatcagccaactagtatttatgggcccaccacctatttttgtaaataaagttttattggcacacagccactcccatttgtttaccttatggccatggctgctttccagctacaatggcagagttgagcagtaacagggactgtatagcccacaaaacctagataaaattcttattttctggccttttacagaaaaaactttgttaacccttgacaaaatgatatcattaaatatctgaagactgtccattaaaatacttgttatttgtggctccaaagacttgaactgggaccaacacgtacagagatagagtgtttagttcaatacaacatggatacatggataactttttagtaggaaaaacataggagtacttccttgaaggaaggtgaaaattggcttaaaagatgacattataactaattgcccaaactggaaactattagctcattacttcaggaattcaggaaaaccagtaccgtccagcgcaagcagaggtatttggcctctctgcctttaaatgagacagtcttcttgaaaaaggttatctctgcattttcaatattgaaaaggaaggaaggtggtgcaggtttgattaaagtcaaatcataagatttattttcatctctcacaggtttctgaggacaccttaaaaccttgactgtaagaggtgatgtgacaccttgagataccttgcctctcctgttcagcagtggggaggttcttgtctcaacagttgttgccccatactctgggaattcacctactggatggtggtggtggtagagaagataacttggacagtccactagactacatatatctccttcaacccaggggaaaacatgccttttttcaaaagggcaaaatggtaaactcagtcaggtgaatttgtgtgactaattggatatttccaaatgtttttaggttagtgatatatacatcatatgacttgtttctcaagaaagtcaatgtggaacttttcataaaacaatttttgcctttttttttcaggagaaaatcccactctgtggaagttagtaaatgtcccttctgtagttaaatttagtaagcacagatgccagctaaggcaggtgttggcaaaaatcttatggcacgcaactctgcaaactggtctccttctgccaacagagtctctgcaaattgtacttaaacaagcacgatgtgttgctgatttctctttcatattctctaaattgccagttgttttgttaaattctgtgttcttacagacatcagcatcaactttaataattgtccaggttttgaaggagatacagttgccacaagttcttctacagagtccagactctggatggacttggtccctcaagttgggactccattgctagtactctcccaatgactagcccttaagatatgtttattaatgttaggtggaacttcttgcttttgctcatagttaggaaagttgttcttaaagtgtattcttcagaccagcagcatcaacatcaccttggacttcttaaaattgcaaattcataggctgcatctcaacttactaaatcagaaactcaagcctttcagttgatttcaagtttgagaaccattgttttaggaaaaatacttaagaactgccaaccgtgtcttcctcatgaaatcacctcttttggttattcaataaacagttattgcctgcatgtgccccattactaagccatgtgctgaaaaagagtagcctatgaatgtcatgaatataaggatcagatctgtgttaccacagtgtgcccccatttgtgggcactgcatatggcttattattggtgtcaaatgaatatttacttatttaatttattggaatattaatacaactaagcccctgtcttctaaagactttgatatatggaatttcaagtgccgtaaccttcattactattgttgtatctctcttactccaaagaatataaaacgttggcaatgaattataatgaattaagacatttttactttatgcataaaattatgttaggtgtttttatttagatttgaaagcaagagttgtctttacaggcaaatcatgtatttcatatagcagaaaagtatggctgaggttgtatattttggttgaactagactaaattatatgtgttccttacttctactttgccttggttgtgtagacctgggtaggtctttacatcttcccaccttttttaatagttcgaagatgaaaagggggttctggagcaattccatcaatgttcgcactcttttagcctacttctgtaaatcactagagcagctgtgcaccaattaattgcaaaagcgtacaggtggtcagcagaatgacttgataaatgcactcttattttaaggggcctttcatttcttacaaaacaaaaaaggaaacagcttttaaatttaatgcagaaagtaaaggccaaaatagttaaaataaaaaaattagtcaaataacaacatatcctgtgctagttgtaaccaaattaaatggaacagttcacaggtgttccaaaacgatgttcataatattgttgaagaaaattgcttctcttgtttttatgactttaatactaggccaatctttatatacagtgaaaaatttttaaacagcagtgaaatgatgccattctatctctgatccttctctttatgtactgtactactgccatatatacacattaatctattactgatgactctgttattcacgttcctgtagccataaatatggatcactgtgtatcaatccagaaatcactcactctgtgtgactagataaacaacatatacagatcattttagtaaagaatgatcttaagtgagtgaacttgtactagaagctataattatacttaataaatgacttctatgcctggaaagaagtatatgtttgacttaatggctattatatatcacagcataaacactgcattcctacatcttttcctcccttcaacaaatccttacccatcacattttttcccatattactggtattgggctaagatttgtgaaggatacagaaaaaaatgagaagaatttctatccctaaagcaggtaagagaacaacagaagagatgctctctgtgtgtgtgtgtgtgtgtgtgtgtgtgtgtgtgtgtctttctgtctgtctgtctagctagctagctataaagatgatagaaaacagcattgctatttaagaggtaccctgaagtttatatgtaaaatgttttatgtcagtagttactcactgaacacctacaagtgaagagcctgcagtggaagttaggaatatagctatgaaaaagacagacgcattatttggtgtaatatgttttgccatctaaatggaaggcagacactaaacacatgaataaacaagagaattataaattgtgataagtaacatgaagcaagcaagacagtagtagagaataactctacttggtgtgggcatgagaatatgcccacacaaagacttgcaagtaaatggtcatggaagcattattggtaatagctaaaagtggaagccacccaaatgcccatcaactggtgttatgggttgaattttgtccctcaaatagatatggtgaagtcctaatacccagtgcccctgaatgtaaccttatttagaaatagagtcattgtagatgtaatcagtaaagataaggtcatggtagggtaagatgggccatagatccaatatgactggtgtccttctaagaacacaatgggaagacacacatacacagaaagaatgtcacgtgacaaccgaggcagagatggactgacatgactataagccaatgaatgccaaggattgacagctaccaccagaaggtaggaaggattctgcccagagtctcaaagggtgcatggccctgtcaacacctttatttatgacttctatcctctagaactgtaagagaataaatttcttttgcttagggccactgagtttgtaatgctttgttaaagcatctctaggaaactaatacaaccagcgaatggagaaggaaaatgtggcatatcctacagtggaatattattctgcaataaaaaggaacaaactactggtacctgttacaacatcgatcaatctcgaaaacgctatgttcaatgaaaggagccaggcacaaaagaccacatattgcacaatttaatttataggaaatattcagaaaaaaagcaaatgtacagagacagaaagcagattagaggtttcccagggctgagactgggaatggggattcattgtgaatgggcatgagggatcttactggggtaatggaaatgttctaaaactagattgtggtgatagttgcatgactcagcaaatctgctaaaaaccattggattgcacacttaaaattggtgcactttttagtatgtaaattataccttaaaaacttgttttttaaaaaaaattatcaatggaaacagacaaaggtagaagtttttatcatttgggtcatttaaagaccattgtgggctagagagtagggcctacagaggagagggaaaggcaggcagtaagtaggtaaaggattctgggagagaaaatgttcagtttgggcctaaatagataggattttaggacgcggagataacagttcagggatctgggacattgcatctctgcgttgccagtgatattttagttctttcaaacaaggttgtgtgacatatatttgctccttggtggaattttcatgatcagattaaataaacacaattttatatgtgatatttatagacagagagaggctgggaaaaaacctgaccacttctaagacctccttggcttttgtattctaaccttattgtctcatctccctctaacacatgatacactgcaaggcaggctgtcttgatttcctgggaagacgaaagacctccttctctcaaggcaattctttttaattaacactgctctcagagtatacagccatatacacagcactaaaaggtgttaacttgctcactgcgctcaaagtcatactactgatatttatgggatgatgattcaacggtacgggctgtttgttagcaagttcaacagctgtgtgtgaatgttgttgtgagtatgcactgagtctttaccaggccagctttgtgcagatgctgaaagaaaggccagcccagactcaggggcaagagaactcagacagcagaggctagcccagaaaggaggaataattttgtaaccgaacatgtcaagcatgagtgtaatgtatttgaacctacttttgtagtgttattcatttcgtggtgagaggccttcgtaagagattaagatgaggagtcaggggcctgagtttcaacaccgactggttttctgtgggactaaagataaaccgtttaactcttgagattacagccttgcttgtaaaagaaagggatagattagaactgtgatttttaacctatggagggataagcgtcccttcaagaataggttgctagccgtggatcctctctttagaaaaatgtgcatccaggaggaaattaatacccagattaaggttgctgaaccaaatgatatcaaaggtcccttccaaatccaacactcctcatcattccaggaaaggaagaaaaatgaaaacaagaagaagaactattatgttcgagtttgcactattgacaacatactttatagcaaagttagctagactgtaagtcatcagacacccagggttgattctgtttctcacagtttgaggagatcctcttgatgcttctcaaactctgaaatggctgatgaaaagggtcacctcggtggggtgcggtggctcatgcctgtaatcccagcactttgggaggccgaggcagacagatcacctgaggtcaggaattcaagacgagcctggccaacatagtgaaacctcatcgctactaaaaatacaaaaagtagccatgcatggtggcacgtgcctgtagtcccagctacttgggaggctgaggcacaagaattgcttgaacccgggaggcggaggttgcagtgagccaaaattgtaccacagcactccagcctgggcgacagagcaagactcagtctcaagaaaaaaaaaaaaaaaacaggcaagggcccacctctgcgaagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccattttttgtctttaacctttccttctaaggttcagtctctttttcctctgactatgggaagcctaaaggagagatgaaatggagagccctatctttttatagtaagccaggtaattccaaactctttatgggcacagttgaatcaaagatcataaaaactgatcagagatggaataagaataaatgtattagaacaattagagcagtggcaaattgagtcaagcatgtattgataagaaataattgataaggccaggagcagtgactcatgcctgtaatgccagcaatttaggaggccaaggcaggtggatcacttgaggccaggagttggagaccagcctggccaacatggtgaaaccccgtctccactaaaaatacaaaaaaattagctgggcatggtggtgcacaactgtagtcctagcaactcggggaggctgaagcaggagaatcgcttgaacccggaaggcagagattgcagtgagccaagatcctgccaccacactctagcctgggtgacagagcgagacttcgtctcgaaaaaaaaaaaaagaaaaaggaagaaagaaataactgataagtatttaattgcaaagcatggacttagtttgttagactgtgttaccttgggcataattgtagagtcattttccgggatataggaaaagtgggagaatatgaccctccaaataagtgtgccattggcaaggtaggtgtaacttaaatgttttctgtagctgtatcttgttattcttttttcacaggtccaaaatgtaataaaaatacaggcatttgatgttaccttgaatatactaatttatgattcatttatattggccttggaaatgaaagtaaaagttgtggccacagaatgattactcagaagaattattttattatatagacataattaagcatgcaggtatttttgagtacttttattaataaatcttacaaatttttctgcagtatacttccaaagagataatttaattttcctgatgactagcacttcatccccttctcctttttttccttaagactaccttaaaacaatacttttgaggggcaaagttgtatgcatggagaatttaatccaggcaaatggtgtggttctgcgacacaaatttttctgtagcagtaactgggagaagagccacaattcatgactgctggagataggacctgctttaaatgaaggaattaattgtgcacataatgatgtgtataagcattctgcattaacagaaaaatgagttttacattttatacattttaaaagaatctccaagacttagcccctttatttattcacaggagtgatgggtgaatatgagcccaaaatagaagtgcagttcccagaaacagttccgactgcaaaaggagcaacggtgaagctggaatgctttgctttaggaaagtaagttctggtttgcgttccttctcatcctcccttcagcttgagcaggtatagagtttttcttgcactgttcacagcgatggtttctgaggtgacggaaaagcaagtgaagcctttctctttgtaattctgtgtatgcatcttggattctgcccctcaccatggagagaggacatgtaatggtgcaagaaggattaggctgccacaactgacatgaccacaaaggaaaggagaatgggcaattctgaaaaagtattttgttctattatcatgacctgtaatgtgcatgctgtctaacccagaatgacaggaaaacaatggcctccacttgaggtacagttaagctgactatgtggaaaaatacggactttcattttggccccagtttatagaggatgcatcagacttttcttgaatttctttttaaactctcagtctcttctctctactttggatttccttctcctctggctagagataggtaagacgtgttgttctctaagagagtctgttttacaaagttgtccaaatattgtttacaactttattattcagtgtggacttccttgagaaaagcctacttctaaactagctaacttttccttacagaatatatcagacagcataaagaacatgaaatgcacatcatttgggatttttatttgccagtaaccagcaataaagatttggcataaacagtataaactattatctgaagtgagaattttgacatcttctttggattttaatgatccgtgtcaatctttatgcccagccccatctatctgacgaatccattactaactctctttttcctgcgcccaaatgttgactaaggcaacaacagtaactttttttttttttatttttcggtagaggcaggatctgcgtatgttgcccaggctagtcttggactcctggcctcaactaatcctcccacctttgctcgtctaagtgctgggattatagtccctagccactgagccaggcaacactaactccaccaatccttatatcagcgtgtaatctcttttcttatgatttttgtgttttacagcaatcatagaagaggttcctttttccattttattgtcggttctaatagaaaggttgttttggtttccatgtgttttcaagtcgtgacaaataagctacagtcgtatctttactttggtacagtacaatgcagtggtaattttttatgtcctgaaaacttatcatattaaataaattaagacataattataggattgaacactctacagacattaaaagtcaagttgcaaaacaacatttaagacatagaaaatgcccatgctaagagaacaaaagcagattgctaacaggataatatgattacactttttatttttattttaaagtatttgtgtataagcatttatatatatgaaattaaagatgagagcaggtaactgggtagtctagatatacatttgatgaattttttaagatgacaccttgaaaaatcatctgtgaaaaagagcagaattcacgttgttcacacttcaaagggggttatgaattaaactctattcacactgtttgaatagtgctggaataaaaacaaaaatcccaaattggcttcttcagtctacacagaaatgtttgggtatgcacatccagctgctgaaacacatcatcactgcccacttaagagcaggaagactacatctcagtatggttatttttaaaggcatatattaagtgcatatctcatcagtataaagacaccgattatgtacttttcatagaccttttctgcattttgagttagtgtctgtctaacgaacttaaattcttctaaaacaaatatagtagagttgatggctttaatgttttaaataccatctcaggtttcccagagaagattagcaagtctttagtctaattacttctctgtgtgtgtatttgtgaaaaataaataagtaaataattgtatcccctgccaggcagccacaatcttaaaagctgtggttagctcactaaaccattgatttgcagattcaatgatgccctctctgcaatttaagatttgttccaacagttatggcagtaggatgatagatgccttgagagtacataaagacctcacagatggcatctttctttctctcactattttaagcgaagtttccccaacccatcttgcaaatggactgctgtaagttggtaaggttctcaatatataaatgacaaggagaaaaaccatgttgtccaaaagaatgtaccttgagtgaacccttcctgtatgtcagcaataggttgtgtctcccaaattttatgagctcattatttctactatcatttattcattatttggatatttctcaaagtagggcacttgcattgttggtacatagatttatggaaatatattgtttctgttatctattgctacataaccaacttagagggaacaccagaattttattatatcttacaatttgtgggttaagaattcaggcagggcttggctggctgattcttttgcttttagtggcatccttcaggtctttcagtagtatttagctgacagatgaactggtctagaaagctcacaagagtctcacacacatttctggtattttgttggggacgttggaaggctggtgtcactgagactgttatctggaagccttacgtacggcttctccttcctggcggtctcaaggtattcactcttctcgtaggacagctcagggctgccatgagacagaaagcagaagctgccagtttcttaacacctgagctttgatcctgcaacatcacttctgtcttatttattagtcaaagtggttaaaaagcgctaccagattcaaggggaggggccatagacctcatctcaatgggaggaatgtgaaagaatttgcagctatctttaatttgccacaaatgcacatgaacatttttattttcatattttttatttagaaaaaaacatgtatgggtgaaaccttgtctctactaaaaatacaaaaattagctaggcatggtggcgggcgcctgtagtcctagctacttgggaggctgaggcaggagaatcacttgaacccaggaggcagaggttgcagtgagccaagattgcgccactgcaatccagcctggtgacagagtgatactccgtctcaaaataaaaaaaaatatattaaaaaaaaaagaaaagcaaaaaacatatgaggaaacatatataacatataaaaatctgtttttatttcaatgatgatattgtataggagatagatcacttttttttttttttttgagacaaagtctcgctctgtcgcccaggctggagtgcagtagtgcgatcttggctcactgcaacctccgcttcccaggttcaagtgattctcctgcctcagcctcttgagtagctcagattacaggcacctgccaccatgcccgggtaatttttttgtatttttagtagagacggggtttcaccatgttggccaggctggtttcaaactcctgacctcaagtgatctgtccgcctcggcctcccaaagtgccaggattacagatgtgagccattgcaccctgccagatcaccttattgaaagttaagaaaagttatttgattttaagaacactaaataagtaatgctagagatgtggatatgattaaagttataatggagatagaggaatgaatgaagtttgcaaaacacccaaccttatatgtgtagaaccaagaaggaagcgtttaggttcagataaaaggtccagttttctctagtttgattcactcctttttattcttgctatcagtccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatggtaagtgtatgatttcagtttatcatttatagtgctacagaacttcctgatattgaaatcataagctgagaggcattcaggcattttgggagagatggtgcagaataggactgtgtgaaactcatggtttgctccataatcagccctggttgattctgggtgtggagagtgagggtggggggcaagggtgttgacggagcagagaggaagacattaggctgatgtgtttggaggatgggtattagtgtgaacacacttgcaaagaagtctgtttttcctctttgcatcaagctgtaaacctgacacaggaaacgttttattattcctactcctgatttatctttttttttttaagctctgtgcttttcttcattagaattttgatttgaggcttgtgctaatcttttgtaattgctcctatttgttagcaatttaatgtggtaccatgaacatttcaaaatgcacactgtccaaatttagttcttatcagagtggaacgtgacaaatctctctcaccccaaagactttttatgtgcagctgctcctattccaatcaaatcatcagcattgatccaaacaatataaatgtaaaaccactagcacatggtcattattgagaccatcttggaaaccctgttaggatactgatttgaaatctcgaaaaggatttcattggataggcattttgaaagcaaactgagttctgccaaattggagcatgccagaatcccatctgtctgggatacagaaaacaaatactatagattgataattatttaagaatggtttaaacaaacaacaatgcatattaaaatgatgagagtagttctgtagggcaagttgtagcaaaagctttaaatgttcttatttcttgcagtaattgatcccacaaaagtctatttatttcactaattcttcttccaaagcattttggttttaagatatgaccgaagttctaagccctccagtagacagaaggggacccctcttggctaagggggggcccagagtaacattgaaaaatgagttcttggccatgatgggagggtaatgtcagacacatctagttatacctgctcccttgctaaccgcaatgagcctttcttccctaagggctaaacacaatctagccctttgaaaagactccatcactgacatcaaccatgcacctgatgctgccccttattttttgcctgataagagaccaccaacacagaatggttctgtcattctagggaggatgtgccgtgaggggtttcatgtcctctggtctaccttttgacatcacagggccaaaacctccaccctcagatgctaatactgccatttttcatacccggaacccatgaagggttgcacatgcagatggttctcctttcataaatatccatgactcctcctgtagcttattaaatatgtatattcatatttatatacatatgaatatgtatataaattcatggcttctgtgtatgaaatatacatatattcatatttatatacatatttatgtacatatgaaaatatgtatatttcatacacagaacccatgaaactcagttgcacatgcacatgtttcttctttcataaatatccatgattcctcctgtagcttattaaatatgtatattcggccattccactcagcacaaattcctgtttgttccctttgctcctccttggaagtgcctgtttacagcttctggccaagggaggctacgcttcctagcctgtcagaatggccaccaggcagactaataaagctctcccttccaaaaagaaagaaagaaatggaaggaagggagggagggagggaaagggaaaaaggaaggaaggaaggaataaaagaaaaagctatggccaaagaattctgatcgataatcacgtaacattttttaaatcttgattggaaactgggcagagatttccactatgagccagccttcaatgacctcccctaagtgactctcagcatttcattttggactcacgttcccctgatgcagcttctgaggggagagaacacacagagttgtagaaagtattaatacttcacttgatgagctgggcagtagctgtttgaatacatctgcacttctcttttatcattcgtctgtcttcaagaatattaaaggactgactctcctcatgccagatgacagacttgatatttaatctttgctttcctcttaaactgtcatagttggtatcttagttgatgggttgtaaagcaaaagacaccacagttaactgactgcaaaatcatgagactgtaaattacagatttattcagtgagatgctatggctgtgtatttttaactgtgtagggctcgtttttctcaccaatgtaataattattttttctatatcagataggaacaatctgtaaatattcagataattggccaacattttctcttttttcttggttgaatagtctcttcagttcagtggtggctgttcctaaatgttatttgagtagcttaactaattgaataaagtcattttaactttcatgattttctgttaactgaaattcctgctctcagtatgttaaactggtatgaaattttctgcaaccaggggtcggcatactgctttcctgtgggttagaggtttcctgcactggaaatacagtactccaggattactgttatggaaaatcaactttgtcactggctcccagccctgtgcagggaaatgtttttttcagggatcctgccctggagatgaaaatcaggttctaacaatgtttcctttttaaatggagttatctgcagccatgcatgggaaaaagagcagaataaaataaaatttgcctgctttctgaagataactcagccttagctcacttgtcagccacgcttggtgttaaaaacttgtcagatcagttgacttccacagcacttggctattgcatttatgtttattcttttgtttttcctcatctagcacatcagtgacaaaaattatctaattgttttcattgtcacagccacaggagagcttaattatacataagcacttggctgtcatcttttttcctctcacttttttctggtctgggtcttcccagtgctgtgttcctaatatccagctgcataggtctccaatttaaatgaattatgataattaaaatcaccatgtagatgataaaaggtgagaaagtaccccagtcacttatccatgaacattctgtctttgttgacaagaatttcttacaacctaggaattataaaccatgggtttgagcttagaaacctgcttctttgggttccaggttgtttattgcattcatcagctctccacttcagcaaccagaagtgtgctaactcctattcagggttggcaaaatggcaatttttttccttcttgcattaaaaccattttgcattaaaaccattttgccttctttcaaaagcctactaggcatgatgattgttcccagtgtctgaataatggaagccctattgccctttggtttgtccctactgtagccatgtctttaagttaccctgtgctactcatgtttggtatgtatgaagaactgaagcaagttcagagatagaacatttttaccctaccccatcttcccaatttgtttttgctataacctgtacggtctagttgaatctacttttctcagtctgtttttggcattaaaaacttcctaaaaatagatttattttcagtggtaaaatgctatggatctctgttactaaagataaacattttccaaaatgactttaatacattatttacttgtttaacaaatttttttttattgcctaccatgtgggagacattatcaggcactatggctgcaagacaaaatccctgccctcaaggacctaatattttactggaagttaaccaaaatgcactattaagcaaataaattaactaggaaattttattttttggtaagagtgataaagaaaataatgaggttgattggccaggtgcagtggcttatgcctgtaatcccagcactttgggaggccgaagtgggtgagtcacttgaggccaggaattcgaaaccagctccgtctctactaaaatataaaaattagctgggtgtggtggtggtgcatgccggtagtcccaactacacgggaggctgaggcaggagaatcacttgaacccaggaggcggaggttccagtgagccgaggttgtgccactgcactccagcctgggcaacagagcaagactccatctcaaataaataaataaataaataatttgatatgatagaaagtagctgagagcaagagaaagatttcataagatgaagtagtcaggaaagacttgtctgggaattgccctctgacccaaaacctaaaggatgaaaatgagctaggctttcaaggggaagtgcattgctggcagaaggtgaggaagtgcaaagactctgaggcagaaaactacttgactttcttgatatgcagcagggaagtcagtgttaactaaatcatagtgagcaaggggcaaaggtttgaaacttgggaaggtgacagactgcagtactttgtaagccaggcacagagtttgggttttattctctgagtaaaatgggaagccattacagcatttcaaggcaggagggtgactcgatttgattaatgttttgaaaagaccgctcaggttgttttgtggtgaatggatgattggaaaccaagagcaaaagccggaccattgccaatatccaggtgagagacattgttggttaggacgtaagagaggaagagaaatggagagacttgagatatattttggagttagagccaataggatatgctcatttcattcctacatctgtctagtttatagatatggaaattgagtcccaaagagattaaagtaattgatttaagtttatacagtaaaaaacagagctagatttcgaatgctttgctagaggttctgaaacttcagtgtgcatcacaatcacttggaagtcttattacaacacagaattctgggtctcgttctatgttcccagtgggaacataccagatggaggctttgatttggtaagtccagggtagaaccaagcatttgcatttctagtaagttcccaagtaatgctgatgctgcttgtctgggaaccacatagtgagaatgctctatgtttaggttgtccacccatggtattgtgaagctgaagattaaatgacatgcaagagaaggtgttcctgctactctggaaagctaacagcttactgtcacatcaggcattttagccagtctacacaaagtagaatgagagcgctaaggcaattatctttgaagaaaggaaagggaaatataaaatgtatttaattcacttggtaattattcatctttgcacttcattctgtctctgtagtcacttcctttttgcccaaaaagactgatagaattatagtcatcatttagtagaatgaagtgtgaactacaagagcctgatatttaatatctttgtacagtttcttctctttgtaacaggtgttatgagagttaaaccatcttcataattaggaaatggggaatctaatatttgagcagtaaacaaggctgtatttcacagaatccagtaatacttaagctggaagcaactgctggggccaaccctttgatttttataattaaggaaaataagatccagagatacaaaataacttattcaaggtaatgcagtgaatgggaatcacagctagaactgcttttttctgctattctacctgtgttacttttcctgccaatacaacattttaatacaataggtaaggtgaaaaaaatccatcaatcatccggatactctttcttgcgttttccattaccagtgtcacaaatgaaaacatctggatgaacaactgactttttcactttctattttctaagttggtcacctggttattgagtccaaaaaaaccctttttttcttcttcaaattacatgtaagactaaatgtctagagcctttgtgctacagtcctttgcctctaaaggcaaaactgtaggcttgatgacactgcaaatggtgtttgagtatctctaaggtcatcaataaatgaatacttaagcatcttacagcagagcatactaattccccatggatgtgctatgtatatgtgatcacaagataatattcagccctgcaaagaagcttaaaggacagagtaaccaaagactgaacacagtacataaggtaatttcacagtagggcaatagtttgcttaattgtcctagacagaactgatattgataccctcaattcccctgtcacttaagataaagtcaacaatttttgtttctttctttcatctgatagttccaataaagtatgttgctacagtttttaaggggtacgcattaagcaaacgttgcgaataatagagagaattaatacaggagtggaggcataaagtcctcacctaataagaaacgttaagccatgaaaaaaagagtcatatcaaggacaatatattgaaatgcaattcaagtcatctcactctatagtcccagagaaggcaaaatgtcacagttacatttttttattcaccaatgaatattgtttaaatttacttataggaggttttgcttaagttgattcatttatctagaagttcctctgcttgtctaagcaggagggctcaaactgttggtttaaggactcctttttaccctgaaaaattattggatacctcaaagagcctttgtttatgtgagttatatctacccatatatgccatataattaatttaaatggagaatttaacttagaacttaatttactttaaaataacaaaaatacaaccagtatatgttagaaataattaacataagaaaactgactatatttttccaaataaaaatatttaatgaaaagagtagcttggtttatatttttgcaaatctctgtaatgtctgtcttactagaataaaagtgcattctcctatatacttctgtattcagtctgtcatgatattttgttttgattgaagtatatgaagaaaatatggtctgacacatatataattggaaagagaggacataatggactctcttaaggaaacctggggacctacaatggttcttagattgcactttaagaaggatacattcaaaagaatgctaccattgtcatttgtgttagggttggacattttttgagaggctctggacagagaatggatgttggagccaagcaggcctgtgtaccattgctaactgagctactttctgaatctggatgttaatgtctctgggccttacctataaaatgagtacaagtctacttaacctgaatattattatgaggtttagaaatgatgtgcataaagtgaagctgattagatattccatatattagtagtttccattattggttgcatttgggactgaactcaaggtgtataagggaaagagaaggggatggattcagctgagtaagagcagattgagggaaacactaggtagaggctttgaagattaaaaaaataaaagaaagaaatatagagaaatgaatctgtgtaaggttagagtcatagcttgattgatctgggtataactgagtaaatcgggcccaacagcctttttgaaaatccacatattgctgatttacaatgtttttattctataactcatttataaagttctgaactgacttattggagtggaggacaaagacccttattcaccaagagctgtgaattcaatgggcatagttggacagaaagtaagagatgtaggtaaaatcagatggcagaagacttcattttcatttatgtatttgttaatttattttcgagacagggtcttgctctgtcccccatgctggagtacagtggtacgatctcagctcaccgtgattctcgcgcctcagcctcctgagtagctgggactacagacaggcaccaccatgcccggctaatttttgtatttttaggaaagatgaggtttcaccatgttggccaggctggtttcaaactcctgacctcagatgatccacctgcctcggcctcccaaagtgctgggattacaggcatgagccaccacacctggtcagatggcagaagactttcaatattaacctaaagatatgaaataatgataatgttctcctaattttcataacatttacaggaggcagagcacattcagaaatcttacttgttatctcgcatacagattacttcctacagttatatttgctttatgtattcatgaatacctattaatagaaatatgccagctttgagttgccttctagtgtatcttcatatagttggtttttatatctgaacttgagtttatccttgctatccgtgctatctgtaaaaggattggcctatgggagatgccatctcccataccattgccagaagcaagtcagttgtaacttatgtggagatgaagaagccataaataagagtgtgtgaatgaagtacaaattaacagaaaaactaggagaactatgaatcctgttggtttaagagacaatctaaaggctaaaggtttcacttattaaaatcaaaaggaggggctgggcgcagtggctcacgcctgtcatcccagcactttgggaggccgaggcgggcggatcacaaggtcaggagatcgagaccatcctggctaacagggtgaaaccccgtctctactaaaaatacaaaaattagccgagcgtggtggcgggcgcctgtggtcccagctactcgggaggctgaggcaggagaatggcgtgaacccagaaggcagagtttgcagcgagccaagatggcgccaccgcactctggtctgggcgacagagccagactctgtctcaaaaaaaataaataaataaaaatcaaatcaaatcaaatgaaaaggagtgttagacatcattaggtccaaacgaatctgaattcaaggagaaaacaggcttccaatccccagactgcatttccaaagccgttcttataatacaagatatcagccagtatcagcaaagtatgtgtatgtttctcaaggtactttttttagcatgaaatttcacaagaaattctcaatatttaatacaaagcaaggctgcagcaaggaagcagccttgcgttgtgttaaatattgagaatttgaatgaatgtagaagggagtgccttccaagaaccctcagagcttcatggaattgagtttgaagacccctgtaaggagactgattggtgtgtggggagtggatgagagtctgaagccagagaagcacagattatcagtgctgaacaaacaccaaagatggaccttgccctgaaatccaacatgcatatttcttgtagagctggtccttcttttcagtgacttctgccaactggaagtcaggggtttatgagaagactgtaataataaactggaagactctcttaagtagcattggaaaatgactatttctcgtgccaatactaggaacactgaatttgaggtaatatgagaatttcttgatgattctgtcaattgcataagaatcccaggcaggagatagagatttgggaagcatctatgtatataggtggtaaactaaagccaagtaattatctccagactcataaagtctactatcattaaaattcttcagcaatgtcagtgaaactcccgcattccctggagatgattcatcttctccaaaattgtgtccgcaaccagaaataactgtgaatgtctacaggtcatctttgtaatagtaatttagagggttttttttttttttttttgctatcacatcctttcttttatatttttaaatttctaaggcctaaggcatatgttggcatttctttcagttagaaatttctgtttttagaaaatcgaagcgccaaatactcctgagaattgtttgacccactgagtttaaattatatctgcctgcaatataaattattattggataagatgcttgtacaattccagtggctggaatacacaaacgctgatttaggtcatttctggcagttattgaacaaaagattgaaatgaagagattgtttatctatccaagagacaaagtgtgtcacagagtcaaatcccagcacaagcatttaacattatatttgaatttgtagtttgagaacaatacttaaggagtcctagaagaattcttttgtttcaaatcttgaaagaatatggaagttcaaaacagatggttctcttttaatatgtgaatgtgtttaattctgcttaatatgtgggctctgtatatattacaaaaaaaaaaagacatttagaaatggcttctgaaataatagtattgaactaacctgttcaggccttcctctgagttgatacaggttgagtatctcttacctgaaatgcttgggaccagaagtgtttcagattttaggttttttaggattttggaatatttcgacccaagcctaaacatgaagtttatttatgttttagatataccttatacacacagcctgaaggtaatttatgcaacattttaatattttgcataatttaatgcatgaaacaaagttttcactgtatttgactatgaccagtcttatgagatcaagtgtgaaattttccacttgtggcatcatggtggccctcaaaaacttgtgaattttagagcatttcagattttagatcttcagattagggatgttcaacctgtgtttagacatggagttgtaaaatatagttgaaccttgatattaggcgataaataccctgtacccaatgcattatcacaaaaggggaggggctaatgatgtgtcttataatatgcttaactgggatttttgttatctaaggactttgaactaggtaaccccccccaaatatggagatacatgagtcattttcatcaagcacatgacttcatttattctagtttgaaaaactcactcgtttagatatgattcatccaatctaagtgagcaggagtgaaaacgtttactacatgggcttttgccctgtagatttgcaaatggcgtgttaagatagactgtctctctttgtcacatatataatatgatacttcatttctgatcttcatgggcccacgttcagatattcactttgagaggaatatgtttatatcagttcaaatttgtcttctatgaattaattttactttaaaaataaagaaagtgccaggtgatctcccacagacactgaattttttgttgatttcaccttggcccgcacaaataactaccactgagtattctcatctggttccttgacctccataaccctgtgggaagagacagaatgagccctcagaagtgcttaactagttagagctttgcaaggccttttcaaaattctctccagtccctcccttctctgcctcacctgcttcttgagattgcaaggttttgcttccagctttctgcatttttgcaaaaaagcaataagaaagcccaagtgttacaggaaatctatgacattgaaatctctctctctgcatgtgattttgatgtttcctttttgaacttcaacttgacattgcttcataagttacatttgcccttccatttttttcctcactctctttcaaaagtttggcttcattgttaatattcctcacatacttctgtggcttttcttgtttgctttgttttcatggactctgtaggggtcaatattcagcaggttgaatgtgaaatcaggcatgcaactgcattagccatcaaattctccaagcagagaacctttttagcttcctttgcattagcagcaggaagataaagaacaaggaagacttgcagctcttttaagggtgtaggttataacccttcattcaagttgatgtttgttgatgttctaaatttttttgaagttgacccttttggcctcccctcatatgcagcaatgcatcatcccatcagtagaggatttgtaaaactgtgttttgctcgttgaaaaacataaaattgcttatagatgagaaaagaaaaaagcagcatttattcaagggcctagagacctctgctggttaagtgatttgttgagtgtctttctagttttgtttattattgaaaaggtgaaatacagtttggcctcaacagtagcaatttccttttgaattaaaattatggatgatttgaaacattgttgagtgaagatactgaggtcaagtcagctggaagagatgttaagaataatgagtagcatctcctaattaaatactgatatcaactttgattattaggtttaccttggtaggcattaccctgtagaaatgccctgtgaacacataaagttccagaatgacagctatggttatcttctgcatgactttgggctgaaggtcttctacctgaatatgtttatcattattcttaatggcatgaattgtgcttgaggcaagatttgatatttatgaagactttttatggaacatggaattaacattgtctttatatctattgaaaataaggaaagaaaatgtgacttcaatgaagtacagaaaatgtattatcatttgggcagcgggggtagtggatagcagtgggcaatgtgggaattaagtgctactttgaattcttgtgttagactgtgggcaggacttgatttcctgaggaggtttgataaaaatcagaactcatttaaagatttggggttctagggtcatattcctgtagataacattctatcaatacgaaatcaataataaacaatgatgatagtcttaaaggagaaaggaatcataaaattgatctatacaacatgtgggagtgaagtatattagtgagggacaagctaagctattctcacaaaggaggccccaaaataaagtagcttagatgaaaagtttatttctctctcacattattttcctcaaaaatggcaggtggatgtggagctgctttgctccacacagtcattcatggtccaaggctgacaggtcagcattttcatcctatgtagcttccatgtctgcacccaaggctatttcaattgctggtcttttccaatcagtgtgaagggaaaaagaagaggttacggaaaatatctttaagtgaataacccagaagttgctctcaccactttcacacacatacagttggcatgaacttggttacatagttacctctagctgcaaagcaatctggcaaatgtagtgcctacctggaaatataccagcctggttaaaagtgggagggggggtgatgggaagatattctctactgaaaggaaaaaaggaataatagatacttacaggagagggacagttaattttgccatatggatattggtagttttatccattttgcatttagcgattaaaagactacaatatgaaccacaaaaatggtattcagagtagggtataggcacctccctgaatgtctccccagtcttgttatttgcataacatctggaaaaggaattttattataagtgtacttttgccctttgattgaatatgataaaaatagattgagtacacactgaatatacacctttctttgctttttggatgcctatagctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggtaagcaagttaatggtaattgtgccttagtcttgactataacgtttaatatagcctcattgccgtggaaacgggagaatggtgaattgtttctaaaataatatgcaatgaaacagcattatggtggaaaaagtgagagtgaatgcaattgataaatagaaagtgcacttaaatccagttctccagctttcaattaagctcttgcactagatctgtggtcttcaaagattaacatatgtgactttataatgggaaagttatgcaaaaggtctggaacatgaaattgtgctaagatacaaaggaacatacattccagcatccactacaagagaaggggcattgacacaatacaggatatccatctaaatagagaaacactctgacaaagaaatctgaatgaagcaggggtagagcggagaccctgagaatgaggaacaattgtgtccaatttaattttccttatgtattttcctgccgaacctcaaatattaattgaaatttgacattttcctcaggctccaaattgagaggcagtctttcatgctcagatttcttcctccagtaggccacccagaaaagagtgcctgctcggagcaatggccctcacatgaatttacatgacaggaagagaaaggggactgttttgcctaactcaccccctgcctcatgcaccttctccatttgctggaagggctccagcttgtccatgattctgtcaattataaaagccaaactcagacaaattgcaggggtataggtacctaggtactggtattttccttcttttgtgtaattgttaccaaaatgccagggagttggtctaggtcctgttgcttgctgtgcagagagccaatcactgagagagtgagtattgccaggaaataaggctttgttcaggtgctttagtcaaagagaatgggagatcagtctcaaatccatctctccaaccaactaaaattgggagtttatgtagctggggaagggatgcagctgtgtgcaggaaggaattaggtgggggtacagaggcaattatgacagatgaagggtctggtgtctcactgtctggatgccatgatctagtgaatttgagtcccttgcttgaggatcagcctcctgaggagtgaactcagtgagaccaatgtaagtttcaagttttaaaactaggcaggtcaatttctgggtttattcaaaaacaggtaattatcatttctgtgggacacttgggcttgtttcttaatgtgagggaacatgaatatctagatttgatcaaagtctaataaagtgtccactcagctaactcacaaccctgcggcaaacagaaaactagtacctctttatatatatgtagaatggcaggtctcctggagaggaggagatcctttttgatacttatgaaaattgacacataagttgtatatcctcagagtgacaaataaggaggatctcctgtgccacgtactaactttgcccccttcagattggccgccaccagatggtcctcagcttaaatcacaccactgacagcaataaactaagggaatattaaactattaatacctacattttttagtaaacctcaaccaatattaaatatttgcctctgtttcatccaagattgtaatcctattaaccttcaaagtatcacctgctcaaaatgtgagtgttttaagcactctaaacagtaaatttagttttatttccgaaaccccctaactctggtcagtacaaagccttaaagtgaaaaagcattttaagtttcaagttattctatttagagaggatattaatctgaatggctccactattaaatcaatgagaactcaagagaatcctacaatttaaattccatttaccaactgatgtactggttgttccatttagcatctgacctgctacaaatttagctgacagataaatagatcatgttatgtaaattgcttatatgatggctgttttcttcccattaagcttccttgatattacacatggtaaaattgccttaaagtctcagttgtagaaggtcattgtttttatgttcctcttttctttcacaggatagaattcaaattgagcaaggaacactcaacataacaatagtgaacctctcagatgctggcatgtatcagtgtttggcagagaataaacatggagttatcttttccaacgcagagcttagtgttataggtgagtctttatactggcaagaaaaaaaaattaaaactctttagatcactaaactaacttgttctttgccaagcataaatgttcaatccaagaaaaggagtaaagaaatctttaggccaaagatgctactcaagaaacaagtaataagcaagtctataaacaataacaagagaacgctttctaaatccgcctcttctgatgcttacaatggggaccatgcttcccttggcactcatttttattcctctattgactgcacttctaaattgagcaaagtttttgagatgctttttggagtctgctgctgatttggtgcaaacttgagcttggagggaataagagctgacttggtttggaaaggcttatttgaacagctgacagaataaaccctgctcttccacatctgaatttttccagactgtgcattaatgatctttcttccaactacatgtttgatcgtgtgccacttcctccctcctcttcagctgcattgacctttctgttctgcatactcaccatcctcccgtcctctgcaggccactggtacatactgagtgcatcgtctgcctgaaacgcttttccttcccctcttcatttctgtaactccttctcagttcgcatcttccatcttcattggtgcttcctcagaaagtcatgcttgggtcaactattcctattacagatttttatactatcttttacctctcctttatgaaagatgccacagttacagtttacacttttttttgtgatctttctatctttttcttccactgcattttaacctccccgtgacgtcaaggatcataattggttcaattcatcattttattcccaggacttaatacagtattgaagcacatagtatgcactcaataaacattgaatgaatgtaagaatgaatgagtgtgttaaatgaaggaagaaattgagagattattttattaaatggattaatagattaggtcagtaaagaatcgaaaacatagttgagtgaaaagataaatctatggacgttaaaaaaaaaagttaagaccaacagcttgcattatcctgtagaaaaattttgaatttgtctattattataaaagaagagatgataatgacaactgaaaacacaaaaacaaatgcaaatgatttgggaactgcctcctattttagaggctttcagtagtcattctccttggtgagagcataatggaagactatgaataagagaaaaacagcacacaaaggagctaattcacgtgctctgataaattgtccagtttcagagtcctgactttcccttatgaaaaacattcattggtgcctagcatgtaaatcttgcatatagaagtaaatgttctcaagtagaatgtacttccattctgtgcaatgtaaaaaaataaaaagaaagaaaaacttccacactgctcttctcactaagttcgttagcactgactcaaatcctatcaaagataacgattgtgagatttcatggggatggagcctttttcaaagaggcctagtaatggttttatgctcttggcatagatagcatcagcatggctaggcctactggaatcctaaacacacatacttctcaccctataaatattaggaacaataattttcaaccccttccaggacacatatgatgattcccttctgcccggatttgctaactattggtacttggaactgagtcttttggagtacagttcaccatggcaggattgcttaggagtttattccaaaacaagtgtgttctctactctactctatatcagctagttggaagaacagctaaaagtgagatgtggcctaatgaaatgaatcatagtgtctgaaaaccctctatatgagcgctagccaatttatcagtctagggacccttttataattttaagagattttgtagatccctttattaaaataagaaaatttgatagaaacaaatgactccaacaaagtgagaaaagctgcttaatgatttatatctagagtgcctacccatagctgaaaataacagaatatatgtgtatgcgtatgtgtacgcataatggcttaaaaccactctgcacagccctcccctctctccctctagtactaggattcaaggcctgttagctgggaatcactgttccaacttttacattaaggagtttatttaaaaatcatttccaattggaactgtctaattacaaatgaatttttgatctgagctcttaagtttcccgacgccagcaaactagaagtgttagtctgtttaagctgctataacaaaaatactgcaaacatggtggcttatagacaacaaatgtttatttctgatagttctggaagctgaaagtttgagaccagggtgccagcatggccgggttccggtgaagtcccccttctgggttgcagactgccaacctctcactgtgtttgcacatggcagaaggggtgagggtctcttgggcctcttttataagggcactaatcccattcataaggtgcttcacccttatgaagggcttcacctcataggggcttcacctcttaaaggtcctgcctcttagtaccatcaccttagcggttaggatttcaacataggaattttggagggacacaaacattcagactatagcagtagagcagtcaagataaaatgaaaatgcctgagaaattatttaaccatgtttcacataagaacaataaaggcatgtcatcaaattatttaggccaaacaagttgtaaaaatgtaaggcttgcaggaattcaggaaagggaatttggctagggggctgggctggaaagctaagccctgaacaatttagattttgacaaacacaaagaatagtccagatcagaatgaaatggctggaacaaaggctcaaaattataaaatatctgggatagtttcctgcacatagagaatcttcagtgctttttaaagctgttgactcctcagtggatgaatgggcaaacaacatttggtatatgtgaacacagtagaatactatgtagccataaagaaaaggagaaaatcctgtcatttgtgacaaaagggatgaacctggaggacatcgtgctgtgtgaaataagtcaggcacagaaaaatatcacatgatctcactcataagtagaatctgaaaaagtttatctcaaagaaatagagtagaatgctggttgtcagggtcgggggaatcggcgggggagggttgggaagatgtcgttcaaagaatacaacacttcagttagatgggacaaatacattcaagcactctattgtataacacgatgattatagttaataacaagatatcgtactctcaaaaaatgctgagggagcggatgttaagtgtttcaccacaaaaatgataattatataaggtaatttatgttaactagctggatttaatcattctacaacgtatataaatacttcaaaacatgttgtatgtaatagatacaattgtgtctgtcaatctaaaaagtaaaataataaaaaaaataaaaattttgattcaaatacataaagcatatatcggaaaatttaaacttgaaaaagaaagatggtggccgggcacggtggctcacagctgtaatcccagcactttgggaggccgaggcaggcggatcacctgaggttgggagatcgagcccagcctagccaaaatggtgaaaccccatatctactaaaaatatatatatataaattagccgagcatggtggcgcatgcctgtaatcccagctactcgggaggctgaggcaggagaatcacttagacccgggagacagaggttgcagtgagccaagatcgtgtcattgcactccggcctgggcaacaagagtgaaactccttctcaaaaaaaaaaaaaaagaaaaagagaaaagaaaaagaaagatggagaagtcattaaggaccaattttggagattcttgaatgacaagcttgcaagttccctatttaatatcccattttcccttccaaaaattcccagtaatatatttcaggtaaattgaagggcagttaaagattgagtgtgtaaacccgtagagtctctcttaagtgaataagggagaagacatctgcctatttaaagatacatagaaattaatattggttaacttgggtaagacataatatgattgttttccacaagtcactttgttccttatatagcaggaatagtttggctcttttggatcaaataactaaattgtcattacctatgctagaatcatgaggatgctgaattgaacaaagaaacaaaatggaaacaagataatctcttgttaagattatctcttggccgggtgtagtggctcacgcctgtaatcccagcactttgggaagtcaaggtgggtggatcacctgaggtcaggagttccagaacagcctggccaccatggcaaaaccccatctctactaaaaatacaaaaatcagctggacatggtggtgcatgcttgtcgtcccagctatctgggaggctgaggcaggagaatcacttgaacccgggaggcaaaggttgcagtcagctaagattgcaccactgcactccagcctgggtgacagagtgagactgtctcaaaaaaaaaaaaaaattatctcttgataatctgtataagaaagaaaaaatatatatgttggttccacctattgattaaatatcaggaacctccaatgctatagaggagattccttttaatgttgggtgatagccctacggtcatgaataagagatggttaggaagcatatatttaataggtttttcccttggttttattttatgtgttctgtcttggtatttaatgtgtatgtaacatgtctatttaatggatttaaactgctaaataattaatctgtgtgctgggtgatttactcactggatgggcaaacgccatagagagacttttatcttgaggtcagtatattggtaggcctggttatgagtacatcaaatggaagtgtccttgtctgtgactgaactatgacaattggcagtttatttttttcccaaggcaactcctcctagatcttttctgctgtcttagcctgagtcatggatgagattcacttgtgggatatatccctgtggacatccctgaggtgctgtacaactccctgggtgataaccatcattccactcctctcccccactcatgaaggtgtattacaattagagtaaatagagtcttgtaatcatggggaaactgaatcttctatacgtaacttaaaaagtaaagataactaagttaggtattttgttggtgaaaaaataacttttctaaagtaatagttctacccatgtttagtatttgtgtccactcagatgatcatattggcgatggggactgctgattaaattgccaaacttgaaatcattgggtaaatatagaggatagctaaggtctccaaagcaagtctgaggcaagtattcaggtatctgcaattcactgaaagagtgttctccaggaaaaacctgtaaggaaaagcagaataaggaagaaggaggaaccaaacaaggatggggtcttaggtaaagtctagcctaagtctaatccagaagggagatttctggaacataaactgtacctcagacccatttccaccttgagataatgaggctagctttttaaaaaatctccatgttaatcacttcctaagctacctcttaagtggggttccagaagtggtgggggtcaaaaatctttgattttgcttatatatgtgagaatattgtgaaaaaagttttttgattttacagtgggaggagccatccctaagggtgagtgggtatctgcccagtggtcttttgaatatgacttgacttttccaggactgtataatggaggagaagtagcttctatcctgaggaaattatgtctaatggttcagtatcccgggggttctcctggcctgtgtggtggaacacatctgaccctggcaggacactcaaataccatcaagtaactgatggcccaattaaagtgaggtgcaaccttgagcgattatctggttaatttggcatctacccaggtgattggctcccaaattagaaaaacattaaggctaaactaaaagttatttcatagggactttcacaagtgctcatctgcatctgatttctcaactgcctcgttgagccaggttacaaaataatcagatgtgctgagtgtgatcagcatcgaatgagaggacacatgcctttcttacccaactgcagtcatccaggcaagagctttacttaagttgtcatgaagaggggagctgtgcacttggctctcaaaagcaaatttggtgtctttatcaagttattgatcatatacgtaccagtagtaggaggatgtcattactcatcttactgtgaaaactgacagaattacacgtgaaagcctttgcaaacctaaaggtgtttataacaatataagaaggtttgggcttttttttttttctcttagtatccataccaaacacttagagatagccatgaaatcaccagtaaatcccagttctgtgcttctcaatttttgctgcagattacaatcatctggggaactctttactatcctgatggcataccatactcgttatcaactaattcagtctctgatcctaggacccaggcatttttccttaaagctccccaggtgtgattccgaagaacaacagaatttgagaactattgctttaattgatcaggtttaaaaagccattgaattttcctaaaatattgattatcaggctttatcgtgcatcacagtaatctagaggacatgttaatacacagattgctgaactctaccctgagaatttctgatatagtagctctagagtggggcctgggaatttatatttctaacaagtgatgttgatgctgatgctgcttatccaagaccaccgtttgagaaccactatcctaaaataggaaatctgtcctacacagagggcttttgttgttgtttttaaaaattgaacatagtctccctaccaaaacatctgattttggatcaaaaagcactctgaatccgaagtacccctgtatgagagaaagagcaggcatcagagattccaaccatggctgaaggccccatttcaacaagagagtgaataggaataaagcacacagaatgtcttgacagactaccatgtgaggcttgagctaaagtgctgcatggcatgactctggtagttaaagccaactgaggggagacattgaaagctgataaatattatgataaatattatgatcatcccttacatcaattcccccaaagaaatgcagtgagtcagagtttaaaatattactctagaatgcagcctaaggcatcactgagcattaatactttatatacaatcctataaccaaaatatctgaatcttctgtaaaactgctgtgaagagatgatccatcttgaagtccttagtccttttcataaaaatatttccaataaatttctcataaaatgtagaacttctctcttaaaagaagaaaagtttgcatcttctagtaaagaggcaaagtttttcatcagtcagtaagaaatatgttatttttctctttgcccagtctgggattaatttaactctattgtattaattctagtgagattgttttctacccttcccctgtttgaattgagtcatattgtaaatgtatttactactttatgtcttttaccattatctaccccaagttctttgaatttgtgaatgaataaataaatgaagtaactatttttccccctccaccaccttctggcaaaattgattgcatttggggagcctaatctaaggagtattaattagactgacattcaagatttggtagtggggggtgattcatcaagatagtcaaaagggaagccccagaccctttttccccaatggaccagttgccattgaaagaaataaaaccagttaagagatttctgcactccagtcaagtgtaaagccaatagcattaaagcactgtagaaaaatttatggcactcgcttgctggagcacctcccactccccacagcgtagcacagagctatcagtagaaaacttccaattcctaatttcttgctggggagggaaagaaaagagtggaaggtatatccagtgtttttacttttgagggggaagtactacctaagggagtggtttccgttttgcctgaatctaagtgatgacagaaactgggctatgtgggaggccccctgagaacaaagtcttatcaacatggcttggtctggtatcaggctgtaccacagacactaggggaggtccagtaccaacagagggaaatttaatgcttcctgcagcactagaaagtccacagtacctgataaagacaccaagggaagctcctgagtagaaaccaacaaatcttcaattaggggattacatacaaaagcccagagaagatgcatcatcagaaaaggcttgagagatttgcggaatctctagctggactgattgctctcagactgcaaagactaggagaagtgtctgattttttaaatgccagaattccagcagaagataataaagcacacaaagaaaccagaagacatggcccaaccaaaggaacaaattatatctacagaaatcaaccctaaagaaacagaggtatatcaattaccaaagaattctaattattctcataaagacgctcaaggaattaagagacagtacagatagataactaaaggaaatcaggtaaatgatgcatgaacaaaatgagagtatcaacgagataaaagatgaaaatgagcccaaagaaattctggaggtgaagaatatagtaagtgaattcagaatatagtactcaatttactagagagattcaacaacaggcttgaccagacagaaaaaaataatcagcaattcaaagacagaacattagaaattattgaggcagaggagcaaaacggaaaaaataagaaaagtgaagaaagctgaagggtctatgggacatcatcaagtgcaacaatataagtgttatgtaatttgcagacaataaagagagaaaatggcagagagcctatctgaagaaaaaatggctgaaaacttcctgagtctgagcaaggaaatggattcacaaattttagaagctcaagaactgcagctaggatgaatccaaagagatctacactgagacacattataatcaaagtgtcaaaagtcagagaccaaaagaaaatcctgaaagcagcaagagaaaagcaacccatcacaaacaagtgtgcatctgtaagattatcaacagatttttcagcaggaactgcatgctagaagggagagagatgatctactcaaagtgctgaaagaaggagctgccaatcaagaatactatatccggtaaaactgtccttccaaaatgagggagaagtggagactttcccagataaacaaaagctgaatgagtttatcaccactaggtttaccctgcaagaaatgctgaagggagtccttcaagttgaaatgaaaggatgataaacaacacaaaactatatgaaaatttaaaactcctagataaaggtaaacatacagacaaatataaaatcctgtaatattgtaggtacaaaaatcacttttataaaaatctggtatagaatgttttaaaaagtataaaaggtaactataaatctatgttaataactgtacagtataaaaggaggtaatttgtgtcatcagtaacaaagtggggcagcaggatgtaaatagtttttatacatgattgaagttaaattgttgccagcttgaatagattattataactttaagatgtgctatataattacagtggtaaccacaaagataatatctatataatatacaagaagagaaatgagcagtgaatgaaaacatatcatttttaaaaataaaggaaacacaaggctgggtgcagtggctcacgcccgtaatcccagcactttgggaggctgagacaggcacatcacttgaggccaggagtttgagaccagcctggccaacatggtgaaaccccatgtctactaaaaatacaaagtttagctggatgtggtggcgcatgcctgtaatcccagctactcagcaggctgaggcaggagactcacttaaacccgagaggcggaggctgcagtgagccaagatcacaccactgcactccagcctggatgacagagtgagactctgtctcaaaaataaacaaattaaataaataaaaattaaaacaaataaaaatcgaggaataaaaatctcctcttttgaagacagaaagaggagaaagggtaaacacaaaagctacaagatacataaaacaaatgaacaaaatggcaattgtaagcccttccctatctctaattattttaaacataaattgattaaatgccccaattaaaagatatagcttgactgaatggattaaaaacaaacaggatctaactatatgctctctgtaagagacacactttagatctagggttacacgcaagctgaaaatgaaagaatagaggaaaataatccgtgcaaaccagaacctaaagagagcaagggtgaccgtattaatatcagacaaaataaactttaagacaaaaactgtcacaagagacaaagaaaaacattatataatgataaaaggactgattcatcacaaagatgtaactgttagaaatctgtatgcacctaatattagaacttccaagtgtatgaagcaaacattgacagaactgaagagagaaatagcagcacaatagtaggatactttgatactctattttcaatcatggatagaacagtcagacaaaagacaaataaggaagcagaggatgtgaacaaccctgtaggccagttggacctaacaagcatataaagaacactgctctctactacaacagaatatgaaatctactcatgcacacatggaacagtgtccaaaagagaccatatgttagggtacaaataagttttaacagatttaagaaaattgaaattatacgtaatatcctctcggactatgacggaatgaaactagaaattgatagcagaggaaaaacgggaaatccacaaatatgtaaaaattgaacaactcattcttaagcaatgaatgggtcaaagtagaagtcacaatgtaatttagaaaatatcaggagacaaatggaaatgaaaatacaacataccaaaacttacggatgcagcaaaagcagtaataagagggaggttaataatgatacatgcttacattaaaaaagaagaaatatctcaagtcaatgccctaacttcgcaccacaggcaactagaaaaagattttaaaaactgaaaaatcagtagaagtaatagaataatatatattagagcagagataaaggaaatatagaatagaaaaatactaggaaaaaaatcagtgtaaacaagagttgatttttaaaaagatcaaccaaattgacaaacccgtagtagactgagaaaagagtgtactcaaataagtaaaatcagaaattagagacatgaaacagatgattcagaaataaaaagagtataaagaccactataaataattattcactgaaaaattggataacctggaagaagtagataaattgctagaaacatacaactgcttaagactgagtcttgaaggaatagaaatgtgaatagacttagaactagcaaggagattgaagtagtaatttaaacttcccaataaagaaaatccctggaccaaatgcctcagtggagaattctaccaaatacttaaagaagaattaacaccagttttccccaaacccttccaaagaattaaagaagtgggaccacatttaaactcattctgtaagcgcagctttatgttaaaaccaaaaacaaacaaggacagaagaaaactacagaccataaccctgatgaacattgatctagaaattgtcaacaaaatactagcatactcaactcagcagtacattaaaaggattatacacaatgtcaaattggaattatacctgaaatgcaaagatggctcaacatacaataatcagttaatataatatactgcagaatgaaggaccagaaccacgtgatcgttccaattgatgaagaaaaagcttttgacaaaattcaataccatgtcttttttgtttgtttgttttttcactctgtcgcccaggctggagtgcagtgttgtgatcttggctcactgcaacctccacctcccgggttcaagcgtatctcccacctgagcctcccaagtagctgggattacagacgcatgccaacatggctggctaatttttgtatttttagtagagacggggattcaccatgttggccaggctggtctcaaactcctgacctcaagtgatcctcctgccttggcctcccaaagtgctgggattactggcatgagccactgtgcctgccctaattcaataccttttcatgacaaaaacactcaacaaagtagagaagcaaactacctcaacctaatgaaagccttatatgaaaaattttacttctttcctttccaatttggatggcttttatttatttacttacttattctttgtctaattgctctgcctaggacttaatactaggttaaatagaagtgctgagagtgggcatccttgctttgtttctgatcttagagaaaaagctttcaatttttcactgctaagcatgatgttactcatccactttacagtcagaaaattaaaaatggaattaccatataatctggcaatcctaacatttggtatatattcaaaataactgaaaacagcatcctgaagagagatttgcacacctatattaattgcagtattattcacaatagtcaggaggtggaagcaacctaaatgtccatggatagttgaaaggatagaggaaatgtgtttaagtacatacaatggactattatttctgttatgtattacaacatgaatgaaccttgaggacattatgctaatgaaacgagccagtcacaaaaagcaaatacttcatgattccactttgtgagatgtctaacatagtcaaactcatagaaacagaaagtagtgttgttaccaggggctgggagagaggaggaggaaatggggagttgggtaatgggtatcaacatttagtgttgcaaaacgaaaacattctcgcaatgagttgcacaaaagtgtgcatatagttaatactactgtactgtacatgtaaacattgtcaagatggtaaattttatgttatgtactttttttttctttttctttttttcaatttttttagtatttattgatcattcttgggtgtttctccgagagggggatttggcagggtcataggacaatagtggagggaaggtcagcagataaacaagtgaacaagggtctctggttttcctaggcagagggccctgcggccttccgcagtgtttgtgtccctgggtacttgagattagggagtggtgatgactgttaaggagcatgctgccttcaagcatctgtttaacaaagcacatcttgcaccgcccttaatccatttaaccctgagtggacacaacacatgtttcagagagcacggggttgggggtaaggccatagattaacagcatcccaaggcagaagaatttttcttagtacagaacaaaatggagtctcccatgtctacttctttctacacagacacagcaacaatctgatttctctttcctttccccacacttcccccccttccactcgacaaaaccgccatcgtcatcatggcccgttctcaatgagctgttgggtacacctcccagacggggtggcggccgggcagaggggctcctcacttcccagtaggggcggccgggcagaggggccccccacctcccagacggggccgccgggtggagacgctcctcagttcccagacggggcagccaggcagaggtggcgctagacgtctaggtggcacttcctagacggggtggcggccgggcagaggctgcagtctcggcactttgggaggccaaggcaggcggctgggaggtggaggttgcagcgagccgagatcacgccactgcactccagcctgggcaccattgagcactgagtgaaccagactccgtctgccatcccggcacctcgggaggccgaggctggcggatcactcgcggttaggagctggagaccagcccggccaacacggcgaaaccccgtctccaccaaaaaatataaaaaccagtcaggcgtggcggcgcgcgcctgcaatcgcaggcagtcggcaggctgaggcaggagaatcaggcagggaggtcgcagtgagccgagatggcagcagcacagtccagcttcggcatcagagggagaccgtggaaagcgggaggcggagacgaggcagagggggagatggtggaaagcggaatagggagaggaagagggagacggagacggagaggtgtactttttaccacaatttaaaaaatagaagatttagcagtatttttcaaacttgaagactcatatgtattacttgggaattttgttaagtttagattccaatttcaggtctgaggtagggcctggaattctgcatttctaacaaacttcaaggtgatgccagtgcttctgctctagggatcacattttcagtggcaaaaagttgtgaaatcatagatctcttctctgtcttgtagtggatggagttccggagggtgtacatttaacaagcttctggtgatttttatggtcaattaaattgagtttatttgaggtgccacagatctgtaatctgctttctagatccctttcttacccattcttaagccatcacagcagagtacctttctaacttataagattgtgtagaggttggaaggaggacaggactgttctgttggtataatgaccctgtgtccagttaatccatgcttccattgctacattatccaagagtgcaacatgacccaacaaaacctctatcagtcatgtgaggcattttttttttaacagaagaagagcattggcaccaacaatattccatctcttctttttccagcatgagaagaccatggttcttctagactcctaaagaaagtcatttgtacttagtgtaaggcgtgttgcttttggtaaagtcttttgaatgtgatgaaaatgaacatagcacaaaggcaaaatatatgctctcattgcctgcaaaactgtttctggtgctttattgaaagagcatgataagcaagatatcagtcactgccgcattgcataaacatagctcttctacattgtaatatggttctggtgagcctgcatgtctagaatagagcctgtatcactgaagtgcatgaaactgctgtgataacttgtctcacaaagcctcagggaacacattatttgagcaagtaaactcaaggtgaagttcttaccttctcagtcctgggtcagctgttggacatactggggaggaaagaggagaccatgtgcttctgccgaacaagacccaaatctggggaaagctgaacttccagggtgcacttgccctgttaccttctcctaagtacatgttgtgggaaaagtagggaaaggcggttagctgctagagctagctcagcagcaggagctcattctatgtatctcttctcaacccagcgttcagtgacttcatgttgatagcttgaaattggccaaggtaggaatatttacaccacagaaattggcaaggactacaaaccaaattctttggtgttttattttattgttttgttttatttagagagccacttgtaaaacatttactatcacaccagttcagatgatttagtagtataaacagcccatgtggtatttcttggataatttgtttcattagactgaggtacaactccaaagaggatgtcatgtcctgtacacaggactggaagttcacgaagccattcataaccctatatgaaggggagaaagagatgtagtgttcaggcaaagcctcatgagacgggaatttcctgttttgaactgaatccctgatttctttcctgcaacatacattcattcatcaaatattgattatcaacttttttataatacacaaaagggaaagaggctcttacttgaattatgccagaagtcagacaaaagaaagattgttgctttttggctggtcatggtggcttacgcctataatcccagcactttgggaggccaaggcagtaagatgacttgaagtcaggagttcaagaccagcctggccaagatggtgaaaccccatctctactaaaaatacaaaaaaaaaaaaaattgccaggtgtggtggcacacatctgtagtcccagctactcaggaggctgaggcaggagaatcacttgaacccagaaggcggaggctgcagtgagccaagattgcaccactgcactccagcctgggtgacagagcaagactctgtctcagaaaaaaaaaaaaaaaaaaaaaaaaccagatcgttgctttttaaaaattgacttaattcttcaataggttcattgattaaatatcaactttgtatcaagcaccgtgccaggcccaagggatatacagatccaggatacatattcttgccttcaaggaactgatgttctaataatagctaataacaagagctactatttcctagctactgaaattctagggttctcactatcatagtctaatgactctcttctgttcatttagcagacttcgcatactgtacactacctgcataaccaaggacttgagtttgtataagagtttaagacactgacatgtaaatgaaatatcaccaatttggactgatataagaaagtcgatgtgattacagagtgtttaaaatgcagactgtcttattatctttatatggataggatgggtcaaaggaggttaacaagaatttagcagctgaagccctacttaaagcattatataagaattaattttaatcaacatgttgattatataagaaataatgttctaaaatgtctttaaaatatttttctgggaataagagaaaacctccacctatgtttatgtaactgatttttgagttttcaagtcttttataaaaaaaaataaaaggccatacctaatcctacttgttggcagagaaagatgagagatcttgaaatggctcccgtgctcaaagtatttgtcagttttcatagagcccgaagtgccgatattgaagatgtatttcttatccataccagcatgtaatactcagcaggaaaaaggaacaaaaactccaaaaggtcacatactgtatgattacacaccacacacacacagactctctctcacacacatatgtatctaaaacattctcagaatgactaaactatagtaatgggaagaggtcagtggtttccaggagttacagaggggaggtagaaggaggctggatatgactgtgaaggggaagcaagaggaagatccttgtgacaatagaatagttccctatctcagtttccatggtgcttttgcccagtctacatgtgtgatacatacacattataccaagtatcagtttctttgtttttgtatttaactgtatctacataagatgtaaccattgggggagacggggtgaaggatgcacaggacctttctgtattatatttggtactttctgtgggtctataattatttcaaaataaacattttctgttttcaaacaatgatgtgtttctcggactctaagaaaattttcagcagaagaaaagtccgtgataatggtgactggggtagtgcagtagtggaaatagcagtggagaggggacgtatgaagttcttaatctggatcaaatactgtgctaagtactttatgttcaatacatgtattattttatttaatcctcaaaataatctcatgattgtaaaattcttttgtttcataataacgcccaaaggaataggagtttttaaacccaagagctgcccgtggaagaagcattattagagccatcaggaaacagggcattcagtgaattagaccgaaacaatagaaggatggatattaggaacactagaaggggcacatcatgctaacatcaaaatggaaaaatcatctacttcagagttgtgttgagagtctccttgtgaatatcattcataataagagagcactgacttgttttttaaaagacagggtctcaccgtcaccaaagctgcagtgtagtggtgtgagcctagctcactgcagccttgaactcctgagttcaagtgatcttctcacctcagctttccaagaagcaagggctacaggcattcaccactacacctggctaatgttttattttttatagagactgagtctcactgtgtcaccgaggctggtcttgaactcctggtttcgagtgatcctcccgccttggcctcccaaagtgctgggattacaggcgtgagccaacacacctgacctcagagaaggctgatttttgaatcagccattctaaaacagtggacctagaaagaagaaatcttctaccagtagccttctttctagatagcaatccaacaggccaaaagaaatttggggtctcataatctgataccaatattttctcctcagtagtgaaaagatttgaattaatgcatttactctaagcttgtttttagggaatgatgaggtaatagttaaagaaagtagacaacggttaaagtaataagaaatgctgaacttccaaaaaagctggccttaatattctccatcaactggcagtgttcccagtgatgcttctatcacagactgtgatagaactggcattacacaataatcctttcttcttcaataatgtagtaagacatcacatccatatatttcccaaataggactgccactgcatatctagttaaggagctatcattctactgtttctcttgagaaatgacactaaagcaaaaaacttttaagtttttgaggggttctattggccacttaaaatacccttgatatatgaccaaaattcatttaactaactaaaaacaaatagttgtgaattacatagagggcttctctcagccagatgcttctcatagataatctaataaagatcattgaaaaataataaaaagttgcatttctcacatggaggaggacccataatacagttcattctaatactgagggagtggtgccctctagcagtgcatgtgagaaatattatcatttaagtatattaaatacagcaaataaggagctcccagtatctcagctactctcagacataaggggcaatttgacagttctgagctactagaaactactgaagtttcacttccatgtgcactaattttttaagtgccagcgaaggttagattctaatagtgcccttctggggatttaccaataacttttaaaacctcattacctgtgaatgtcaaatagaacaggtccctttcacttttccttcaaacctcccctaggtcagtgtttgaggatgagaataaagggtacaaataggaaaaaggatcatcctacaagctgaacagcatctctggtgcaaaagatgctcacaaaatgggagaatgttaagaaatccattaatagctcaagtattcaaaaactgatggagttctgacaattttcccttaaaagtaccacagtttatggttacaactgataaatttgcagggttagataacttcagaagctaattaagtaaattgagttaacaaaagaaaagaacttgattttttttttttttttttttttgagacggagtctagctctgtcccccaggctggagtgcagtggcacgatcttggctcactgcaatctccacctcccaggttaaagcgcttcttatgcctcagcctccccagtagttggattacagaggtgcaacaccacgcccagctaattttgtatttttagtagagacggggttttgccatgttggccaggctggtctcgaactcctggcctcatgtgatctgcccacctcagcctcccaaagtgctgggattacagacatgagccatcatgcccggccttgaatttttaattccattttaattagtgaaagatgttccagccagtcttatctcgataagatatccaaaagattatatgcacaccaatagtacattacaaatgcttttgaaactgaaaggtgtgttttctggtttctgtgtgtctgatatgctatttcaaatcctgtaaaagcaaaatgtagttttttgacaaatatgcccatgtgttgtgcacagtttgatttatgtaaactcatttcaaatgctactgcagaatttctcctgaatggatgaaaaatgtccgcctaaagtgataaaattatatgtgtagaaagatacagttttaagaagggatttttatatgatacagatttgtaactctatttcacaaaatatcatttaaaaaaaaacttcaagaatacctgactttttttttttacatttttctgtcagttcaggggtttgcattgagtttgctctgctgaaacacttttctgtgacttagcttatatgggattggtaagtaggggaatgatgtcagtataacatagaccctggatttgttcaggtattttactaagtagcagcaaccaaacacaaagcctacgaacacagattaacacagctagccaagggaaaatacctactgcacatgattcccattcatgccacattcttcctgttggtgcagtgtggccacgtactccaacatgggagtgcttattgcgtaattctcaatctttctgcaatttgcacttatttcatagcttagcaatctcaactcttccttctttcttccatcaagctaccttctcatgcatgtgcacacacacatacactgtattttttgtagtagttattatgaatttaacttatctttttaatcatgtttatatttaattatgtttgataattactaggatggttattgtttttgtagtgttctcgttacataaatattgagtaggtgtcctgaccctatctttttcataaaccctacaatttttattgcatgattttgcagaccatagaagaaatgcgtttatctcattaaagcaaaaacatctgtacatctgtacttgcactctacttattaattgcacttattatcattgaattactcccagaattatagacttccctcataaatctgaggtaaacagattgagatatcaattgcctactagattcatttttaaaattttaccttcgcatgagaataccagccccaggtgtacattgcatggccctattaaaaagtgacctctccatctttatttgtttctaggcagttaccgaaagtatttccacaacaaaagaatgtaatcaagatttgacttgcttccactgaagcttactttcatttttaaacatcattagcctatgatttaggaacttttaagaaattggcccccattaccccccaagcccccgcattcacataacacacacctcaagttctcctttaagtaatttgtgatttatatttcaattttacattcaacatggtcttaaatattaaattccaccaggtcaaactgcaatgagtcaggcttttaaaatatgataaaattaagattccaagaaatgaatccttccattccaaaatctcttcttgcacattaattcaattaactcagaagaaaatagatattttccaggaaaaatgtcttttattttacttttgtgcgaatacaaatatgtatcttttgttttaggaaagaaataattctctgatagtatttccataggactatgttactggtgttagcatgagtgaattttttagaacgctagtggtgagcatataatagagctatctcaacacctacactccaagaacaagtcacagcttctcctaaatgagccaagcattgcattgggcacttgcagtgaaaagctaaacaaaaccctgtgtttaagaagcttacggagagtgacaatagagacagttcagcatgttctctaatagagatatatatgaagagtgctatgggacaaagcagaggtggcgaccatatcagagagcaaatgctttaacctacacaattaaaaaaaaaaatcttatggcgttcctaattttgtttctttccctttcaattttctgaaattttaaaatgtttgttcacttgaacatacaataaattttctttaaaagagtccctcaacagggagatgagaatattctgtgtcttgatcttcatggtggtgtataccaaattcaccaaactgtacacacacaaatgtaccttttaccaaatgcaaattatacctcaaagtttactaaatccatcaaaacatacagtgctacatactttaaaaaaattagcttcctccctttgatgaccaaggtagcaataagtgtattagagaaagaaaaagatgctgggtgtggtggctcatgcctgtaatccccgcactttgggaggctgaggcgggcggatcacgaggtcaagagctcgagaccatcctggccaacatggtgaaacgccatcactactaaaatacaaaaattacctgggcgtggtcatgcgtgcctgtagtcccagctactagggaggctgaggcaggagagtcacttgaacccgggaggcggaggttgcagtgagccaagattgcaccactgcactggcaacagagcaagactctgtctcaaaaaagaaagaaagaaaaagactaaggaattatctcatggaaggctgtcttgcataataattattttttgtactgtctttcagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaaggtactgtcttgaattattttcaatatttggttaacctgtaaaaatgtgttggtctgttattaataattctaaggggaaggtggggtgactatctgctgttcctgaactaagtgttaaaaaaagaacagaagctttggaaggatgagtggtaagttattgatctttatagtccttctggatttgggaattctacaaagcactccgtgcagagatagatcacatgatccccgctgaagactgccagagctgcctgaagatgaacagttagaaacatcctccttaatttaagcctgaaatttttgtagatttccccacctttccccatcctaagtcctttggtatatgtaaataagcccatgtcttatttgctatgacaacccttcaattatttggcagtggctattatgtctcctgttagtttctccttttttgaggctgtctcaaaactcattcaaaactcattcttttcaaaactcatacttcaaacagcagagtgttatgctttttatttcaactacatatttttgagaaaacaggttttttttctaatatctaaactcttcatctgtatatttcttatacatgaattacatttagaatgcatgtagtgtatacaatgcaaatatataggagttatttgaggttttacattagcttgcacgaaatggcaggtgtctctaagaccttttcttggctgtcacccctgtaaaatatcccctacctttttctataatctacttaatctgttgcaaaatggtaattatgcgtgaatctgtttgtcacctataagacaggatttgccagctgtatatataatgattttaattaatgctaaaggtcaggtactcaaggatgcaagaaggaagcctataaaaatgtgtacgtatctaccctttacacctgtacacctttggatttgcatatacatattagacctgatgatgatggtgttgtccattttaatgtaaacctgatatggtttataaatggtgtattcatactttttttaacacttgctatggactaaggagtaacaaatgtattaaatttgtggtatacatccctttctgatttctggtgtatcaagaaagcagtgtagttcattgaatgttgacatggcattcaaatttgtagccaaacctgaaaatcaatagcataattgcttattttgcagtcatcaacatgagattcattttctgttttatttacttcagtgtttcttaaaatgtggcacgtgagattacttttaatagctatgtacttacttttaatatagttgaaatataactagtatgtaccacatgtatttctcagaataaggctacattttaaaagttttaattttaaaatgacactaagaaaataataatatgggtattagacatgtcaaaaatcatgaatgaataaagttataataacactgtaggtcaatcaggagaagctaagctatgctactgtaacaagcaaccctgagttctggcttataacaacaaaaggcaatttctcttttgcacctagtgtacatcaggggtttggtagtggctctgctcctctctaaggccagcctggtggaccaagatgctctggacgttgccattgcagaaggaaaagagccaaacatgcatgggttcttaaagcctctacttagaagtgcaacacttgcactttcactcacatttcattggccaaaacaggtcacatgttcctgcaactcagcagggaaatataatcttgctatgtgcctggaagaaaagagacaacctaatattttgaacagtattaatgactgcttacaactgctacagcttaaccattgttacaagctaattaaattacctttggggaaatagtatgccagtatcaagaattctatatgatatgtgaatttaattgattgtttccaccacttgacttaccacaaagcttgtctttatccagatttcattctatctattcctgacttgactaataaggtccaaatatgcttcaacatttattttgcactaaaatatatatttaaactgaggaaactccccatcattacctaattcctgctatttatcgcctccaccttctctgtcagcaggctagtcccaaactatcaatattagcacttattctccacatgagtgctgtgttctcacagttctgatcctcgttcccacctcactcagaatgtattaaccagatatgatgattttgttaatgtaaatgcattaaaaaactggccaggtgtagtatataggggaatgctggggacttcagtgtttgccccatccaagggagacacctgccactcagccatatggagacacaggtcaggtgcctgctcatcttcttgttcttcaagagaaactagaaatctagacttttgtttgagcttccattttttaaatgtcagcaactaatttttattttgatgatgtacaatataaactgtgtgcttatagaccaagtttacttcatgagccacgggtttttaacttctgagaacatgaagtggaacatttcatagtttctgaaatgggtgaacaataagaaagattttatgattgttttctcattggcagagaagagattctgccatttttctcatttctttctgatagagaagagggaaaattaagtggatgagtgagaaaaagcaattgtagatgaaactgatgagtaaaaaattttagaacccctattttgggaaaggattgacctggtagaccaacatgaagtgcaaaattctttgactacacagctttgagtaataatttctaatgcactgcctcattagccttaattctcttttcagatgtagaatcttaggaaacaaaaggcaagtctttaacctttgattaaaaatattattaatcccttaagtaaaaaatactggcataacacagtgaaacaacactttatgatcaagccccttttattaatgttctgcctagattctgtgttttgaaagactttgctaaactcttacttattgacatttaatttcaattttaattaatcaactgcctacaaatgagtttacagtagtggtattagaagcaatattttaaaaattaaaaaggttttgtctcatctaaccatgtggtgatattgtagttagctaagtggatatagattcagaaacactggtttaacattaacatgttcgttatcttaaaaatatgtttaaaatatgttattgttttggcttcccattcttttggaaatatacagcatattcacactagccttatctatgttaatccaagcatctaaatgaaagattgaaaagtcaagtaatttcatagcattcttcttgggtaagcagaatatccataaacataaaacatttcttattgtcttgtgtgtgtctccagcaatcagtgtaggcaatatcaggcatttaaaacagggaagacctgtcacacagctcaagagctttagtcctcaggagaggtctctagtcaccataaaggcagttggaatcatttggatgaattgaggaattaagcctactaactgaataaggttgattattttatttactgttagtttttagacagaaggtactttgaggcaggtaagactgaagttgacctattaaaaacaaaaacattaaaatacagaaatagcagaatcattaataaaaatcctagaatcctaggattataaggagctatacaacaattgtatcaacccagggtggatgcttttggttacaagtaagagaaacccaactcaaaaggacaaacgagaattcattggctcatgtatttgagaagatccaggatggattgcaactgcaggtatgacagggcttaggtgctcacacagtatcatcaggactctgtctcgctctcttcctgtctcacctgcacctttggctgttttggcttcttttccaacaggctctcctctcctgctagtaggatgactactggagccatgtactcaccctcttttccaatgtatcgcaatgtccactgatcaggcagacgtgagtcatgtgcttatcctaagaggcacatggggaagcccatctcaaaccacatggactgagaatgggacaggggttttcccaaagaaatcgagctgctatcaccagaagaagagggaatggatgctgcgcagaggctgatgccaaactcccaccataattacagagcccatcttccatgccagggcagggatccccacaatggctgggcccacatccttccctggttactaataatgatggagaccttactaattgttagattatgtccttgcaacttccactcatttttggtttcactttgtggaattttactgacaaatcagattgttctccaccacccctcccttccctttctatactgggaggctaccctatgttctctttcaattcttttctaagcccagatgtcccccttgtatctgattttcttcagacagcgttgtttggcatcctctcactgttttggtcatttccaagcggttttaataagggaaaaagtagctttatttatctccacagaaaaggatgatgattattattgttatactagagagaaaaaatgaccttcagcgagtttggattagtaaggcaagcaagtgaatgatataacatagaaagaccactccctgccaatgtttatttttaaaaattaatgtggtgcttagacaagaaagtttagttgtctggaaaaatcactgagacaaaatattttacttttcaccgaagccaaataaattaataaactgtcactctcattaatgttgagtaaataaagtcttcttattcttatgcttaagggtttccccccacccttttaaatattagactaatacattatgtcaagcaaatggataataagcaggtataggtacgccactgaatttttccaaaaagaatctcacacctacagtctgcatgtcgcaggcttgggtttagaacagcagcatgactctgttttgtgaatctagccaattccagtttcattccatggatgcagcactcactgggtatttacctttgcttagcactagagagagagaaaaaaaaggagacatgaacctagctagccctcacggtgctcatagactagcgcagaggcccagtagcacaatatcaatataaatttttcaacaatcctgaggcatatgttataaaggtgatgtattgagaaggactactggaaaatgtagggcagcgatagattgtggaggccttgtattttatgtctgtggagtttagacttgaatcagaagaccatggacagaattgaaggattttatgcaagggagtgtgcagtcatatgcatgctacagaaaaattactgtgcctgcaacatgcagaaggaatcagggtagggcaaggttgaggatgcagagagggcaattccaggtagcagtctaggaagaaaatcacaacacgtggatcacatcagtctcctgagagtgaaagagagaagggtgatatacggactattaaagggtagaactgaaaacacttaatgacctagtaagtagaaggattgaaaaaaggaggaggaaaaagaggaaatgcctcctaggatcccatctttaggaactgacgaatggcagttcctaataccacttgccgcagtagtaaacagagaaggagcaagactgagagggggcaaataaagaggttactgttagcatgttgaatgtgaggtgcctgcaagtggtgacgtcattcaaacggggattcccattcaagtgtcacctgctcagagacacttttcccagtaacatacttaaaatggtaaaaccctcaccttcttttcctaatttatatattttatagtatttgtcaccatcccacatactatgtattaacttttaattgtttatttatttattattttttagagacagagtcttgctccattgcccaggctggacagcagtggtgagattatagctcactgcagccttgaactcctgggcaaaagcgatcctcccacctcagccccctgagaagctgtgatcacaggcacatgccaccatgcctagctaatttgttttgttttgtttcgttttgttgcttgtagagacagaggcttgttatattattgcccaggctggtcttgaattcctggccttaagcaaacctcctgtctcagcctcccaaagtgctaggattacaggcagaagccaccacaccttgcccacattttaaccttatcatcgatcttctccaccctccacccattggatcgtaaattccatgagaatagaaatgtgtgctgcatgtgcgtgcatgtgtgtgtgtggccggggtggggggtgggagtttggcttaaacagtacaaatttaggccgggcgcagtggctcacgcctgtcatcccagcactttgggacgtcgaggcaggcggatcacgaggtcaggagatcgagaccatcctggctaacacggtgaaaccctctctttactaaaaatacaaaaaaattagccgggcgtggtggtgggcgcctgtagtcccagctactcgggaggctgaggcaggagaatggcgtgaacccagaaggcggagcttgcagtgagccgagattgcaccactgcactccagcctgagtgacagagcgagactccgtctcaaaaaataaataaaaaataaaaaataagtacaaattgagattcttatagttctggagataaaaattctgatatgggcctcattggtctaaaatcaaggcttcagcagagatacactcattctggaggctctaggggagaatctgtttccagcttctacaggtcacctccattccttggctcgtggtcccttcgctccatcttcagagcttaatgaaaaagtgagggaggcaagtcttaatcggtagaggtttatttcgccagggttgaggacatggctgggaaatacatacgtcactggagcatctgttactggtgctcttccaaaagggggtttgaggatttttcagtatttaaaagggaaagagcaagcaagagagaaaaaaaaggagggagggtggacaaagatgcagatgcttacagtctttatttatttatttatttatttatttatttatttatttagagacggagtctcgctctgtcgcccaggctggagggcagtggcgcgatctcggctccctgcgagctccgcctcccgggttcacatcattctcttgcctcagcctcccgagtagctgggactacaggcacccaccactatgcccggctaattttttgtatttttagtagagacgaagtttcaccgtgttagccaggatggtctcgatctcctgacctcgtgatccgcccgcctcggcctcccaaagtgctgggattacaggtgtgagccaccgcgcccggcccagatggttacatttttatgaggctgtgatcggcctcaggaaatgtacattttacgtgtgaaaagagggcatcaaggaaaaagtcagttatgcattcgtcgcagggtcagccaagggataatttctggttttgtccttttcctctccgtgggaagataagctggtaattgacgttgtcagggtgagattcaacggaatttggttttagggctagtttatacaggggatatgtatcctgaaagatttaggggctcacaaggaatttcatttgtgacgcaggccatctggggagatacgtggccttctgtcattgtgggaacctggcttatgggtgaggctgtgatacagggttgtgaaattacagctatcggtctgggaacaaaaggaaagcagtgttgcgtgactcagttcccaagcttaactttttctttggcatagtgagtttggagtcccaagattctattttctttcacgctagtaaaggcaagttcttcccccatcccaccactctgacctctcttctgcctccttcttccattttgaaaggccttttctattgggctttctgtatatgttttattccgttctttaacactacaacactgcctggcatagcataagtgctatgtgagtgtccaataggaaactggaagtatagatctgagttctggaatagagacagagatacagacatcagtagataagaagccatggagtgcattggagtgcatatgttcatccagagagagttctacagaatgagaacatctatggctcaaaggaaggtaccctgaggaacagacacattcagagaatgagcggaagccacgcctgctgggaggtttgaaggagactcaaagaggtgggagaacatctaggagaaagtaacaaacagaagccaagggagaagaaaggtgcaacaaggagtaagcgcttggtgcttccaagaccctcaaaaaaataatggtgcaagcatgactgctggatttaggaaccttaacgttaccttgggcagagtacttttaggccactgtggaccagttttgaagacacaataaaattgtataaacatccatattcttaggcatgtcttgccaaaccgaaatacatgtttaggtctgcctgacccctgcagtgtaatcagatcaagtctagcattctgtgaaaatatccaactgaaataagaatgaaattcatgctcatgtgtcttgtctatagacactggtatctgcctccaaagtgaaattggatcataaccctaatttgcctctcttcccaaaggcttttggaagagttgaaattcatgtaagacatggaaggaaatcccagtgcagggctgcacaactctgtgttgcacacaaggtgtgaaacccaggtccaaagacgctggcagtctgggaggcaaagcaaatgtgatggcaggtatttgcccagaaggccgatggaatcctggtgtggaaagtaaagtttattgcttcaggcattctgtctctgttctggaggcagagtgtctatatatgtgctcttaatgagaaacctgccctcaggatatctcttacagttgctgcagagctataaagctctgttattaggaattctgccctggggaacaattatgttattgcaataattagaggcagttcatctccataataatggaaatcctgccttgtaggcaaaacaacatcaaagcaacaggagcgtcattgctctagttagaatctgctgccctgcttattggtagtactatcattttaattttgcacatgcagttacgaaagagagcttataccgctcttcaaattcagacctagaacttcttgccgttacttcagtttgtctctcctagagccatggataaaatagttacggcgttgagctctcctgaagtgcagttgcaaaagtgtttagggagattggtgttttaaaaatgtttgtcagaatccacaggcccagtcctctgggagaccccataaacttaccctcagccaaagccttttctatgtgggtatagtatggcatgttattttatggccagggttaaaatgatgactaaatccggtgactacctgagatgggtctgaccctttgctctagtcatgtggcatagtaataccagaagacatacatgtggttatataactcaagacatatatatggaatttgtatatgaagctgctttttaaaaagtgtccaatctaaaggtaacatttgattttcaaaaaaaaatcttttgaagtgtctcacatattaatcccttccttgcaagtaagtcctttgccactcccctggttttcaggccttattgtctcttgtgtgaattttgcaatgattcaaccaacctcttaaatgatttcattggaaccagccctcacccaaatcttctacaagatgaaacttaccacaataaacctctgagaaattcaattgaatgaatatctgtcacgtatctccctggtacaagatgtatttgagattatgaacataacctaatttaaatcaaggttctacatgtgtcacggaaaagggacgaaacagtttcttccatgatttaccagagacttttttttatcttatcatagttataaacttcatatttacagctattggttatttaattaatgttcattttccctaagaggctgaaagggccatgctgaaaagtgccatttgtgttggagcatacaggttccccagttccttgtgctatacctagagtagaatagacactaatgttcttgtatgaaatgaatgaaccaacccaaatcgtctgattcttggaggggattgaggagaaggtggtggtagtatatttaggtgcaaggagcagcgggaaagaaatgtatttgaaaggaaagtagagtgaaaggtttgagcaggaggagataaaactgggacatctctcagaatccagttgagaaaagcattccatggcaagctaagaagctggcatttcactgggaaacagagtgaagtaatgattttgtcttggggcttcacacttccttttaagttatctcctgtcctccatcggttgagttcagtgtttgtactcaggtagtgtctgccgtgacttaccatgcacccacctgggaaagcatttcaacttcctaaggcagtgtttctccattcctagagcaaagatccagtggttgttcccaaatttaggtctgcagctcagtgccaggctgactgcagcaaaatcaactgagatgtgttttagaaagcagagtcccactctccatcttcaaagatgctttctcgggaattctgagatggggcccaggaatcagaatacttgtttcccataggattttaatgcacactcaggtatgacaacgtagcagtggcttcccattgacttcaggatagacactaagtcttatgagatgaccagtaaggctctatatgctactcaggctcctgcctgctgtctaccagctgtctcacttcactcacctttaccctcagtttttgagccacacggaccttctctcttttcttcaaatggcttcttcttcctcttgctgcaaagcctgagaacgtgctgttctccttccctgaaatgctcttatccaggccttgaaaaactaagtccacaggccacatccaaccctccacctgtgtttgtacagttggcaagctgagaatggttttacatttttaaatggtaggaaataaatcaaaagaaaaatctcattttgtgacacgtaaaaattatgccgatgtcaaatttcagtgcccacaaataaagttttactggacaggacacagccatactcattcattcacaaatggcctgtggctggcggcttttacactgcaagggcaagattgactaagtgggactgagcctacccagatcaaaaagcctgaaatatttactctctggctctttacagaaaaagtttgccaaactctgatctaactcatggtacatttctggaaatgtggggtattaaaacatcttcatagtaacatgatcttcccccaccttgggttttttgtttgtttttggtttgctgtgccttttatttgttctttgtgacttacacttttgattaaattgtcacttccagcatgtccgtcttatgcaaagcaaaggggaagtgaatttggtgggaggtccgaattatctcactttgctctctagagcagtacctcccaacttttgccaggaagaacttcttttcatgcccccaaaatctgaactccctggagaaatcagagcccaagggagctttaaatgtgaagacacagagggtgagggatggtggcagtggagagaaaagtagatacctggtcatcttccccatatttctgaacaaccagtaaaaaaatgaagtaatgggaaatctccatccttggttgaggatccatggttttacgtggactattttatacaggtgctttaagtttatgctgataaatatttatgaatggtctagttccgttggggaaggaaagagaagacagcaatcacaggacttggtttctagagttttataaaattcagctactgtgaccatgtatacacacatcaaacaatttagaaaccaccagtgaagcacaaattaacataatatagtccaaacagaatccacagcagtgcttagggaacagactgggaagagactctcagtcaggcagagtctgccaaaatcgacttccaacaggaagtgagtttaagcctttgtgaaagaaaatgctccacagagagaggaagagagggaagggagaagtctccatgctggagcccatgtacgtgcagcaagtcatgtacaagaaatgaggggaagagagggactcagccagggggaggagttgccatctgtagcatttagatggaagaggtggaaggacaaacatcaacaggaagaagctacaggtttaactagagttgattaacactgtaaaataatatgaatgaatataaaataatagtgccagaaacacggtgagtcagcttaactgtgaagaagtttgggaatctctagccattaagtagaaatgagactttgatctctcgttatatcactaatgtatttttgaatacatttgaggctttggggatccttggggattcaggttacttattactttggctctagtcctgtatttcatggttatcttgtggccatttttatctctgtaaaaaaaatgagcattttcaaccccccatctgtcaataataatagtaacacccagcgcttgttttttttttagtctttactatgccctctgcttaatttcttttaatcctcgtaaaaatgttatgggatcagtcctattattgggactccatctttcagataaggaaaccaaggctggaagaaagcaatttatttaccttacttaaggttgcaaagcttgataatgttaaatctggaattcaaatctaggtctcactcattgcatctatgtctaccaggtttgcctgaggaaggaacaagcactagatgcttctttctaagctttaaaagggagataaagctttcgttacctccctggcataggactggcatagcagcttttcctgttactcatttcatattttcagtaataaactggcagctttcagatccatagctttatcatttcctgagagggagagaggtaggatggtctgatttcagggctgggttagaaccatgtaaaccctttggagaagaggtaaattaagtccttgaactacctcagccgtgcctttgttcagagaaaatagctgtgtatcatcaagtggagttaagtgatcatgaaaatattcaaaccaaagtggcatgtcattaagagcaattagaactgaagtgatgtgactggatattaaaaccagacaggcagtgctttgtgccttctcagtagagacaaggcagatgatttgggttcctcctaactttgtcatctctagaaataaaatctgctagacttcttagatgtattgatgccatgtaaatattgaaggtctgggatcatatactaagtttgacccctatatttccattatagagttttctcctcatatttcagtcacagatatgccagagttaattagatctctactagtaaatatccatcatgatgtttctaaatcccttttgccaaatgatctaattagagcaacacttggctttctatataattacaacatatggcacctagagggtacatatagtagaattataggttgcctgatgagaaatccaggtggtgggtaaaagactccattaaatagagtaggtgtgtgtgggtgtgtgtgggggggtatgggcatgggtgttaatgtacacaattcctcctacaattctccctagaataagtaatattttgtaattcagctgtccttcccacatgaaacaacatgattatatcatggaacaggagttaaaatttaaaagaaaacaaataattgatgacattaggataaattttttaaccttccatgcccctaaaaatgatcacatgtagtaagtcagcaaggctgaaagcagctctgtgtaagatgcattatgtgatgggatgtattcctccaagcaagatcacttacccaaactgctaaatataaaacaaagatgggaccataaagaaagaatggtttcttaatgcctatttgtaatctctggaagtagagtacccaacttcagtaggtgaagagttcagtgttggtttgttgaatttgaaaagcttatcctgcactgttgtgctggagcccagtagcaagggctcaaaagagtggattctgcacatccattcccagctctctgttcagcgatagctcacattcatagcttgatgttagccatcggcagaatatttacaccatggaaataggcccacttcaagggcagtttttccagagccactgtggtaaacattgacagcacaccactagctgtgggcatatgcagctcagagttggccacgccagtttaaagtccctgggacagatcaggtggagaaacatgactttccaaattgttacttttgaagtaataagggtgtgggaggttcattgagagaaaagagaaaagcaaaagggctgtggacagactcttctgatttatgcagagtgtgcatgaaagagaaaaagaaacagaaaaagttgtcagaaagctaaacggagaaccacgaaatagggctgctgtgaaattctaggtatcatgaatggacagtggtcaacaatgccaggtgtggccacaaagtcattcaggatgagaccacaaatgatatatatttggtgacaatgaattcacaagtgaccttgaaataaatactttagataagtgcaaaagctgtacaggctgcatggtaagcagccagatgcagtggatctttttgcaggtgttaggtaaggaatcggaagcttagatatactgcaagagagtgacatatttgtggcaaggatctcattaggatggaggagattggggaatatttatagcttgagggaaatcacactgtgtcgaagaaggagttaaagatgtaagggaggggagatgattctcaaggagagagcagaagaatggactagaaatcaattattgtgggaaatgatgaggaacctctgttctctgtgggtaggaagagaagatgagtaaagtctcagagaagttaagggtaaaaggagttgaggaatttcatataacatacctttgacctcaatctcaataatatgagagtcaaggtcatcttctgaaagtctggtcatgggggtgattgtgcacttgagcaaaagggaggcctggactgtgttttatggtcaatgtgatagaaataacatttgaattgagctttttatattttcagttgcttccacacacattgactttcccacatattgatttgctctaaagggttttattccaaaagaggtggtttgttccaaaggatgcataaaattgttatagaaaaaatgaggttgactgctcttaatatcaggaaagatgtttttcaggtgaatgcaatgtgttccaactcagaaggaaaacaatgcaatttaaaattactattatcctttctcattttctcaaggactttccctccttcaatcattcctgctctttctctacatcatcagactctcccttttcttactgttcctattggattgttccttccagcacatctgcatcttcctcatccactttgcctcctttgctctgtctactttccctctctctccaggcaatctcctcccctcccatggctgtaaacaccatgtgtgtactgacaaccctgaaatgtgtgtcttcagtacaggattctcccctgagcaatgtatggttaacattcttcagaaggaactcactcctgccaccagtctccaccctgaaccttagtcagttatacaccacctctctctgatcgcttgagcctgaaacctagaaatcactgctaatttctgtttcatcaccccatttatcctatgcatcaataaattttaaaaactttacttccaaagaacataatctatctccttctttctatgtgcattgctggtgcactggcccaaccaccctcatttcttgtccagatggttgcagtagccccgacgcgtcgctctgcttctatactcgctcccttccaatgtgttctctgtaccatagccagaatggtaatggaaatcaaatctcatcacaaatgcttaagatagaagctaagctgttgaacacaacctacaaggtatggcatggtctggctccttgctgtattatttttgtgttttgtttcatttcccctcccttacatctttaactccttcttcaactgcctctccctacctgtacgtgccagaggtctgaggccgtgtataccgcacttctcactataacaccagtgcctcctttcctcttcaatttcttctttgcatttttctgaatttgtaattccatatttatgttttcattgagttgactgttatctgccttcctaaactggcctgtaagctgtgtgaggacaggatctacctggttccgttcaccactatttatccagcactagccctggaatacaacttagggctttagtcaataagtgttcaataaatgaagaaagaaatcaatggacttacagcctcttttcacgaggactagagacttctccaaaaataaaagcaatagtaaagataaaagtaagtaatttagggagttggaataatggagaattgtcagtagaaaaataaaaatggcagcaataaaattagcacatagaaatactttcagtataattcacaggtctggttgtatctgtcttgctacccaatcaaagaaagaaacataattagttataattatcgtgtttataaaattaaaaacaattgtttgtccaatagtaaaatcttagcaaaaccttcctcatgagacgcaattactgcagttgatataagatttcatagatgtgccttataattttcatacatttggcaaatcatgtggtgatggaggacaccttagtaaattaacttctgtgaggtagggccaaatatagagctttttaatggtgaagcttgatgtaagggtacagttgtaaatactacatcaatatttcccaacacgagttcttgagatggggtgggaggtgatgtatagggtataaagtggtgttctataatcaaataagtataagaagtacaatttaaacattttgtattgcagactgtctcagaatccttaatatgttgattacagtgataatcttcaggaagcgtggttcccaaatttatctggaaatcaattttgctgcacagaatacatcaagggactagggtttcagggagcaaaaacttcggaaagctttcctctaagtggatgtaagactttatttactttaggaattccatgattaattttcacaaccatgattgtataaggacggattagaaggaaatgcaagattataattgctggcaaagaatagggagtgcacctattgtgtgtccccaatctagatgaggtgtatactatacagtagggcaaagagaaacgtgagggcaaatgtcagaatgccgcctttagggtggaacaaagatgcaagttccttgggagaatcagcaagcaggagaatcatttagctcacaactgattcctgtccacaaagtcaacaacaaagaaggctgggtaaaagctacagagagtctcaagtttttcctgatgtatttttccacaggctgttagacctaaaactgaatagctaaatcgaaagcaaaccagctatcccaatatagcataacagcatgaacaactcaagcctgcaattagcccagggagaacaggactttacttctagttccctcaagtgtggaagaagcaaagagagcacagtcaagtgagaaggaacactcggcaggttcttagcaattgcaccatcttcgttcttgatttaacatccagcgtttcatgttgattagtgaatacttggttatagagacacaaattttatttagattgtttgtttatttttagactcctaggtaatatataaatatataaatatatttatatatatatatatatattttttttttttgagacggagtcttgctctgtcatcaggctggagtgcagtggtgcaatctcggctcactgcaacctctgactccctggttcaagcaattcacctgccttagcctccccagtagctgggattacaggcatgcaccaccacacccagctaatttttgtatttatagtagagatggggtttcatcatgttggcgaggttggtctcgatctcctgacctcgtgatccacccgccatggctggtaatatttataatggccacaaacagttccctagcaattgatttggaagtgtttgcaatgctgggaacagatacccatatgatgcactttgcctacagatgtttgtatttgtatatgtgattatataataatggaattgtagttccatagtaaaaaataaaaataaaaatccattgatgaatttttcctcagtagctctaataacctttacctgtatcactcaaacataatcacaagccaaggtcatggttcagagaaaaaatgaatttttggggggttttttttttggtgttgctttgtttggtttggtttttgttccacaccctcaaataccaacagaaatataacacctcctttattaaattttatattaacagcaacattttgagataactagagcataaattttttttaccatttcattctcggaagcacaatagcacagagttaaaaaataaatctaagtagtagaattttaaagctaagagcagcatctagtctaagaactccttgaactggctcctcctccatgtgactgcattcattttctttctgataatcatgaaaagttgagctccatgatgttggtaacgaaacttttattatttctgctcctccatagaaccattttgtatttatttttgaatatgtcacacattttgctctccttgaatactagactctattaaacacctaccgaaaacacagcaaagcaaaatgtaagaaaactaacaggaataatttcaaatttcaaatgatagcctctgcctttatttaacaaatatttgaggcaactgaagtaaaaaataacatgaatgctctcttgaactttaccagaaccttgtctaaggctactgctactgccttagattgcgtgtcctgaaacaaactcagatgacaggttgcatacagaaggtttataggggagtgctctctgaggatacacctgcagggaagtgagaaaggcagaaatgagcagagagagaaactgtcctacaggttggttgcaactgggatttcagctagtcccactgagagctctggagctcagatagcccttcagaatggtcttaccttgaggcaagggaatgtggtctttaaatccctggatcagccagtcatgggcctcagatcatcacctataaggggtataagcttagtggaggcagttccccgtttcagggggtaattcagtaagcgacacagctttaagctgccccatattcttgggcagagtttttggaggtagaatgctttggcctgaaggagggaaatctgggtagagtactctttcctataattataagagatgactgtatggcacccttatcataggaagaaacatttggaactactcattatttttaaaaaaatgtcttatgttagccaattagtcttcaacaggatgcccggaggaatctgtctgaatttctcatcatgttcaaagcataagttgtaattgattctttcttggcaagggaacgcagtgtgattcctctgcctcatttcctttttccgatcctcccctcaaaaagcagactcagggaatatgacctagacagtatccccatttttagccttggggactctccattttatgaattccctttttccttttccacagacactctctcttaaaatgtctgggcacctccccctctcagcctttatcctctcttgcttactttttgtcaaagattgtcagtaacttcatttgaggaaggaaagaagggagggaggagacaggaaggaaaggaagaaagcaaatctgaagaaaataaaaaacttcgacatcagatcaataaaaccacctcttcgcctagttcctatgactttttatgcaagagggtcagtgtcttttctctgctttgagttgcaggaaagaaggacactttaattagcctaagttagtacatggccattgcctagaggatagatttgtgtcaaacctaaaaaatcaagggctagaaaaatagaacccattatatatacatcacaatatagttatgcattcaaattcatttggaatttttcaaaagtgagatagaagattttaatgtggaaatgttctgtacaacttatagatgcatgtcatattaggtaagagtagggtccagagagtctcatcttctttcaaggatgtatatcttttcctgtagctaatataatctctgattattaggatttcagggctaaatgaaactttagagataaacagatgagtgggtttcaactaccagttgaaaactctggttttcagccatccctgggggatgcagcatatcactattgttgaaaatggttcattgcacactgattgtcagaggaagtggggatggggaagaggtaaggggagaagggagggtcaataggagtgtatgagaatctcaggcaaggggatgctttggaaaatccctcctgaactttctgtcatgcgtggctttccaagccgtgggatttattggtttccccaggacttttgttttacatttatggtaaaactgaggttagatgattcatgacatgtctcataattaactattgacgtgtatatgctcatgtaacgtcatgtctcactgtaaagcaataaagctttctagcaagaagagtatttagaatcccaccagaaggttccaaaaatcatccaaccaagggttcactgaaatgagctttctttggcaagcacagtatattagctggctccacgtttaattttttaaaattaagttccaacatttataatttggtacatgccctataatccagacttcggacatctcttcaaaaactgaaggatctgcaacagacagcttgcttttttttttctttttttttttttttttgagacagagtctcactgtgtcacccaggctggaatgcagtggcgtgaacatggctcactgcaataatcccagacttctgggttcaaacaatcctcccttcttagcccccatgtagctgggaccacaagtgcacaccaccatgcccagctaatttcttaacgttttgtagcagtggggtctccctttgttgcccaggctggtctcaaactcccgggctcaagcaatcctcccaccttgtcctcccaaagtgctgggattacaggtatgagccactgcccctggccagcctgcatttctgtatggcaatacttatccagagctaagaagagttatccttttagcaaaaacatgaaatcttcagttagccatacaatccttgtatcccaaattaagatgtggtgtcagttgctgcttatcattgttttcgcattgtagtttttcttacagtaaaaataaaagcagaatattttttgcgtctgtttctctatcaaagagtgaaaataagaaaatgtagtcaaaaagaccacacacttcaagaaaatacaggaaaagaatatgttctcttatgccccataacaaattttcctgtgtacaggcaaagcatgtcatgaaaaccttcttgccagcttcattcatttttatgacctgcttacctcctataggcaatagtgcttgtacatctagatctagctctatccctttatgttaccaatgatcattcagaaggagaagaaggttttaaatccctcagactacctgtgaagtctggacaagaacctagttcctcacatctataatagtacagtgttctttttattttaccatgaatggttaatagtggaaactctgtgttttctcttccctggagattgtactaatctactcttgttattttttggttttttgtttttctttttgtcttcatttgctctgtcatactgacgtgaatggcaggttgtcaattaaccctcttcccagattgtattaaaatctgagtataaaagctacagccagatccctatctcttccattatagataccagacatctaacaacacccaagtgagggttttctttataatttttcctacacagctgattgtcagcctaacttagtgcctggtagataaaacggagaattaaacttgccttttaggccaggaaattattctgttctaacattattgctcatattaaaaccctgtgccattaaagctgtctctattaaatgaatatgtgctgggtgcgttgtttattcaatttaattgtagggaaaaaaaaaactcatacgagggaaatggttttttgaactggtttttaccagtcacaagccatgtgaatgagtgtccaattaaatagtggctcactaggacttgtgtaatagtaacatctgttaccttaattaaacaagttactatataaaggcactttcatagctcactttgttagagtaggttctgacctagaaactctaggaaggtttgttctctttgtgggattttgttggcggtagcgttcccagttggccccattaaactatagacctgacaagctctgtgatctacaaacctacaatacgttcaagcctacagagcctagaggaaggagggaactgaagtttgtgatgcaaagtggaacaaataaaatagtaaaagtgctgggtaggagtgcttcgtactcattttgatgaacttgggtgttgtgactgagaggcaagtggtggtggtaacagagaaaggagagtgaacaagtatttattgaccctccattgcatgttaggctcgcaggaaaatctgtatctgcaggcataggtctacaatcctgtatccatatctttgaaatccaaaaagctctgaaaacaaaaaaatatttttctgtcttttttcttctcttgttaatctatttgtttatttctggcaggtttggagcaaactcatttggtggcaaaaccaaactgaggctattgatagactttgtctttatttaccccatgttgaatcacagaaataataatatattgggttgtgagatactacatacaccagacttttcttgggatgttatataaaataaatatactatggtgttttttaatattcaaaatcctgaatgccaaaacacaactttccctgagagtttttgataaggggttatgtattagaccatttttaaaaaggtaaaataaactaaggctcagtgatattgttttgctcaaaaatagacaactaatcagcccttccagtgacttcccattcacttcaaatagtctctgcttgccatatcctgcagtgtcctacatagccaggcccctacttatctctctgaccatatctgctgctagctagctctttctcttagctacaatcacaccggctttgcagatcctcagtgacatctagctcttttttgcctcagggcctttacacttgcttttcccactaactgaaacactttcttccctgatctttaatgaacagctccttcttgtcccatatctcagctgaaatgttgtctttgcagagagacctcaagcacattcaaaaaagaccttgctcctgtcatgccaaccaaaacgagtgtgatggaaagttagctgaattcctactggattcatagatgaaataatatcagaaagaatacagatattatgaagtttgttttttctgcctaacgtctagtacttctttgtctgaaagaagcaccctagcgatgctttcaggaagggccttttcccattatttgcacccttccttgcttttttcagtgccaagtgctctgctgttctctacccagtggaccgggttatgggaaggcacaggctaagccaatcagaccctctccttctttcaagaatcagaattttcctatgggcaggacacagagcagagacattgggtggcagctccctggggatattgctccttaaattctactctctagacccccagagctactactggttgctgtcctttccaagccctatttgttctgctttttcttcagtttgtgagttaccccatatcttttcaataagttccccattttgcataatttaactttgcttttttgaaacagactttggtctattttagttacttacaatacccaaaccctaactgatataggcaaacagatagaacatctttaatttgtatgtttttctctaaatctaacttagaaaagtaactctttaatggcatttgggtgttcatcttagtggttaaaaataattatatcttatcccatttgaataaaacaacttaagaagttgaatatctacaatttgaggaaggggagcaatttgaaacattttgcttcgcaaagatgtttgcatccagcttaactgcttacccacctgattaagtaccttatccatgactaatggagttgtcgaacatgtggacttgcagagactcatggaattaaaatggatgtatcccctccagagagccctgtttcctcgaagggtagctagcactggagtgggatgctgtgtattcccacaggcatgtgctgacatgggagttgctgaaatttggaggctgaaacattttggctgcctttgtgcaaactcaggttgtctggcatctgcatcctcccagaatgagtcattgtatgtccatgcttcattgattcttgctgaaggagatttggacaatgggcctgaacctgccaaatgagtttgggaagccccaaacacatcggtagcttgttatataagcatcttgtgctcagcagttaggcctgccactgtctgtgatgagtagcaggtccctgtcatagtgacatccagatgaggttatttgcttacctctgtgcatgacatgtgagcccaaagatgctggactaggtcctcttccagcaaaatggtgcgcattgcccagatggtcttgcataagctgagaaagaatagagaaggcaacgtgtggccactcacctagactctcatttgagctcccttgtcagtgctttatgaatgtggaggatgaaaagatatcccagcattctttgatgaattggttttaactctatatggagaccttcctgaatcccaagataatctaatctctatttccacagcccatgaacttatccttataacatctgaagttcaaattatttatttagaatttgtgtcctatactagaccttacatttcatgacaacacgagttgcctatcttgatcattgtcatatcttatgcacttagcatagtacttgacacataatggacattaaatacatatatgatgaatgaattcactagctgtatcactttgggcaggttacttaatctctcgaaacctaattccccatctgttcaatggtgataataatggtaaccatcttagaaagggttatatgaggtaacccacgagaagcttagaattgtgtcttttgttgttatcattgataataaataacgaacaatgaatcttccctctactttcaaaaagggaagtcatatagaccagtggtcccctttttggcaccaggaactggtttcgtggaagacaatttttccacagatggcgggtggggtgggaggtggttttgggataaaagtgttccatctcagattatcaggcattagattctcataaggggcatgcaacctctagatccctcaaatgcacagttcacaatagggttcaggtcctgtcctgtgagaatctaatgctgctgctcatctgacagaaggcggagcacagactgtgatgcttgctcacaggctctcacctcctgctgtgccacctggttcctaacaggccatggaccagtaccagtctgtctgcagcctgggggttggggacccctgttctagactactgtgtaaatttagttcgtgcataattcgtctaaacttattggtaatacatagatatttactgtcttctccatgactccaagaagtgttttaactttacagatgaaaaggtcctacaaggaaggtttcagtcgttcatatgtgtatatcagaaaaacaaaggtggctcatctctccacagtagtttcactggtgatattttcattgcaaattcctttttacaggtgtcaaaaatcatagtatgtgggaatgtctgcctctagtgaccttcaatgcactattaaaaaaagaagttttgttttggattgccaggattttaaccttcaaactagcctgtgtgtcatggatccctgcactagaaggcttttagaaaaacagataaactaaaaggaagctttacagactgaacatcagctacaggaagacctaggtgattcccaactctatacccaggtgccaggaaggttctaaaagtcagtaaacacagagaggccattctactacccctggcctgaggccccaaattctggtgaaaagttctgctgcccttgtagtatggagctttttaaagcaaaggcagaaatacttagaaaaagaaagaggatgagcataagatctaccttctcccaaagcagccttatcgaaagccttagtgagatggtttctaggatatagttggaacctgtctggactcacagctccctatgtatgttgaactcttagtccaagactctcttggatcttgaggtaactacagtaccataaaaaggactagatttggggaatggcatcagagccagagctttgccatctatgtagtcttgagcaagtcacttaatttattgtacttaaaatggacttaataagaaacacctgcaatgttctgctcagatttcattagatgggaaagtgctttttatatggctctaacctctaaccactgtagagtttttgttacatgcatttttaggtctatgtgcattttttcaaaatgaaattatataataccttattgttttattatttgactctttgattgacagtatatagtagataccattccctactgaagaatataacattttcattctatgtttttattttttatggcgcaatcatatggcattgtatgactttgtcaattcactacaaatatttattacttaattttgaacagttcagtttcttctttagaactgctgtttaatctactacagttcacatcaattgcatcaaatctctagtattctaattagaatgcaataccaactatgggaattaccaagcagctgtattttgggcatcttcaccaacatggttatagcaacagcgaggatttgttgagtgagtgcctaatatgtgctaggtattttacatatactgtaccttgtataaatctcccccaaactctccagctcattgtcattctgctcattttgcacttgaaggaactaaagctcatcaacatcaactaacttaatcgtagacatagagatgactaagtgacaaaactggaattcatctgtaggttatttgacttcaaaacgacataaactgtgtccactatatgaagcatcttgcttgatctcaaactcagcacatttggatttgatctcaatgtcttgcccttgtctcaaacatgtctccaccgtgtgccaccattttatgaatggtgccatcatctaccaagctcccctaactggtagcctttccttccaactgccctgagatgacctttgtgaatgttaattccccccagattgttaattctaatgaccagcttccattcttcaatttctcagcaccatttgacacaggcggtagatcgctcctccctctgaaatccttgtttcacttggcatccaggaccgcataggcccctggttttttttttttctagtccatccaggccacttcttctccatttgtctattgggtcctcctccattctacaacttctaaactgacccggggcacagtttttgggccttttttgtatatgtcccttcttccttggtgtcttcctctagtctatagccttccaacttacctaaacactggagaagtcatttatatttccagcctgaaattctcccagaatttgagtatattgaatgatatattcaacacctacctaggtctttgcaatctatcctaggcaaaaatgtcctgactccaacatataaattgtcttcccccttagtgaaaggagaggaaagcagtgaagctttgctgggcctattgatttggatgacacgtgttctctgaatcacctagagggattcattgattaattgagtcattaatgcaccgattcattcattcaaatattatttagtgactacatcatttgccaagtaccatgctaagaatctagataaaatgtttagggccaattatctaggaaataagttttctaaattaagtcaattcttaggaatcaccttttggttttcatactaaacagggaatggagtatttctgaatcattaattcccaaatcaacttttctaaaatatgcataatcgtttccaaaatggagatttatttagatgtcacacaagataattgcagctttgtaaacctaacctaagggaaattgagttttcattcagaaaccttatcttgattgcctagacatcacccagcatcctctgacgcctctgcttgatgtccttatgtcagcctgtcctcaggagagaaagaggaaacttcaccaaaatgaacaaggtctttcaccttctccctttaggttttaggaagaagctgtttatgaaagttgtcctccagtgcccattgggaacttgcaaaagatcagttactaccgatggacagtatgtctggtctttctctctttttccacatattaaattgtcattgtgtcaaatgtcttgccatcaaatacggtgctgcaaagaaattgcaattatatttatcagttttttttctctgacctttgaatttcattcagtccacagagaatccttctcggtggttcagagaacatgtgtcatccaaatcaatagagccaacaatctctgatttttctctccccctttcactgagggggagggcagttcatatattgaagtcagaaccttttaagcctggaatggatagcaaagacctacagctttagtgcatgtaatcttgcaatgcaataacctggtagtcacgcaatctggacctagtaacaggttaccacaattccatatggagttttctagtgttttcatcctgtctgcctagtattaattttgagtttctgtctctggaaaattttgtttagattttaaaatcttggtttttgttctctaatcattttctctcactataagattctgactgtcagaattaaatatgttataaaactaatgtttaaccgtagtctcattccctacgccctgccccctgccccgcaccaccccaatcacctagaatattttgaaggaagaaatgggtggtggataatagcagccaggttatctggcagcgcaacctcattttaatattagctaaagcagaaatagtcaagagggcaagtctgccatgaaaagtcttatgaaacattacaaagttaaatggaccactaaaaaacggtagacagaagagacagccaggtgctcaccaaaatcttacagttgaactttaaaagtcatatataatgagcaagattagatgcaaaatcagccataaaaataaactatttcccaagactcaaggctaaagtgcacctaaatcttatttattagcatgactgaactagcagcacagtaaatcgtaattgcatgtgtcagtcacgtggtgtttattaggccttttctgattttgagtgacaaaatacacacaaactcatctcttctatccaccatgttgactctgttctcagacaggtgtcatcctcattaccacaaaatggctgcagcagctctagacattaaatattcagatattcaattccagaaggacagagtgagaatcattttccagaaagtcccaggaaaagtctcattgtagcttactgactctgattgagtcgtataattatccctaactaatcactatagccagaagacatgaaatgctgggattaatttaagcctgggccctgtgcttcatgccaacatttagtagtggagcctactaatatctcatggcagaggctgaaagagggataggtttttaagtggctattattggatatagtgctaatggacgctggacacaactgtttgaacaagaaggaatggtcaaaagtgacagatattgtgaagaaattggaacccttttgcacagctagtggggatgtaaaatgattcagcatcaacatcatgacatgtcctcaaaaaaattaaaagtagaattaccatatgattgaacaattccacttgtagagattactccagaattaaaagcaaggactcagctagatatttgtacatccatgttcattgcagcattatgcataataatcaaaaagtggaaacagcccaaatgtctattgatagaagaataaataaacaaactggggtatacagtggaatattttccagccttaactaggaatgaaattctaacacatgctgccatatggatgaaccttgaaaacatcatgttaaatgaaataaactggacacaaaaggacaaatattgcataattgcacttatatgaagtacctagaataggcaaatggatagagacagaaagtaggataatggttacaaggtgatgggaagggggtaatgggaagtcattgtttagatgggtaaagagtttgctagagatgatgaaaaagttctgaagatggatggtggtgacagttgcacaacagtgtgactgtacttaatgccactgaattcaacacttaaaaataattaaaatggcattttttatgttatatatatattttaccacagtaaaaaagatataaaaaatggaaaataggcaaagacaaaaatcaaaggggcaatatatactcccatctaagttaataaatgatgggaatgttacttcttttttatttttaataggtaaatgatgctaattttatttcttatttttaattatttaattgataaaaattaaatattcaaggtgtacaacatgacttgtgtatatattatataatgattaccacaatcaaattaattaatgcatccatcaccagattgtacattagacccccggaattgttcatcttataactgcaattttatactctttaaccaacatcttcctatttatttcccctacctccagagcccctagcaaccatggctctactttctgcttctacgagctctacttttttagatttcacatgtaagtgacattatacactatttgtctttctgtgcctggtttatttcacttagcataacatcctccaggttcatccttgttgctgcaatggcaggatttctttctttttaaggctgagtaatagtccgctgtacatatttactagtttctttatccattaatcccgtgatggacacttgggttgtttctatatcttggctattgtgaataatgctctgatgaatatgggagtgcagatagctcttcaacatactaatttcattttctttggatatatacgcagaagtgggattgctggattatatggtagttctaatttaaatttttttttgaacaaccgtactattttccacaatggttataccaatttacattcctatcagcagtgtacaagtgttgccttttttccacaccctagtcaatgcttgttgtctcttgtctttttcatagtagtcattcttagcggtgtgagaagatatcttattgtggttttggtttgcatttctctgatgattagtgatactgagcaccttttcatatgcctttggccatttacatgtcttctttttttatttcaactttattttggattcagagagtacatgttcaggtttgtaacatgggtatattgtgtgatggtgaggcttggactacagatgaccccgtcacgcatgtagtgagcatagcacctaataggtagtttttcagctcacatcccctccccaccttccccactctaacagttcccagcatctgtttttctcattctatgtccatgtgtactcaatgtttagctcccactaataagaacatgtggtgttttgttttctatttctgtgttagtttgcttaggataatggtctcccactgcctctatattgtgacaaaggacacgattttgttcttttatatgccgcatagtattccatggtgtatatgtgttgcattttctctatccagtacaccatcagtgggcactcaggttgattccatgtctttgctattgtaaatagtgctgcgatgaacgtaaagtgcatatgtctttttggtagaaccatttatttttctttgggtatatattcagtaatgggattcctgggttgactggtagttctaagagccactgtgactggccttttgatgatattttgatttgtctaatggatttctaatttagtatttctctgatgggaggctgttgcattttaaatggatgtttccacatattgcaagactgtagcatctctaggcccaggcattcctagtcattctgacaaacagaaaatctccatgcttcccaaacgtgctgtaagaagcattgttgcctccaattaagaaacactggtttatgaggaaagaaagtgccagttaaactggctgaatggcagttttatttcatatggtacattaataagtgagcaccccattttatatactagtttctcattagttcttatatattttaagtaatcaaaatgacccaggcaaggtaagttctgaaccttcagggtgaggcctagatattggaccatggaaattcactggcataactcagtttattgaattctcatggcagcccaaccagcaccttgcctgctacctttgtaatgtgcttcttctaaatgttagcataaacaatctgcatttttttgaattatcccggtgattgcttccctggtgcaactatgattaaaaataagacagataagttctaccccaagtagcttacaaaatgtaagcattataatacaatacagaaagcaagaatccccttaagtagcagtaaaatcacaggctgcaagaatgcagggcaggcagaaagacttccagctgcaggaagcagagacagcttcataaaagaggcaacacttaagaggttcttacgtaataagtaagcagtacatttgtagaaaggttggagaggggtattctgggtatgctatgagtaatccagggaactaatgctcaacctaggaagtctagattttatgaacttatggatccctttataactccagagcaactgacagaaagatggaatagcattccattggctagttgtcttgcccaaataacttgtttgacaaaaaccgtgcctccagggaacagaagggtcagtagtcatttgagtatctgcatatatacaaagacacatatacaatgagaacaactgaggcagaaattgaaagcaaagctctcagtgtctatgtcagagcctttccccagacggtgctaagtaaaatatgtaagcacttaaggttagctataaactattcctttgggcaaggaaataaatattattacaggaaactacagcaattttttgacatcaggaaaagaatatagtcctgcaaagtccttttaggtcaaggaaattagcttctaggggaaaatatatttaaaaacaaagagtcagataatgttttcagagcaagttttcagaaggcagtctatttccagtttatgctatctatagagcgtctgtgtaaagctctttaaaaatgtaaacacctaattgcatttcagtatgataagaccataaagtctttaagtctccacaggtatttatgagttcttggtcataactttgaaagcccttttcataattatgcctatcaacatattgtgaaaaaaaatcattgaggagcttacccttggctttagaaatagtatataccatctaattattattttaatataaattatttccttaccattagattaatatctagcccagagcacatgtaattgagaaatctgtttttttatttttagaatcatactaaatttttaagtgactgatttttcaaaaaaaaaaatcttctactcatcagaaacagtttgggatctgtaaaaatcccctagtttattccagacgtaaatttccccaaagacttttagcacctattaagtttttgtctccctaggtatgagagtttgctgtcagttaagaggaaatttataagaaaatgttaaaaccagcttaaataactttctagttctatttaatgttggtacaacttcaatgaaaacatttcaagtcagcatttcaaattcagctgccaagactcaggtaatatttcctggactcaatcatatgggcatgaaacactgcagttctatcttcaaagtcctttgaaatctgtctcatgatatctttagaagaaaatattccaaaatgaaatgaagaacttcattttcagctgaattttcttaacgtctgtcaccttcttaggtgtgggttctgaattttaaatattcctctttttgaacctgtggagattgtaaaaggctacatccctagtgaaaattggtttgagataattccctggaaaacttttgtcaaggtgtacagttgtcactttggttcatgttagaaccaggagaatgtaatatgtaataatgactaatgcccctttaaaagagcatttctctcttttcttgtctgcagatatttctcatgtctataggtaccgcacgggcaagagccatactttagataaatacaggttttgagtttttttgttttttgttttttgtttttggttaatatactgtctctctcaaaatcaaaaataaaagctaaacacttgaggctgcttataatacaagttatatataataggcctgttaaaataaaacatttagacctgtagaagaaggggaatgtgtactttaataatgacttagttagtattattagtgttttgagtttcctaggattctgagccaaaagagaaatcggcaagctgttaaataaagttcattatatgaaaaacggtgttgaagagagacaactttctcctgactttaaattatacattaaatgtgttagttgaatccaggggcaggttgattgcagtaatggcccctgctttgcacatgtcctgcgtcatgtcctttggtagtgccttcccactttcactcttgacttggccagactgcttgctttggccaatgaaatggtagtagaatggatgcaagcaaatgattttgaaagtccttgcacattggagcctaccccttgcggcttttcaaatcgtttcgctaccatgcgaacaagataaaggcctattgtgccgggcgcggtgactcacgcctgtaatcccagcactttgggaggccgaggcgggtggatcacgaggtcaggagatcgagaccatcctggctaacacggtgaaaccccgtctctactaaaaatacaaaaaattagccgggcgtggtgatgggcgcctgtagtcccagctactcgggaggctgaggcaggagaatggcgtgaacccgggaggcggagcttgcagtgagccgagattggaccactgcactccagcctgggcgacagaacgagactccatctcacaaaaaaaaaaaaaaaaaaaggcctactgaatattgaatgaagaggagacaatggcctagtccccctcatcaccccagccaacacctagctgaaacatagactcaagagcaatgaaaagtcttgttattttaagcaactgagtttgggggttgtatgttatgtggtgatagctaactgatacagatatttagacaagggatatctgctaatataatggacagtgtcttgtacagtagtttttcagcaactgttgaaaaactataggactgtctccttatagcaaatgacaacccttgagagcataccttacataaaaataaagatatttttattttcctcactgcctgttatatcaaatgttgttaaatccctgctagagacaacatacccacctctgaaccagaccaccttgttattagaagagagccatcctttgaagtcacacacaacaacactgcttaatggctagggaaacaaaggctattattaatctaaaatgctttaaacagggcttagagagaatgaaataagcagactggagtttagccatggtgcaatgctttgagggcgaaaacaaagccatccatttagataagctttgaaaaacactgtgtagaggggaattcttctagaaagtgtgtcttaacttctacaatccatttgatactcaaaatttttgtgttcctgctttcagtggcacttcctataaaaatccattgccttttccttcttcatcaaagtctttttaagcttggggaaaatagacttgtcaaaaacatgtcaaagacaattacatttgaaattttaagtcatatgaaagatgtaatttgaaccccaagacttatagactctctggacctcaaaaattatttaggtcaaccctatatgatttttgaattccctccaggaaaaacctaacttatctggatctcttctgccaaagacactcccagtaatagaaacttctgtggagaattatgccccttagggaatttttatgtaataaaatgtttatccctagatagagccattcacttttaagccagacgcctggtgcagcacaggaaatcccaggtttcctttctgccacactcttccgaatattcaaagacagcagctcttctgtccccaggttcaccaaagtcatttctttgttcaccaggctaaatgtgtcagcattcttgggttgcagttaaccaaaataactctagctaactcaagcaaacaggaattttattggaaggatatgagggacttagaaaacccctggaagaagcagttttgaaactaaatgaatctaaggtgtccctctgggattaggaaacaggaaaggcagaagctgtatatttacaggaatagtttgatcagggtgcccctgctgagttcatcaggttctttgtcctgctgttccaggaggaaggagttatgtatgactattgtagctttggttgtaagacacagggaaagggagggcctctgaccacagccttaccagattgaatccagtgagaacagctatcctcaaaagaacatatgagtactatgaaaacgggaaaatggatactgagtaggcgaaaacaacaacaattaaaataatgttgaacaccattctttcatcttcatgtgaagtggctttgagtcccatccgtcttgttcctgtgaatcatccagtgtccttagctgccctcttagttggtgttaattttttcaatgaccctctcaaatggtggtgccttgtagctctagctgcagtttgatcagcgcagagtagaatggggttatcccctcccgcattctggatgccgtatatctattaatgctgcccaggattatgttcatgtttttggcactctcatctgcccatcgagtcagactgagtttaaagtcacctaaaacctagtaattaattttctcaccgtttctctagtctatgccacatctgcccccatcattatcatatctcttcctgtgcctagaatgcactcttctactttctgttattgcctagttaacacttccttttccttcagacctcgctcgtattacctcttactgagactcaatttcccttttatagatatttataatactatacacttttcctttacagtacctcatatgatataatttcacatttatgaatgtgattatttggcgtcaagatggtctagaaagaaaatctaaatttcttattacatgatctagcccaaaccttagcagccaatctcatttcttaccactccactcacccatcccactggcctttctgttccaggaaaacacaaatcctgctgtttccttagggcctttgcacttgatgttctctctcattccccattctttgtctgaccactacttatcatcgattagatcttagctcaagtaatacaaagagaggccttccatgtttaacctaaagaaattccatcatcttttgtgcccccaacacacaccaaaagtccatttctatcataagactgtccatattttcttcttagcacatattactgcactaacttatcacattcatatttgctttatttgctttattgttagtctctccttccactgaaatgtgagatccttaagagtaatggcattatttgtcttatttattgttggatacctaattcccagaagagtgcagggcccacagtggatgctcaggaagtatttgttgaattagtgaattgaagaatggtcataaacagaataaattgtcttttccaatagagtttaagtttcatgaagggagcaaccgtatcagttttgttcactattgcatctttagtacattgcctgacacatagtaggttcttattacaaatatgtttcatgaatgcaataccatatttgcactattagtgtttttgagcattcatagggacatttatatttcagggatatttatgttcagacctgactgatacacaatatgtgagcttttcctctcaattccctatcatgaggaaaagaaattggcatcttatctctacctccacccaaagtaatcggcaatttcattggagaaatttttagccaccactgagactagttctgcataagaaaattagactgagatctagcaatttactagggccatcagtttaattatgaatatccaatgtgagtaaatcagacttcaaatgatacatgtttttcaccaaattgcttagtaactctgtcaactcttccattcattgatctctaaaattggaagacttgaggtgaaattccagtctcctaatgtgtagttcagtgtttctctgactttgggagcatataaatcacctaagaaccttaataaaatgcagaatctgattcagaaagtttgggatggggcctgagattgtgtgtttcttataagctcccatatgtgacatagctgctgacctcaaaccaaactttaagtaaggaactagataaccctggataataatagcaaacaccagttgtaagcaagtgtagcactttgtagttttcaaagaacttatttgtaaattaatttttaaaaatccctacaaagacacaattattcaggtatagatgaggaaactgaagttgagaaaactgacacctttaattgaagtcgcacaactagaaatttaaccaagtttctccttccacaactgcagttgtttccccttcacatcatctgtctggaccacattcacccactcattcacagtaaatttaattatgcttccatcgtgccctactcgaggggttgaagatacagcagtgaatgagaaaaagatcttaccaggttttctgatgtgtaaatggaatgattggcccttcccaactccagtggtctgtgattctattacggtgtgccatgtttaaaaaatgaaattatagaattaaggcattatcttaggtatcattttctacctctgtgctctcagaatcaataaacttaaattcagctgatcatcaccgtcatacaaaacttcctcccacattctttgtctcattgcagacaagcatatcggagccaaatttcacgctatccaatcaataattaattctcctcctaactgttcctcctaaattgtattgttttgtgctcctcctggccactgctgccctagttcaggttttctcttgtctagtctggcagtgtctagaagcactttctctggtgatggaaatattctatgtctgtgctaatgcaatacagtagccacttgccgtatgtgggtattgagcacttgaaaggtgaccaacgcaactgaggaagagaaattttaattttccttaattttaacgttaagtttaagtagccacatttgcttagccatctcttggacagcatgtgcctggatccttgcaggaacttttctgcctggtttccgctggcttcttcttatatctaaattgattttcctcattcattcaccagcatgatctttccaaaatgtaaatctgatgatatcactcccatgccttaagttcttatcctgggataaagtctttgcttcctatgtgactggcaagggtctttgtgacctgacccctttctgaacccaccagccccgctttctgcctcacagttaatgctctgacaatgagctaccaccttttctgcatgtcgtcccctgtatgtatctaactcctacatatcccttaagaatcagttcatctccatgaaaaattatcattgattcatccccacccaggacctctactatgttttcaggatactctatagatacatatatcatttcagggaaccacattattttatctgtctcatatttattggtggtgatagtggaaattcaccagactgtgaatttcctaaagggaagggttatttccaattcatctttattgactgagacactaccataggtagtgagcactactagccattgaatgaatgggagatgaaaagaaggagagatggaagaaaggaaagggggattaaaccagctagtatcaaattttaaaaataaatattggctgttaactgttcgggaatctcaatttttcagttaactttatttttttttacagttgatagctagtataaatctcagttagacatatttggatttttggaggactagtggataggtttcctataaacaattgatcatttgaatttagtttcagttgtacaaaataaaaggcattcaggcactgaaagacaaattttgcacgttctcacccacatgtagaagctaaaaattaaaacaattgaactcgtggagacagaaagtagaataacaattaccagaaggagggaggggtggaaaaggggtgatagttaatggatacgaaaatgtagttagacaggatgaagaaaatctatcattcaataacacaatggggtgactataatcaacaataatttattgtatattttgaaataactaaaagcacaaaatttgaatgttcctaatacaaagaaatgataaatgaggttatggataccccacttaccctgatgggatcattacacattatatgcctgtatcaaaatgtcacatgtatcccataaatatatatgcctattatgtacccatagtaattaaatatacatttttaatgaagaaagaataaataaaaggcattgtatcttctctacatagacagattattttaatcagccaaattatatttccttttgctaaaatgtctgagctttgactatattgactggtggacttttaaagccagaagacactaagttcagccatattgtaactgctcaatgggttcaccctgcctgctgcctagacagagcagatttatcaagacaggggaattgcaatagagaaagtataattcactcagagctggctatgtaggagacaggagttttactattactcaaatcattctccctgagcattgggggatcagagtttttaaggataatttggtgggttggtggggagcagggggcagtgagtcaggagttctgattggttgagttggagatgaacacataggaagtcgtagctgtcttcttgcactgagtcagttcctgggtgggggctgtaaaatcagatgagccagtttattgatctgggtggacccagctgatccactgagtacagggtgtgcaaaatatctcaagcactggtcttagattttacaatagtgatattatccccaagagcagtttggggagggaagaatcttgtagcctctggcctcacgactcctaaaccataatttctaatcttttggctaatttgttagcctacaaattagctggggtctaatccccaggcaagaatggggtttcttatgggaaagggctgttattgtctttgttttaaactataaactataaactgagttcctcccaaacttagtttccatcccaatgcccaggagtgaacaaggacagcttggaggttagaagcaagatggagctgtttaggtcagatcgcttttcactgtctcagttataattttgcaatggcagtttccatatcatttttcagaggaaaaaactatacaacttacccatgattaatcagtaagttagtggtgaattcagtagaaactggtgtgtatatgaacacattcttgaagtctaaatctggaaagaaaggcattttgtttttcaaatacctacttcagaggagttttgtttgcttttttttttttttttaatgacaatgattttggttgagattttacttaaaacaaaagttacaaagttgtgccgcctttggtacttcatgctgtgccagttaacagtggggtgggtcatctgtctatgaaccatgaccattttcagttgaaagttagggaagtctgccttatctcaaaagcccttgccttcaggcttctgttcagatggtatcagctggaacaaataagctgagattgcatttgctgttttttgtgctaatctcaagaacattccaaaaatggtttgtcagcagctgaactgagcacagaatctgtgggcatgaccatatttctcctcacaagaaaaatcactttttaagtttcttggaagttgattacaatgtgctttttgctccctcttcaaaagtaagataagtatcggaatctgtcattttctgctttggatgtatgcctaaacagccaaagaagcgcatcaaaaccaaggaaaaaaatgtggaaaggccaacctaaatgtatatagggtatagtccatccacagactatagctacacagacaaagtgaggtgaagaacttggcagttatctgagggattttcccagtttggttgatgcactcgaccatccagagttcctcttgttaagtaactttttgtctgaattttctgaaaaacagaaatagcactaaagatgaatcctgaactctgaataattgtattgtaagtcagaaaaaactttttgtgatcagccactaaaagggaagtcacaagaagagtccaccactactaccaccaccaccaccaccagagcaaacttgtttacagcctctctgagtcattactgtgctaggttttgaacacagagagcaaaaggactatattgcatgagcttatagactggtgaggagacaaacaaggaggtggacagttataatcaggatgggcacccatgttgacccccttcttctggtgtttcagccatttgatgcatcatctatggacacacagatgtttcctctgtatacactgtctcacaagtgacactgtgtattcatcaccactcttcaggttgcaaatgactgaaatccaacccaaactggcttatgaggcatttttgacaactttattgaagtataatttacattccataaaattcactcattttaagtgtacaacgcaatgatttttagtaaattgtactaagttttgcaactatcaccatcatctcattctacattattttcataatatttcaaagggaatctgctgactcacgtatctgaaaatttcagggtttgctgtatgtgctaagggaatatcatcaagacttcatttttgttggtttcattcttagccaatctattccctggtgaaacgacaaatgacccctagcggattatctaccaccttagtaaccccagcagaaaacatatacctcttttccagttgttggaacaaatgtcttaggatgacacacatttatcctgattggtctaggctaggtcaggtgtccactcctgaaccaatcgctttaaccaggagtgtgtgatgctctatctttggccatgtctgtgtcacatgaacaccccagcagccagagaatggtgttacagccacccaaagtacatggtctgaaagtggggagacatgatttcccaaaggaaaattgggattattattattattattattattcctagacaaagagaaatggatgctgtgcaggcaatacagtagatgtccaatccacaggaaaattgtgatcagagtgacgttgcttcttcccttttgaatcccctgtagtggttatcacacagccttttatatagcaagtactcaaaaaatatctgtggattggtcatggacaggctaaaacatagaacagaccaacaatgacagacttttactttcttattttattgttggggaaggctaaaaaattaggagtatgatttcaattattaaagctaataaactggggcttatctgagaggccacatgggagcatgatggtcagagagcggctggatgtgtgtcagaactcaaaagcagattgcagtcagactcttcccctgtgtaggcattgagtacgtagatatatacacccacacacacagacagttgacccttgaacaactaaggggttaggagtaccaaccctctgcacagaaagaaattcacatataacttttgactccccaaaaccttaactatcaatagcatactgtttttgttgttgttgttgtttgttgttgttgttttaagagagacagtcttgctctgtcgcccaggctggagtgcagcagcagcataatcgtagctcattttaacctctaactcctgggctcaagcaatcctctagcctcaccttcccaagtaattgggactacaagtgcatgcccccacacccggccgattctttcatattttttgtagaaacagggcctagctatgttgcccaagctagtctcaaactcctaggatcgagtgatcttactgcctcagcttcccaaagcactaggattataggcatgagccactgcacgtggactaataggctactattgactagaatgccttaatgataacacagtttataaacacttttttttttaattgagacagttttactctgttgcccatgctagagtggtgcagtggcttgattccagctcactgcagcctcgacctgctgggctcaagcaatcctgccacctcagcctcccgggtggttgggactacaggcgcacatcactacacctggctaatttttgtattttttgcatagatggggtttcacaatgtgcccaggctggtctcaaacacctgggctcaactaatccacccacctcagtctctcaaagtgctgcgattgcaagcatgaaccaccatgcccagccaattaacacatattttgtatgttatatggatcatgtactgtattctttattattttttttgagaccgattctcactctgttgcccaggctggagtgcagtggcgtgatcccagctcactgcaacctccgcctcctgggttcaagtgattctcctgactcagccccccgagtagctgagattacaggtgcccgccaccatgcccagttaattttgcatttttcataaagacagggtttcaccatgttagccaggctggtctcaaactcctgacctcaggtgatctgcccatctcggcctcccaaagtgctgggattacaggcctgagccagcacacccagcctacgctgtattcttacaataaagaaaataaaatgttattaagaaaattataaggaagagaagaatatattgactgtttattaagtggaagtgcatcatcatacaggtccttatcctcatcctcttcaagttgagtaggctgaggtggaagaaaatgtgtgtattagtggacttgcacagttcagacccgtgtatttcaatcccgtgttgttcaagggtcaactgtatatctatctatctatatctatatctgtctgtctgtctgtctatctatctatctatctatatatatatatatttggcctttcttattgctctttcatcagaagagtaatgctagtgaatgatctggaattcagtggtataccataagctggcaagaaacctggcaaattgtaatttatattcacaaaacatttttttcaaactatgcaaatctttacatctaacagaaaaacaataagcagaattctagaacctttggaataaataattcagtaccaatagatacattaaagtatattgtttatagaaaggatcagagttgaaaattgttaaggaacaacctgtattttaaaagtaaattttataccatttttcctaaaaggaatatggttcacagcaaatttcagatccataaaaactttatcttctagtgacttttaagattctctttcttgacaggaacttcaagaatggcaagatatttctttcttccacttaactgcaatgtgactatgaagatgctgtaaacatttgcaaattaggttgtaaatagcagcaatgaaagcattaactctcatagccacattttcggaagtgcactttacattatgtggagataggtattaagaaataaacctgaatgcttatataaaaattatgctggagataggtattcagaaataaacctgaatgcttatataaaaatccagcctcctattttccaagcacagtggtataattacagctctaatttatggcatactttgtaggattgctgattaattatacagacctcctgatgttttatattcttttcaactttgtttccctctgctatgtgaccactacaaagcgagtatccctaaatcacttattattcaggttacctaatttttaaaaagtgaatttgctattaacatcattttcttatatagcactgtaacatttatatgttaaaaattattgtactccttaatgttgcagctaactcatacacacacagacacatacactcactcctacacatacacatacagacacacacactcaaagattttaataaattcccgatatttacccaatgtagacatgtctaacagttctgcatgacttgatctgaaatattgaacacttcaacagtgcaacaaagcatgattcgttagggataatactaaccaatctcatttttaaactgattatagggatccaatttgaataatttgctgctgtggattatttggaaacagttgtagcacattttgtttgttgctcgaggttatcagtgttttcagaacactatcttcctttcatagttcttttgagtttaatagttatacaaaagccccatttaccagatttttcaataaatgtagtgtgctgatgattacaggaggatttgccagaaaactcctttacatatacatagtgcaatatcttcagatattatcctcttctttgctttaagtaggtcaggttcacaatgagctgttctccttaaacccctccccttcatatccttatcaaattccctttatcactgtcacatctaaattactatcttctgctttgccaccaagacatttttaatagtaagagcttcctgctcctttcttaagctcttctctttttcggtcatcaacttccccttggaattaggaaaaggcccttgtagatttgggctattaaataggagaggacccatgtatcaagtccttaaatgttctgtcatcatgagaattatttattggaacccattacctgtgcgacttcacagttctttttagatggtttgtctgaaaagaataaaggctcttcgttgaaatgaaatcgctttctttgctacctagggaagaaaatagttgagtctaattatttagaaacgagaggaggattgctgtaaggacttgagtcgatcatggaagtttctcctatgcaaaacagatctgaaggtacagaaaacataaaaataatatccctgggaagagaacacccaggtattaacttaagcacatagcaggctttattgagttttacagaaaaagtaaatacagctgacacaacctcgagactaaaatttttggtgacatctctgtttatcccagacactgatttctctattcagttttgtgatgtggagagtattccgaaggcctgaaagtgttcaaaaccattgtgcatagcttcattttgggggagaatgttataatttgcttctgaaaactaagtaatctctgacctctacccacacatcaagaaaggttagaaatcagtcctaatcccaggaattgtcatcaatgtctctaaaattctaaagactgaatgaattttaatccaataatcaacatatttaatgtgtgcctgtttgtatataaaggactgtataaaatgaaagggagacagagagatggatacgacctgggatttgagttctggaaatcatttgagtaaatggggtgatgatatattgaggaagtgtaacatcaatgccatgtgaatagattgggcagctttggaaggtcatgaattggccattatgcgatttgcccaacacagtttatacttattcataccattgtaagaggaagttgatcatgggagaaaggttgaaatagatgtgtgtttcacaaggtacaagattggcacttctccaagtactcagatcatcttggatggtacacagtatacagacattaaaaagcactgagcaacatagttctcttacactccttctgagaatatcaaggggaaactcatggttggtcctagcatatctgaacacttttgaaatcctgagtaatccctcttttactgaaacaaaaaaagtagttcctaggctgagaatcctgggagacaagtttacctagctggaatataataccttaggtgggtttttatcacatttatttttatgattaccactatttatggcaagtagatactggtttccatgtatcatagcaacaagtttcctttattctttaattttgaactttgaaacatttaaaaaatattgtgactattggttattagaatgatactgaaaataataacagaaatgatctttgcagctaacaatgaccagctgtttaccatgcaccatcacaggcttaaatgtttcatgggaatttttacatttaaccttctcacaaaaaacctatgaaattcaggtgcttgttaattatgacccccattttagagatggcagtctggagcccagaggggttgagactcccaagtcacacgtctagcagataaagaggcaaagatttaggctgtcttgtagtacatcaatgtggccgaaatggagagacgtcagttcaggaaagcttagaatggatgactgttggtgatgctgagtttctgtgcttcccagaaggcaaagatgcagctgttttagggacagggagagaccttggggattttaactggaccgtgacagtggtgttctatcatgatagtgaatgagctagtagattccactttcattttctctcttagaaatattatgaagttctggtattaggggttaaagcaaataaagcatgatcctgccatcaccaaagagttgcaaattggatgcataataaaattaaaacattttttgtttctggcatggccaatattgctatttgtcttatagaaacctcttctcattactaaattatatattctgtatagtgggcccccctttctaattaataattaatattgtcttccaggcattttagttaccaagtggtaaaggaagcttctgtgatttcaacttcaagttatttttcacatattctttacttttgcttctgctttcagacacattaatagggacacatatttctcaatattaggaaaagctatttcaacaagtaaaattagaaagcaaacagaaaaaaaaaagaactatttaattataaccaaagatctaatggtaaatttaaagaaaatctcttaaatgtggttacattttttacttcttgttttatttctttcctacaccctccaacactgcaggatagcatggtaggaagggtacaggctctctagtgagccctgagctcaaaactccactctatttcttgtaaatgacattgactttggatgttttaatttactcctctggatttcatttttcttaactgaaaaatcaggataatgatactcctcagaattgtgcagattaaatgagataatcaatgcaagcagccaacagcacccaataggatgttgtaagtgcttaataaacttcttaagcatctccatgcgcccaatactcaacttagtatatttacagtttttcttctgggtctcttggtccatttctgtccacgtcttctttatttctaattatttctagagacagctgcactttgttattaaactattcttttacaagctactctgctgttctgattttgttatataaagcttcctgagtgctttatatattttaatgtttttttctcattataaaagttatattacttattatgatgctttggtaaaagtatatggaagtatagaaaataacaaataatattgctttaaataatattactttcctgtccttacccccattcatcctcacaatgccttatggaattatgttgaaattgtctcaggtcctaaattctcagaagaaaggaattctaaatcttatattagtggaaacatggagatcttgcatcaatgaaatatagcaatttaagaaacaaattttaggcaaaatgacatccaaacatgtcctttactttatttccttttcccaaagacatggtgtttctagtgttatatgcttaccatgtgaataaataaaatcacaaaattttaccagcccaagaaaagcatttctcatgttcatcatgcactgtgtcacgaagaacaattaaaattaactctgtgatctttaatactcatccagccccaggcagagagttattgccaggttattttaaagggctttcaaactgttgttcagaggaagttaaacctgaatcaaaccaggttaaacaaacacaagtttattttctcttttgagcaatgctgcagacaagggcaatagggtctgaacgcagcttgttcttcaggtggcctgaaatgcacaggttgttcagcagtttattaaacccaaatcttacaacagaaagcaaattatctctaagggaactttgtcaccagggtgtctgttcaatagtgatgtctattgccaccacagagactacacggaaaggtcaatgacaggtttgcctgaaattaccccgggaggaggtgtcttcctattgacctacattaaatttgttatccaaaatacctttttttccttaagatggggagcaaagccatcttctagaggtctcaattgactctttgtaaattgcaattaccacaaaacaatctttctttctataattcaaaataattaattccttcccatcatgctgagaatttccacgtatcttttgaaatcaagtatgtaagcttgggcaaatttcagctaaaagttaaaataccttttgaattttatgaaaagagataggcaaggaaattcaaaccaaaacaagtctttttttttttttcttttcagagaaaagtcttggtgttatttgctatcaggtaggtctatagcatacagcctacccatgccaattaatctgccaggcttttctaatttctcaactggcacaaagccagagacccctgtactgtatccgtatgtcagctcttgcagtcacaggctaattctcctgttgataggttgaatatatgaatctttatctctgtctcttcattgtcacctctctactccttctacattgtgactatttcttgggcattgtattccaaaattatgctgtattgcttttgcctcaagggcaagtaaagacaatgcctttctcataagcagttcagctttcaggcagaacagcttagaataccataggttgccattttggtgtagatcctcctctgtcttattttggttataattttaataccaaagtaaatatttatcacttggccagagtaacaagaaaaagatcaaatgagagatgtagtttaatccaaccaacaaactgggttaattacagaagaaattaaaattgcaggcaggccctaatcttttttttcctactggacttttattctttgatacattacccattaccacccccaaactgtcttttatactcctcatttgattgttattatatcaccgagagagcaataattgcaagtctctgttagctgctgttggggaaaaggccaagccttctacaggctggaaggaggctgagcagtgggcatgggaggtggtgccaggcccacaaaagcagaacccctcctgcgtatcacttcctctgcccctcgtctaagggcttcaaacaaggtctaacagccctggggggtttcctctcttgatacccgttatgggttaaacagtttccctataaaaatcatattcacctagaatctcaaaatgtgaccttatttgggccctttgcagatgtaatcaagttaagatgagatcatactggattgcataggccctaatccaatgactgatgtccttatgtaaggagagggaaatttggatacagagggaagacaatgtaaagagacacacatccgcaccatgtgacgatggaggcagagattggagtgatgcctctgcaagacaaggaacaccaaaaaacaaaagggccaacagccgccagaagctgggagtgaaccaaagggtttctcccgcagagcctccagcagcaaccaacctggccaataccttcatgtcagactgccatcctccaccactgccagagtatagatctttattgttgtaaagcgcctagtttgtggtgtgttgctatggcagccataggaaactactaccacaccacacccatcgtcccctcccactgcattgctctgttctctctgtccagtatgtcttgagtggaaacattgaagaggggatagatcgtggcctcataaccacaggctaccctaaatcccggccccatgtactcaggcacatgctgctactggtttaaagtcagggttcacagtctcaaaggcctgcaggggcctggtaggaacattaaagagaggttcaagccaggcatagacgggagctagaaaacccaccatctgctcaagagggctgctgcccgtctcctccagcctattggtgccctaaggggatatgttgccagtattgccctatcttcccatatgtcacaattagccaggaatgggcttttatatgaaatcatacaattattagattgttattttaattgtgtagaaaaagcaagctcatctgtggctgtgaagttcctctggtctattaatgacaggctcgctgacacgtgcccaattctgtcctgccttgtgatgtacgtgagacctttggttgggggatgcctgtctaaccgccctcattctagggcatcgctgatggcccctggggtcagcagtcttcctttcctggagccaggcctcctgtgacagctctgccatcctcccctctgccatcctcccagtttgcttaagctgagaagtagtcttaccgaaatataagttagtcgctcaccccttgcagagttcaattaactggagtgaggtctggtataaagaaagcgatttattccaaagctagcttggggaaagaaatacagatgtcctgccttaagtataccacttcacttttggaacagaaaacgggtacttttcaaaggtagaggaggaagcaagcaaaacgtgatagctctggtggcttatctacgaggtgttcgagcttgtgactgccggcacctttgtggacaggactaggctgcaaacttaccaggtgggaaggagtttcctatctcttgaggcagtcacctggtaggagggagttttataaaattgaggcagcctcctggtgggggaaagtttctttctggggcgcctaagcacatagttagatgaacttgcccggtagggagtgtctggtgaaggggaggtaaaaggctatatttgcatttctaaagggctatgtaggaagtggggaaccaggggaatgagaagagaaaagagagagaaaaaaataattaaaccatcttagaaaaatggggctacttggtgacagtagcagtaattattttaactatgtttgggattctgtaataaattttagctcttcaggagtttagcctccctcgtaatgtgtaaatctattgtttcactttcaggctttcagctttcaaacacgttttctggaaccaatcatgtataaaagagagtagaagccttttaaggccctttgagttttttttttttttaattgcacataattttaagtgagctattttattcttgatctaacaataataaagatgatttaaaatttaacataacagtttgtcacttttttgtgtattttgtttgtttgttgaaaggaaatgatcactccataatttctttctttgcagaaggagagaagtggttttctaagttgtattctgaagggatttatttctaaggaagtgtttcagtgtgacttaaaggcaagcaaggatacgctgtctccctctacagcagttaggcttcctgctgaactgctcagaaaaatcataggtctccattttgggataatcctcctcttttgggtgatagagtgaagttggcagctttcatcatgtgttactaaagacccccccaaaagaaaagatcagcatttttaaaggtcctgtgtccccagactggttttgatttataggactgacaatgtcaacttttcaatggctgcaactcagagcctcatgtgaagaaagatagattcaatttatctcctgagtccagatttgttcctatcctctgtggatccaaaatctccaaatgacagtgagggaacaactgcttctctatgctctaggtaatttactgtgttgtgaattagatgacctcttttcatgtagggaaaattaagtcttgtgtcatgtctgtatttgtactacttgctgctttatcacctttggcttttctctgttgccaccaataatttaaaaagggccacaggtaggtcaggactaacctgttctaagccaagaacagatttacattttcaattcttttcatcttactccatcactattcataagtattaggaggagctcaaagttcactatcaccctaatagctacaagtcagtcagtagtctaaattgaggaaaccaagatgagatggaccataaaggaaactttgaaatctcatccagaaacaaacatgaaaataaagctattaaagcggcgctgttgtctgaggtaatacccgacgtttgacatctcatgccaagaaaattaaggacacgggcacacacaaggagtgagtttagagccgaagtttaataggcaaaagaaagagaaagaacagctccctctcctgcaagagagaggaacattcaaatgggacttccggcttgtgttggagtacaccagattttatagacaggcttgaggaggcggtatctgatttacatggggcccaaagattggatagaccaggtgtgacgtttacataactcgtggggaagctggctggaccaccctaatattatgcaaatgaggtctttgcctggccagcaccaccctgttgtctgcttcttgctgtacacgtggctggcaaagagaagggacgatggagccactattttaaacatgcctagtcccaggtagtcttttcctattggcacagctgccagcattcacccatgcacgcttccagcttgctttgtctatgtctgcagctcgattttacaagctgctctttgttagaaaagaaaatgatttaggggctgcttttcgttaaaaggaaaacctgggccgggcgcggtggctcacgcctgtagtaccagcactttggcaggccgaggcaggcagatcacgaggtcaggagatcgagaccatcctggctaacacagtgaaaccccgtctctactaaaaatacaaaaaattagccgggcgtggtggcgggcgcctgtagtcccagctactcgggaggctgaggcgggagaatggcgtgaacccaggagttggagcttgcagtgagccgagatcgcagcactgcactccagcctgggcgacagagcgagactccgtctcaaaaaacaaaaaaaggaaaaccttaccgaggactcccgtaccctcactatctgcctaaataatttctccttaactcctgtatcactatccttggactggatttaggtactatattcatgaaaaaaaaaaagaatgtaatattagtggaaaaaccgtttttctaagttggtagaagatccaaatggaaaggaagaaaatatctaagtatttatattgagttgcatttcaaatttttccttgagctagccaaatttgtaccccaaggccgaatgctagctttatagcttatttctggcttataaaaatcccataaaacattggccgagtgtggtggctcactcctggcatctgagcacttcgggaggctgaggccctcggatcacttgaggtcagaagtttcagaccagcctggcctacatggtgaaaccccatctctactaaaaatacaaaatattagctagacgtgggggtacatgcctagctatcagggaggctgaggcgagagaatcgcatgtacccaggagttggaagttgcagtgagccgagatcgtaccactgcactccagcctgggtgacacagcaagactctgtctcaaaaaacaaaaaaatcacataaaacacattaaaagcaacaggtcaaattgtatacttagcctttatatgcagaaaaatatagccaaaattatgtgatacagctgtgtatgaagaaatgtcaggtgcttttttcttcatattcggaactgtgtggttattcttccattatagatagcattcgtcaatcttctaccgaaaagttctatcaaggcagtcatcacggaatcatcttcagaatccattccttccattctacttttactaccaccgtcacctgaacaagttcagcaatttcttggaaagattgcactcttcctgttgtcagggctgaaaactcaatttctaacatcttatattattggcttatataactggggcgtccaaggtgttgacttccaccgtggacagaaatgggctcaaaaatgtcataaggtctctgcttctctttctctctctctttctcttgggctctgtttgtctttggatggcttccttaaggcatgctttctctatatggtaggcaaaataattgccaacaattctagattcccatcttccaaatttagcaatcccagcagaaagagattgttttctcaaagagctcctggttttgatggcatgcttctacacccatcactatagacaagagaatagggtctcctgactggccaggtctgggtccctgcccatctttatacctagatagtttgtcaaacagctttcccattgaaaacagtaatgctcattttactgtgtgcttatagaaatgtgtatgttattgtatggaacacattggcattatttctagatatataatcatcaaaagtaatgatttattatgagcttgagaacaaaaacaataattttcacatcactaaaaaaaatagcacaaagcttgccgggcgcagtggctcacgcctgtaatcccagcactttgggaggcgaggcgggcggatcacgaggtcaggagatcgagaccatcctggcgaacacggtgaaaacctgtctctactaaaaatacaaaaaattagccgggcatggtggcgggtgcctgtagtcccagctactcgggaggctgagacaggagaatggtatgaaccctggaggtggagcttgcagtgagccgagatcgcagcactgcactccagcctgggtgacagagcgagactccatctcaaaaaaaaaaaaaaaaaaaaaaaaaaaaaaaaaaaaaaaaaagcacaaagcctaatatataggaggtatttagtaaagaactatgaataaatgggttcaatatatcatcccccttctgtgtctatttggtgtcacccatatgctttgtgaggcatcataatgtgttgtaggacttcagagtggcagaactactcagcagttgtcttagtcttaacagaatcctttgtaattgcttgaaacagtgggtccaggaaggcacagagcttcacttaatagaacatgtggctaactctggtctattcatgagtgtctcactgacatatgcccaagcacctgtcccgcctggtgtattttacatgtcaggcatcgttctaagcaccgcacatcttaacaacaactctatgagatgtatatagttacttttattatcccatttttacaaacaaggaagctgagttacagagagattaactttcccaaagtcacacaacttctaagtagtagaagcatgatttgagcctagacagtttagttccagagtttatgttcttagttactacactatattgctgtataaaaaagtggttgagtttctccaaagaatagtttatcaaacttcatattacccccacatttggataatagtaagaataagcggtcacagcaatatgttgtgatttaatgaagactactgaaaattaccccttctacaaatgatctccctcactgtctttctctcatctggaattctaacagttagggtcttacctctcttacttacctctttgcaaataacagtgggagagttgagaccctaaaccaatatcaggcactgaaatatttaaaatgaatagtataatagtttataaaaattattttgtaatttcacaaggcccataggaaattggatagggaaactctgaggacaaggggcaaagagagccttctactacgactgtgaaaagctagctggcttttatgcaatgcagataccaaaagcaggaagcaggatggaaatgatggtggggaaaacatttgaagagtgtgaagcactttaagttaacgaaattttcacctatcttatctcattatagaagaagggattttaaaaactgaattagaccagcagttctcaaatggggtgattttgacccccagggtatctttgacaatctctggagacatttttgattgtcatgacgtggggaagggttagagctatgggagtccagtgggtataggccagggatggtgcccattatcccccccaggacaaagaattgttcagtccaaaatgtcgtcagtgccaaggttgggaaactctgtctcagagcttgcataagtaacttggctatgccatatacttgacaagtttcagagtcaaggctagaatccaagtaatctgatgacaagtcctttgcttgtttccgtattcatttccttcagcatgtcagagtttgatacaggcgatggctttaggtttttggaatgatcgtgatactgtttttaatggtataagttattaataggtgtttttgcttttaaagagtcatctcacccctcagaatgtttaatatgctccaagccagtgttacctcatgaaagataagtctgtacataaaacacaaatgtcaccttacatattgaattctcatatgccagtgtttcacaatttctagcaaattattttataaatggaatgtgactaactcctttaaagctatttttgttattattgaggtaattaagatttgttcaccactctgtttttgtcagtgcatctgctccttggcaaatgaggtatcagatggtctttactgagcaactgttatatgcgtagctgtgatgtgaatgaacaaaaggccttcttgtctgtgtcttttttttagccagagcttggatttagcttacgctaaattatttttttaattgtagatttgagatgttttattatgagaagttggtaatcatctgtgtaaactaataagaactgaaaattcatcatacatttacttatttttttaccttgatcttctagtaaatgtttagcttcatagatttaggctgctatgtaagaacattctcctttatctgagtgatgtgatttaacagagtaatttgtttatgagcatctcttattctttctttattggcaggaggacttgcacctctgcttctcattttgtcactttgggttcagacacctctgtaatagccatcactgggggcagatttcagtagactttgaaaaacttgttttccctgaggctccatatgcttcctggtttgcaaaatataatgacccgcaaatccttcaacaacagcaatggttaggcctagcagttaccacctcactggccatggctccagctcggctcccttgcctccaccagaagcatgggtcaccccagcccaaaggccaagacctccaacgccaggcctctaccagaaagcaacataggcaccgccagcaggtacaaactgcccaaccacaggtgcccttgtgccttgtctgcctcttgtaccttgattcgggatgactcagttaatttgcatattgatttcaaattgtcagaagtaacagtcaaaatacaaacagaaggcagaaggctgatgtaattactatattaaaagaaaatatattaaaatgatgttgtccaatttttcctatatatacaaatgaccaaataagagaatactttttttttttttttttttcgagacagggtctcgctctgtctcctaggctggagtgtagtggtgccatctcggctcactgcaacctccacctcctagattcaagccatcctcccacctcagccccccaagtagctgggactataggctcaagccagcacacctggctaatttttgtgttttttgtagagacagggttttgccatgttgcccagactggtctcaaactcctgagctcaagtgatcctcctgcctcagccccctaaagtgctagaattacaggcatgagccgccacacccagcctcgcaaacacaattttaaagatgaaagagaaccactgcctagtaaatatcaggaaacctctaggaaccttactgaccctatcttacctaattcttgctatcaatctataagatggacattgttagttctgtttcatagaagaggaagtaaaaactgagaaagttaagtaagttgtctttagtggtacagctagaacccacagctctggaatgtgaactcccatccctctgattccaaaattctttgtagaattcttccaccttcataccctctcatcagactgagtcatagatctggaccgggtcttcaggaagactgtagcttctccatctgtaagagccttcaaaaaagtatatgcagcatttgcaacccagcgcatttacatcttcacctgtgtttttataatgcttgctcaaaagttctatgaagtgaggctctgcccatcctagacccctgtttcagatatttgaaaggactctgttaagtatagcactagtgccaagtggttcaaccactctgaattcctacaacgtattaccgatttttcccttaggttatttatttattcatgtatttactcggccacttaagaaatatttctagtatccactacacgccatcctgtgtactagacccaggaggttcagtcgtaagacagacaccatcccttccctcagagatgctaccattccatgtgataagacaactaagaagcaaacaaataaaatttcctgattgaatttagtgggaagaaataaagtggctgcaggaaaacagggagacagggagaaccaccgtaaacagtgagttgggagagatctatcaggaaaagctacctctacactgagatcctgaaggtgagaaggtgacagctatgtccagatacagggaaatgtgttcaaagcaagcagaagagcaagtgcaaaggccctgaagtgggaaggatttcaaatactctggaatatgcagaaggccagtgtgactagagttcatcgaagggtagaaagattagaacaaaacagtaagcaagagaggctttttaaaaagctagatccattaggcttcataataaggctccagcaagaaattttttcagaatgcaatggcagagccaaggatatagctttaagccaggagagtgatataatcggatttaaattttaaaagatcatctggccactgactgaagaatggatttgagggacaagggtagaaataggcaggccaattaggaggctgttttgatagactaggtgagaaggagggcgtgaaagggatggaaagatgtgagcagatctgaaataaaagagaaatttaacagacatttaccttgagtgagctatctgtgtacattttttacttctctgacaagcctctaagccaagctgtgtgtcttattcatctttgtattttcctacttctcttctggtagtcatgatgaaaacagagttcttcaaaattcttcctcttccagattttgcatctgtcaacaaaaacattttcttccctgcagaaagtagatgtttgtctctaattgtggggcctgaggtttgccatccacatttgctcttctgccaaagtcacgctgagtcgtggaatattttaattttttttaagttcagtttttacatctcattaaaaatgtgttggctgacatatttcagaaataaatatgcttaataatacctcatttaatttaaggctctcatttagaaaaaaacactttcaatgaaaagacttaaattgattaatcaagggattttttcgtattccttattagcagttataagactaatggtgatctaccgtaagccttccctttgcctaatgtggttagagctaccaaagagaaatcgttacaacctgtctaatatttataatggctattccaactgactgttgagaccattttagcaagaaaagaattaaaaacactaaacaagtcacatgtctcaattatgtttatgtatatgtggacaaataccctaaataaagatgaggctgtcatctttactacaaataatgtagcaatgatttatggtttgaacaatgacagaatgacagaactaatttgcaataggtcatatgagataaatttcaccatttttggttcatttactttgatttcagaattaccatttctgaagatggaaacctcagaatcatcaacgttactaaatcagacgctgggagttatacctgtatagccactaaccattttggaactgctagcagtactggaaacttggtagtgaaaggtaatggctaacccaaagaattcgaatatttatatatgtgtcctcgtgtctaataatgtaatctaccgaagtggcatcattcatattaatatgtacagataccactgtattgctaaattaattcatcacggcaaacatgatatgattaataattcttagaaaactgctggtaatgaatatgattgaaaggctatcttatttcagaatcatccaatacaattttgagaattatagccattgtatctcttatagtattgtaacgaatgttatcttcaatcctttaattaaatttctttcaagtctctatagatttgaaattcatgtctaggaacactattccaacaaattaaaaactcaagactcatgtactatttttagaaaacattgtttaaacaatgacattggtaatttttaagatagctgtcccatttattcagagatatggatatggcttattatactaatagaaggctttgatcacctctatgctttgccttagtcacccagccaaccttgtcagttttaaggaaataaaattcccatataccatagcctgggtgctttataatttttgtagcagaaagtcctttatgctcttagcaaagcacgtgagtgaaactatttcaatattagcttcatggcatgggctggaagtgctaagtaaccattgaaaaggagaaaatcttaatttacatttcatttgcatttctttcactttatatattgccctgtcataggatttttgagttgaagggatcttgacaatgatttgactgaagaagatgaggctcaggttggtggttctctcaaggtcacgagtagcaggagacctgaacccagatcctgattctgagttcttcttggtcctttatgctgcaccaggaaacaggaagcctttcctgtttctgagtaatttatacagatgggtcatatcatattatttccttcttgcccatttgtagttcccttggtgaagacagatgaaggcaaataaaaatatcaaaaaaaacaatttgcctttaatttaaagaagaaagctaaaaattacctaattaaatattttagggtcattagaagttggaaatgtactactcttttgggaagtctttttatcattaacatacttgaccatgcagatagaaaattggaagtccaagagttagaactaaatatatgtttagattgattacaactatttcagtctattaattacttcctcagagcactagcatcagtgtatgactgactgcttgttcactctgtttcataggcaaaggaaaaagaggttagataatatttgtaaagtgcagttctagctagaggtttttgctaatgtatgactgtcttggctaaaggaagtttagtaatcatttaggaccaagagagatctcaatgtttcagagctggttagacacagagctgggatctgttatagattatttgtgaattatggagatataagagaatattaggttgacatcttaaatcatagttaaaagacagggattcaagtcagagtgatctggatttgagtctcatttctaccacttaccagctcttagacaagacacttagcctgtgtggggataatagcagtgccagtctcatggagtcgctttgataactgtgaaaatccatgttaagtgattagtgtggtgcctggcacctaggaaatattaatagttgttttgtttataaacatgttttcataaaatgaggttgttctgatgactgtggtaatccatgctaagcgattaacagggtgtctggcacctaagaaatattagtatttgttttgttgtttatatattttcaaatggatatgcgtgtattctaaatcctgttgaaatgaacatttatgatatttccaccccaatagaataattagcatagagaagtgagcctataataaagaaatgactaagaatatgaaagattcaaaacagctaagcatagaaaccatatatatggtgtctcatattgttaaaagtagggtattttcacaggtaggaacaaggtatgttctgtattttattatcatccttcttataagtattggcttccttggctctcccaagagttggcagaaaggagaggcctctatttcccatcagagtttgcatcccagtgataccacaagccccaggacaaaaccgttcccaaccaactgtgcagatccctgctgctcatcttacactgaatcacgatgcaaagcctacaaatatatcagggattaaatacgttatagttgcctcatttttgtgtggttataaatattgctaagatagtaatttctacctattctaacaaacaaaataatttatttcttgccttctagtaaaatgtgaacaagtattcacccaagtaagtataggatatagttttaggcagtttacagttacaattttttaaaattttattaactatttgtttctttcaaggtatattaggagaacactagttttccactaacggcaataataacaacaatatttcaaaataaatttacgtaaagaagtgagtcggtacaaagaaaagtactaaatatgcattgttataggaggatatgcaaaaaatcatgaagatggtatatgtgaatgtctaaaactaggaaacatgacttgaggacaatttccaggagagttttagtggacttatagatgcagaattagtatgtcctgcctatgctagccacatgattcgctgaaacatgcacaacactttaaaaactgaaatttcctaataggtgagagaacgaggagggactgaggtaggaagagcctggcccagtacaaaaagaggaaggcagggatgtgtaggtatgagccatgaggttaagggatgatgtgcccaggtagcctgattgacaggtagaattcatgtgtttccaagcagagttatttctggcagtggctcctggttctgagctgcagttagtttctccacagaggtcctctgattcttatattcttcttctaggtgaggtgggggaaaaaagttttatttggccaatatgttctcaggagttaacaatcctgttactttagataaggtcagaagagatttgggggatcatttatctcccagtgtggttggttctcactcccattagcattaatgggaagtacgtgtgtctgcagaggggccatccacagtgcgaggtctccaagaaggacattaacataaactgagaaatataatttaaaaatctgccccataaagcacgatataggcagagaaaaccattctgaactccgcatgaactgtgccaagtcctgaatcccacatcaaaatgcttgagccctgcacctttagtgcaagtgtaacagcttagcccgaaatatgactgagcgctgtattttaattcaattttgagatctacaaagggactaatttatcagagaaggtgttctgtaaccttaaaatgtgcttgtattctttccgatttcctcatgtgtctgggattaaaacaccgtgaaggtcgggcgtcagaacatatcttttctaacctttttacaatagttctatcattaaccatgctttcaaaatccaattctctttctccctacccttgcccccatgtttcggagagaggctgaagatagtgtcaaacacagggtcagcaggtaggggaggagagggaggtggcacatctattccaccagatacaggaggtttagaataaacctctgacaagcaatcatcacatgaataaatattcagattctgcatgagcaggctcccaaactgcagaattctgacaggtgcccagggggctcttgattatcatcccatcatctgaattcctaaattttactggttttgtttttcaggctagttataatatacttgggatttggtttgctgtttcattttaagcaagaacagttcttaagtcaaaccctcaaatactcacagaaagcataatgttagacctttaaacaaaaatgtgcttttgtgatcattgacatcattaagaactctacagagggcagggtacatttatatgcaatattgtacttactaaatcatgtttatctctacagcagagttaaaggggtggtggtgggtggggattttgcatgacacagtgcctctgctatacaggtttcatatgacagatatttttaagtagcagtcctagagaagagcaatttagagtatttgtttggatgtagttcaacaagataactatgttaatagcaaccctcactcctattgattatctccaggactcaaaatgtagggcagtatgctgtggatgctgttaacatagtcatcgtgctgaactacatccaaactgaccttgagcaattttgcaactggtggttccagactatactttgggaaacactgtcctacaccaaagaacttcgtacatgcatgccacctagcaagtgacagttcagtagagtgcatattagaagtgcagatctcctgggcctcactcctaccctaacaaatctaactcctagggaggaggcctggaaaaacctacatttaaaataaataccccaattgatccttatacacatcagagtttagaacattgcattttcaggggtttcacactatgctctgtgggccaaatccatacctgttttatataccccaggggctaagcatggttttcacatgttagctggttgagaaaaaaaccaaaagaacaataatatttttgggcatgaaacttttatgaaattcatcttttagtgtccataaataaagttttgttgtcacatagccatgtcatttttttacatattaactaaggttgctcttgccttacaacagcaaagttgagtaattatgacagagactgtgtaatttttttttttttttgagatggagtttccctgttgttgcccaggctagagtgcaatggtgagatctcagctcactgcaacctttgcctcccgggctcaagcgattctcctgcctcagtctccctagtagctgggattacaagcagatgccacgacgcccagctaatttttgtattttttagtagagacagggtttcaccatgttggtcaaggctggtttcgaactcctgacctcagatgatctgcccgcctcggcctcccaaagtgttgggattacaggcatgagccactgcgccccccgagactgtgtaatatataagtacctatataatatcctcaactttgccacttctgcaaaaccttaaatatttactagtaagtccttcacagaaaagaaaaatacttatcctctctttgataactttttctcttcctcagatcttcaaaattctgtccaaggtatagtctggccaagctatacacaacttttcttgtacccctgctgatcttgcatgctggaaatttccacatgtccttgagtctgattattagctggaagtggtagggagttttctttcccaggaccttagcctcaccccagtatccaaacagttgactttagaacttggatacgagttgaaaatccagaggagagataataaatcattgattgagagggaggaggaaaattacttggcagacactggaacaataattcaatttgattctccagcatgtggggaggattcacacagctggaaccagaatagtaagctaagaagaccctaaagtaagaagcacatgacctggtgtttttttaaaacacttctctcttcctaaacctcccaccgtcaccagcctaaatcagcagaactgttccacctttacctcataattctcagactgcatgttcttcctctaatagcaatttttttttattttgaaattgactatataaagttttaccctaattctgtctggattttaaaagagttcttttggcttttctgtttatttaaatgtctaaattcagtgcatagaattacttttataataagaaaaaataaatttatactttaagtagctttaatagaaaagaagtctttagtggaaattgactaagatcacagatacacgtaacaagaaattattttgtattttcattcttcaaccctacaagccgaaaaggttcctgtggtttagctgagcatttaacggattcctttattgccagaaagagtgctcattgttcaccccatagaaagtttatttatgtttaaatcaacagattttttcatatatatatatatatatatgtgtgtatatatatatttgtaccagcaccaaagagtatctacagcattactattgcgcactatataaaattcttctgttttaactgtaggacattgggaaatatcaacctttccatgcatagcataatagacgcaataaagtagagtcttttcagttggaactttattttgcaaatgagtttgaagcagcccaatcttctatgtaaaactgttcaaggctttatacagatttgacaggggatcaatcagaaatcagtaacatacaatgacggttggctgctaacacacaacaaaagcttttaacattggtcccttataactgaatacatttcaacccaattagatatcttccactggaaccaattatttctgggtgataattaagggtatttctaataggattaacacaaattgtgaccctaggcatctagagtaggaaggaaaagtttgtcattagaagtgctaaatgctaattatggtaggtccctcagtagaagaacatctggccagaacatttcaatactagatcctgttagatctgagatctgtcaccctggagttggtaccagctatggtaggagaatcttaaaagaagggtaggtaattgtgcatcttgttcttcctgtgttcacaaagcgtgtgacataacctggaaatctgatgaaacagggtgtgattatttcctctgacattcttatggacatgtgtgagagccacgtagattgagcaaataacatgcctttggcgatatcaatcatgagtagaatgattccccttttgtccaaatctctctgtaaaaaccttctctccttttgtaatgctgattgcataccatgacagtctgccctgactccagcctgcccatcacttctccatccttggtctagagggaagatgtaattccttaactgttacatttctctatgccaactctgtctttcgtagcaaagcctctatgctgaagacaggcctcgtatttttgcttttggcataaaagacactctgtgggtcaagaagcttgtgtggtaacatcacctcattaataatcagggaaaggcaatgtaagcatctgtgtggtgtgatttttttacatatgagactggcaaaagagaaacatctaacagtaccttttgttggtgactatgtgaggaaaatggtactcacacactctcagtagggatagaaattgcaatagatactgtggagagcaagtaaaattgagaaagtgcaatctccatggcccagcaattccattttctgggcatttaacctagtgggattcacacgtgttctgaggcagacttgcaaaggtgttccttgtgttgttgtttgtaatgaaaagaaaatacaaggaaattaaagaataatacatatggtatcattttatttaatatattgtatgattaaatataaaattagtaatataaaataataccttataatgtttgcatacagaatacacatgcggcataagccctaactcagtatttggagggaggatgcctggagtgagattatgtgaaaggactttagctgtattggtaatatctgtttgggtaaatttttaatatatattcatggggggaaaaaggctggaggtacatgaaaatgtgttaaagccttctaattctggaagagggaatatgagcacatattggtaaatttttgttgtagttttatatgtaaaatatttcaaattaaaaagaatacctcaggtcagaatcctacatggtcagatattgcaggcaaagccatccagacaggaggtctgttttttcagttctctctcagatattgtagaagagacaccttttacctggtgatatttaacccatcccatacaaataatttctttcttgtaaggaaaaaactctcctataaaatgaattaatgaattcttttgtaatgaatatttactaatcagaataaacaaaacaaacaaacaaaaaaggcaaacagaatatgactctttggcttcattatatgtgaagcacataattaatttcttttccagcaattcaaagagacttatgttatactgattcagtttaattgaacttattaccacaagaagataataagaaatatattgaagctatccatctggcttgcattgaaaacctcacatgtttcattcttcatgactgtcataggccatactaattgcctcatttcagctgttttataatcagtatgatttagctatgaatgcgataaaattcttactccagaggaagttgatattaaaaagcatagatctctcacctagctctgctaccacttctgaactcatcctcagcattattacagttatatatttttgaaatacataaataaaaatctatctttttctcgtgcatatctttttaaagtacatctgtcatcttccttctgtcatcctgccatagagctattcctttactgaaggaaagaaatggtttatgttaagcttttcagttcattaaatgtttaaatctcaaggtaggttgttttcaaactatggagtctttaaaaataatttccatagctgaaatggagtttaaatggctaattgtgtaataaataaagagaaaagaaaacttaggcacttttaccttctgtctctaaacatctgaacttcctgtggcttgagaatgatgctttgtcatgtagactggttttatgtgcacatgatctctcagaagaagacgagtttgtggtatgtctatgtgtatgttttaaatcatctgtctccttgtatgttagaggtggtcccatggggggagccaacagttggtcccaggtctgaaagggaaagcttggtttcttataaagcttgaatcagaaaggagacgtgtcagaataattcatgagtgactctccccttcctgttttggcatttgttttctgtgccagaggcaggaggagtataactctcaaagaggcagtcctaccaaatcacgactgaatttctttggctgtcgcaggcaatcaaatttaagaaaactgcccaaaagactttaggcctttaggttaaatacagaatctgaccaagatgaaagcaagttaattaacattttcatcatctctctctgatttactgtagaagatccatttctaaaaagttaaaatggttgtctcttttatgtatccatttgaggaggtgaaagtaggttcctggttatgggagaggaaatgtaagcagaacatttagagttaacagtggctttttgcttggccttctagcaggtctataatcagtgtgcaaaagtgcaagacataattaagtgaagattagcaacattgctttgaagatttcccaaactggaaaacataccaactgtcatcttattaactttttccccttttctctctcttcaaaagtagaactgcttataaatgtaagtaaagcttggattctacctagaagaggaggatccaaagggtcaaatcagaactgccttctcctccatgtatactttaataagcctggcccacatctctcctgatagaacatgtatctgcctccattggctttgtccacagcatgggtagaacacctggtcactgtgcaatttgtaccaacacttcaacttcttcatgtgtaagacaaaggaaattaaattataatgaccagtatagttgatgaagggacactctgatgcagtccaaatatgagggaatagtcaaaaggtacaaaagacaaaactgtctcctccctgtaggccattgtgagccgtagaccacaagcatcagaatcacgtaggagtttttaaataaatgcatattcctggaccctacctctgacctgcagaaccagaatctccagggatgagacccaggaattttcattttcaacaagttcttcagggaatgcctacactcaacaaagcctgcaaacttaggagctcaacctttaggagtagatactgataaacaaagacacagagctgtgttcaaagtacagaaggaacacaaagggaggcaaaactaactaagaggtaaaggtgacaattgaacagggaattgaaatatgagtaagagtctaccagattaaaaaaaaaagtcaaggtaatcccaggaaaaagaaatgtatctaatggccccagtacatgaaggctcctagcatattcagggaaaatacagtggaaaagtgaggggaacacacccatagctattgctcatatttcaggaactgtggaaaataggcaaatactttgattccctttttaatggaaataaaacagatttcatgaactgtagctaagtgacatgacgccaacttcagtagaaattttgcttcttctaagagacattagaatgaaaagtagttatcaccagcatatgattttttaaaattatgttgtaattatattatttgtagaaatattagcaaaaagataatctcatcattcagagagatccacataaatattttttatattttcttctagaattacatccaggctgtattcaatccatatctacatctgtatcttaactgtgtatgtatctgttctcagatctgtaaataaatatccttatcacaaaaagatcatactgtatacactgtttgtaacttcttttttcattagtatctttctaccagcatagattattttgaacaataaataaggactagcctggtttctttatgaatatgtttctatctcctgctcctcaaaatagcatcagcaaaacaaaacaaaaagaacaactcttgtaatatctatgtggggaagatagaagaatctgggggatgtttaggaggattgtttcacatgtttcaccctgaaagtgttggtttggggattgtcttagtccacttgtgctgctataataaaataccatagactgggtaacttgtgaacaatagcagcttctttctcatggctctcggggctgggaagtccaagatcaaggtgctggcaggtttggggtctagggaggggccaattgtcagttcctagatggcaccttgaatactgcatcttccagaggggaggaacactgtgtccagaggggaggaacatggctaatttgtcctgacatggcagagaggatggaacagcaaaagaagacaaactccccacacgaaggtcttttataatgacacctaacctcattcatgactcagtcacctcctaaaagccgtacttcttaatagtgttgcattaaggattatgtttcaacatgaattttggaagggacacaaacattcaaaccatagaagggatttatgtcaatgggggaatgaaatccctagccattctctgccctttcctcaaacttttcctattgaaatttcttatcagttgacacatgctgttactgataacatgctgagtacattctctgatcacatgaatcattagggaataaactaaatatcagaagtagtattcaaaattagtttgaaagataatcatgtgaaccaagtgtaacaagatacatcttaatagtgataaaatataaagatttgcatttttcttcaaaactcaggatgagagagccaaattttagtgtcaggttgtgataggtcttagatgactataacatcatttatgagtctacaatatatatactctttaaaaaaaaaattaaatctagaacataatagtgtccaaaacaagagaggggggaaatatagagatctactgataaaaatacaactggaagaggattgcttttaagatagacattaaaatttgaaatcaccttaaagagtgacaactgggatgataggaacagctgtagaaactgaggctgggtaatccaaggaagagaagacttatagagggtgggaggggaggggtggtcagtgttttcaaacatttaaagagatatcaaactctatgtgacatcagagggcagtaccataagagatgagcaggaactgctggagcagaggatattacttacgtttgataaaaggaaaattttcaaacaattaggccattggcctattatgtatgacattcatttccagactagacatctactctagggaaatatggcagaaagaattcatgtatcagatacaagtgtgtggtttgagtagcctgtagggtcattttctattcatcttagcgttctcagggtctgccctaagtaaatgttgactcatatatcccacccaactctgaaatgttatcattctctgattttatagcttggaaaacttacttctgccctaatgtgcttctactccagagcaaaagcatacccctaggttgaattctgtcacactgactttgttttcttactgtagagtctttctttctttcttttttttttttttttgctttcaatgtgaatttatccataatcagcaatgcagtatgggttgaaaaggttattccgctaattttgagtaatatattctcaagtaacctattctcaaaatagagtccaataaaagtatccgttttctatttaatcatatgttgggatttgaaggggttcaataaacagtaccttgttcagtgcctgagttttgaaacacttgagaagtaagttgaggcagttgggcagatgaaaatcaaatgtcagctttgctagtgataaaggggaatgtggctcagggacatagcaataatgggcttcctaacactgaactccaaattaagcagacttttaccgctacacaacctcaagtctctctcactacgaaaagaaaaataaggagtggaggatcaacgcaataggtgtacatccttcactcttccaggagaaagaatggcactgagccaagaattcctcattgttttttcccagatgcatcactggataaggagtgagtaagaggaaaaaagaggacaggcatgttaggaaacatcaggtgtgtttaaatgtcagctatagaccaagggttacaaactggtagctctcatggctaatttgacttgaacccacagacttgtattgtttggctgtcagagtgtttaaaccttttaaattagaatgcctttagacagggggcatgtattctctaaactgaccccagacctaattattccgtattatcttatagctctaaatcacatgcttaggatactgccacatcctctgtaagcatttgacacgcagtattaagtgggtctcattgctctatgaaaaaaagccagctcttgattatttccaatttttaaattattaagtagatgcaaattgaccatgatggggatttgagaagacgactactagagaagagaatgtttcaaatctttctatttataatgctgtacatgattctacactgaatctgcatttcactcccatatctataccagaaggttatcagtggaagagaaattcagttatctgaatggacatgatcttctcaggagcagtcagtggttaattgggacaagaaaacacaagtcattatcattgagaaatctgaagcaaattgaggcaggttgtcacctttcaccaggaaacaaattagccctgtctttaaaaagacttctttctctctctgctgactggggattcctgtcaactgccaatgaaatagggagagtgtagattaatggtactgtaacagtggccatgaaacaaccataaagccgttttctaatttttatgaatatttttaattgattcgaccagtgtgtttgaatgacaaaatttgtgctaagcttcagctccagaaaatcagggtgccatcttccagctgaaatcagtaggtgcaccagtctgtttggggaaagttctgtgtataaagaaaaagccataaaataccgacaaagtagctcttcctcttggctaatttaccttcatgaactccttgccaactagggacgaatataattcaggtttagctcaaaaaagagagaaacagagatagagagagagagaaataataaaatagtaggtaacatcctgagttataagggttgcaagtaggataaaacttgagatatgacctactttttctacaatttgtgaatatgggaatcattgcagtctaatgcaaagaacagtgaactgaggtcctgtacatctgggggctggttcccagattccagttttctcacctgtaaaatgaagagcctttaatcgagaaaatgaagtccccttctaattctaaagttctctgatttgatgaagaagaagttggaataaagcattaaaacattccaatttcaaatttatttgttaacagtaacaacaaatttatccagagatattctaactcaggcacccccaaaaatgagatgaaatttttcatgtgcaagagatttctattttatgaacatttattttacatgcatcaggttatggtcactcaaggaaagagaaaaattaccatttaaatcgtgtgggcagttttaccaaccagctcatccacgaatggtcatgcgatgaggacctgaaaggacattggactcggtttgcctcgatcttcatatacctgtcaaaatgtgatgatcttgccaggctgaatagaactgatgacattgattttacacagtatggccaccaaacacaagcaagccacttcaaatggctcatagagaaagggctagagagaaaactggttcatttgaacagcatattgattccaaggtggtgccttcctgggagacttctaagggcagttttcagtatataaaatgttttgttttagatactgactttaaaactgagccatgtgtagatgtatcagaaggcaaggaaaacttgtatacaaatgtccatagaagcattattcataatagccacagtgaaatcaacccaaatgcccatcagctgatgaatggataaaccaaatgtggtgtatccatacaatggactattattcagtcattaaaagaaatgaagtactgatacatgctattgatatgtggatgaaccttgaaaatatgatgctaagtgaaagaagccagacacaaaaggccacatactatatgattccatttctatgaaattcccagaataggaaaatttatagaaacagaaagtagattcgtagctgccaggggattcaaggaggcaagaattaggactgactcctaataagtacagggcttcttttggggataatggaaatattctggaattagatagtagtcatggttgcaccaaaaaaaaaaaaaaaaaaaaaaaaaaaaaacaaaaaaaccccactgaattgtatacttcttaaatgtttatttatttatttttgagacagagtcttgttctgtcacccaggctggagtgcagtagcatgatcatagctcactgcagccttgacctcctgggcacaagcaatccttccacctcagcccactaggtagctgggattacaggcgcacgccagcacgccaccaagccctactaatttttctgtattttttgtagagacagggtttcgccatattgcccaggctagtctagaactcctgggctcaagtgattctcccgtctcagcctcccaaagctgtaggattacaggtgtgagccaccatgcccggcctgaagcgtatactttaaaaaggtgaattttatgttatatgtattatatcttcaattataaaaggaaaaaataagtaatgatctattttgcacacttaaaaaaaaaaagaatgaatgaagacaaaaaggaagtaatgaagcaaattcatcagctgtgatctccagatgtcctagatgtcctagagcttgacatattcttaggggtcaccagcttttctcctctcagttactttggtgtttttcctgatccagcctctactctgataacagccctccactctattcctagaaaacactgttggagaatagtccccccatcagtcttccacccactgtagctctacaaaatctgggcacccttcctctctatttctgtgacaccgtacctgatatttaaggcagagttactggacagagaaggtctctgacagatccattacagtccatctgttcccttttcttctaatgtattatagagggaagaatataggctttgaagatagacaaatcaggttctaatctcgacattaccacctataagctgttgaaagtgcgtttgtaaaatttatataatagtacctatttcataggatagttgggaagactaaattagatgatgttttaaccttaatcagcacacaccagcactcaaatagttactctcttctcttgctgtactgttcacagcccaccaatgagaaccccagtgtctggccaaatggccgcattctgctaacatcttgtctatgccattgtgtacttggcttcacaataaagcctttcagacccactggggcagtggtcctgtacctgtagctcttcaggggtcagctgggtggctctatccccatgcctttgggtggaggctgcctggtcggtggaagcaagttgaagctccttcttttaaaattcaagaggcagccctgatgatctctgaatcacctttagcgtcattcttcccttgtcttggaaataagcacacattcactgccaaatagctttatagtcttctataaaatcgaaaaattctggtagcccttcttcagttcttcccatcttcttcctcttcagtttaaattggaagttttcctgctggggtggctgattaagtcagtgattcacaccgaggctaatctccttacccaaaaatcacttggccacatcctttgtattctcttcagaaagtgcttttccctttttatttttgtctttgcaatatggataggctgagatttttttcaaatgtttaatttctacttcctttttgcttactaattctgtcttctgatcatttctctcttctcacattttgctataagcagtcaggaggaaccaagctactccaaactttgcttagaaatctcttcagctaaatatccagtgtcatcacttgcaaattctccctgccagaaaacactagaacacaaacacaattcagccaaattatttgccactttttaacaaggatccccgtttccgcagcgtaagcagaaatttatttctcacagttctggaggccgtggtctagagagttcaagaccaaggcactggcagatccagggtctggctagggcctgcctcctggtttggaaatggtcatttaccactgtatccttacgtggcagtaagagaactagccggctttctttcctcttcttataagggcactaattccattcatgagggatctaccctcatgacctaattatttcccaaagaccccacctcctgataccatcacattgggattagagtttcaacattggaatttgggggttggggaaacaaacattagtcaattgcactctatctcagcacactgtgtagaattttttttttttttttgagacggattctcactgtgtcgcccaggctggagtgcagtggcacgatctcggctcactgccagctctgcctcccaggttcacgccattctcgtgcctcagcctcccaagtagctgggactacaggcgcccacccccacgctcggctaatttttttttgcatttttagtagagacggggtttcaggatggtcttgatctcctgaccttgtgatccgcccgcctcggcctcccaaggtgctgggattacaggcatgagccaccgcgcccagcccacgctgtgtagatttttaataatacttttgttatctaaacgtacttttggttttggttatttgaacttcatgtcaccctcatgggaacataaacttcacgatcagaacactcacgtatactcatagtctttgacacgtctggcccatattaggtgctctgtaacaatttattgaatggatggaagaatgaattaatgaaaggaccacatgaccaggtctccttttgcagtgcattggaatcatcctatctcagagttgattcataaattgccccaactagaaggtccctttgcgatttttgaaagagatagtgatcatctcttccagctcattctttttgcaaaggatactagaaagggaaaattttatattcaagctaaggcccaataattaggccttttactataccttattgtctcacagaggaacttagcaaattcttgttattcaagtaactactgagcaaattagtaagcagcagaccaaggaaaaacagaggtcgtcaatggggcatagtgaaagggacatgggctttggtgtctgccaggcccgatttcatatactaactccagacgttcttagcagctctataccatggaacaattaatctctagaagtttccgtttttcctccttaaaatgggaggtccaacctgttataagaattagaattttctctgtcaaacatctaagagctcctggtgttgagtgtgtacctttaactgataatcaatatcattgtgtttgtattccttttgctacctccccgcgccatcaactccactaccatttatccaagagcaatgtctccaagtgcttaactgtgtgtctcactgtgtagttccctgaaaacataccaaatcccagcagtgtttttgtagcagcactgaagtctgagaaattagtcactctcctcctagaaaaagtaaatcattactgtatatctacttcttatatttatgttgtttactattgtgcatgtattatagaacccacaaatcaatgctctcagcagacaaaactgttcaaatctgcagcacgtcttgttgtgtactaggtatttgacaaaacagtatatatctgtcctgaattctgttttctgaaggatggtggtgtgagcactggagtctgtgattgatttctgagtaacttgtactttatcaaggaatagatgtgatttctcatgtatctgattaaccctccctgtaagattaccatcatttctataatgccagtggattattctgtgcttggaaagatgtatatcagatcattttaatcaatagcctacaaaaggtgtcacctggctctgcctgtggttatctataatatctcacccaaagggtgttgtcatttttcaaataacctgtttaacttaaagcacctaggaaatgaagttgcctttattttgaaacagtatgcagaacaatatgttaggtgaataaaatgtatgcttgttttctgcacgttaccctattaaaaagagagaataccagtgtggtaaaatatccacttatccatctccatcacacaagactggcttggtaacccatagattggtatgggagcaagataaaagtagggtatgcaatagattctgtgctggcatagcaaaatgggagcaatgaggaagtgacactgggctatcatataatcttttatcccaattagaataaatggggtgctgcagataggctggaacaacagagataaacccaagaccatcctgggcaagcaaggacacatgtcaacaataaagtcataccctgttttgtaatttaggaaactttctcatgatgttgagtaactgggacatttgggattaatgatgtatctgtgatgtactcctctgttggattccctgagaaaaatcttttgagatataaactaatcattgcttactattcagccatgtagagaatgtgtgtttccatacttaagataatgagtcctactaagagagaagaggtattaattcttgggagggataattttatatcaagtttagacagttttcagtctgcactaagctccttttttatggccagtttaggaaaaatgctaatgcctcgtatccagacctgtttggagatagagcaagtcaagcagaaaaacgccattctcctaaatgagcgttaggccacagaacacgaaatctgtcaggcagcattttacctggcatggatccgccaaagaaaacaaacaaatcagagttggattttttaagactaaataacagcaagccaaagaaagagcatttacactgaaaaaactgtaaaggttgacaacatcctcaactcattaaatatgatggggaagagtaaaatatgtagcacttttgctccttagtgtgggcttttaagcctctccttcaatcgtgatttcactacttcgtctctaagctatagattctgcctttgcaaaaagagaatacccacctccctaagtcgttccgtgtctaagaaaggtaacattatgcagagcattaaacatgtaacctgacacagagacactctacataataataggtcatttcccttctcaaacgacccagatttctagaggcaactagctatagcttgatgcaaaagtgttgcagtttttaccattacttttaatgcaatttaaaacgcaactacttttgcaccaacctaatataataggaatagacaacagcagtagcaggcattcgggtttcccattgtcctcggcattctagggcaaaccaccaagatctaataagctgtgagattccaaaagaagggcgccaaaccttgggctgcacggcttcaaacttcgtcattacagaatcaccagcgtctttcttggtatgatctgcgggctagaggacaagcctggtgttattagcacagtgagcaagtggcaagagcaccacctccggagccacaattagggaagtaccatgccttgccctggcatgactggagagtaggggccaatgttagactataagagttgactaggattgattgccataaacagtgggccatggttactttcctcggagcattgcagagagcctctttctctgggaggccagcctacaggagatcagtcttagacaagttaacctttacctttcaattatcatggcttaaattttcaggaactctcttctagtatctgaatgttccttatttgtagcacccttttcttgtttatgcaaataaacaagaaacacccttttcttgctactgtcaattcaatatctaatatttctctgaaaataataatgacagaatttcttttttttttgagatggagtcttgctctgtcgcccaggctggagtgcagtggcgcgatctcagctcactgcaagctccgccccccgggttcccgccattctcctgcctcagcttcccgagtagctgggactacaggcgcccgccaccacgcccggctaattttttgtatttttagtagagacggggtttcaccgtgttagccaggatggtctcgatctcctgacctcgtgatctgccctcctcggcctcccatagtgctgggattacaggcgtgagccaccgcgcccggccagcatttctttttgcttgccttgaaattgatcttttgtgttagttgtcctcacatgtctattgactcacagttgttggcccatatttaagagtgtggcacgaaaaagcctatgtgaagccgtgaacatgtagatgaagttcattgactaagaactgggccatttccttgtggaactccccatacccacattaatatttcggtgtttccttttcggctgatcgctacctagagaaagaatatctagtacctagtctcatttggaagaacacagaactcaacagcagtgtcctgggagcctccttggggaaggagactgagaatctcagcttcactgtatgaacactcactaaatccctgctatcctcagttcaacctggtgtcctctggcccagagacctacctctgtattacctgctcagaaagtaaaatcccagaatacttctgggatggggagggttagtcacctggatgcatggaataagggagagcaaatagggacctaattgattttaaacagcatcttccagtgctctgttacctgacttcaagtaatacccgaattcccaaatctttgggcatttttctatagagtaagtcagactgtttcttgtctttccccactgccagtttaggattcagggtttcttatctgctaatcatccagttgctttccagtattttaacagtaatacctcccaaccattctctctgtctttataggcttatgccattaaaaaaaaaaaaaaaaaatccttgtactactgtttaaaaaagttttagaaggttcctaggactctaaaaggatcattgtgacgaagaaatggataatttaaggaagccagcacaatgcctgacacataattgtagtgattatttttgttattttgttaatattcaatccttgtaaaatcatccaagtttataaattatgtactatatagccaaacagcatggacgaggagggcgctgtgaaattaagacctacgtcgttcaccttcccagtggtgtcaggtcatctctacaaccatgagcttttagtatggttagttcccattccatttcatttagaataaccttgtaaaagaaacagggattgggtgtgagtgacacctaaccactaacatgataagcattctaaatctatgttcagcatcatgtaagtacaccctcattgaaatgcagatctccactactggtaattccacacactcctattgaagaaagaattgctcctctgaagtttgctaccccatcctctcacgtttatcacttctgcaaagtcatgcagcatgcctcaggtgaccctgtgaggtaagcaatcttgcactgtatgtgggcatttgcgctgatcttcccagaagcaacccttagtccttgcataatttctagcctcaggagaattataagatagaagacaagtgggggaagaaaaggtttaaaaagattctgtgttctttaaagccagatacttctcagctaagcttttctcagacctttcatgtccctcaataaagtatatttttggctatgccccataaactactccaataatccattaagatagctgtagaaatcagcatagcaaactatcagtgagctggtttagttattcaccggttattaatcttctcagctcagggtcatattgtcctgtcttcagcatttttcacagtgtctgatgatgttcagagagttaatggaggtcctgaaatgtggatacaacaagcatgataatcccttgacttgatgtcattctagggatcgttttcaaactttgtgtgttgccctggcaaatgagcaagaaggcacctgtgtcacttatctggatgtttgtacactgttctggcaaataaatgtctatgtacaatgataatttccttatgatactttcactagcaacaacttgttttgagcatttgttaccagttttagtagctgtcatttttgtttcttctttagcttccttgtaaagtcgaggcacattttgtcctgacttagagtcgcgatatttctttggagattcatgtgagcgtcttcctctcactaaattttcctctccccgccccagtctctgcatgtttggagaagttatcttcctctgaagcttcctgcacttaaaacagacccaggcacaagagacttccatgatgatgatggtgatgatgacagtgatgatgaggatgaggatgaggatggtaatgatatctttattcaaacactgaaaccattcatcatgttatatgcaaccacaggaatattacaagttaagaaacaaattaactgacttacaagtcaaataactttcccacaatcagtcaactagtaaggggcagagctaaaatttgcatccagatttttctgacttcaaaactcagtttcttagctacttccagtctgtaagagcagctttctgtctagaatctgtacaccctcaccacaagaatctagatagctggttttcctttggatctgcatggtacaggcatctatctttacacctggaagaggttcttttacttaggatgtctgtattcaacaaaatatcagttgagatcacgtagggcattcttgacctttgcaaggattttggcatttactctgaggtaaacgtggaggcatctttgtttctgtcacattcttagtaatagctagcattttttgagcactttttatgtagcaagctctattcttgtttgtttgatcggtttggttttttgtttttgtttttgtttttgagacacagtctcacactgttgcccgggctggagtgcaatggcgtgatctcggctcactgcaacctctgtctcctgggttcatgcagttctcctgcctcaacctcccaagtagctgggattacagatgcacaccaccacacccagctaattttttgtatttttagtagagacagggtttcactatgttggccagacttctattctcaaaactttgcattggctgggcgccgtggctcacgcctgtaatcccagcactttgggaggcggaggcgggcagatcacctgaggtcaggagtttgagatcagcctggccaatatggtaaaaccccatctctactaaaaatacaaaattagccaggcatggtggtgcatgcctgtaatcccagctactcaggaagctgaggcgagagaattgcttgaaactgggaggcagaagttgctgtgagccgagactgtgccgttgcactccagcccgggcaacaagagcgaaattccatctaaaaaataaaaaaataaaaaaaaccctttgtattaattcaccttagaacatcaccctcttcttactctcgaaataagtgtctctttttcctttcttccccgtgcaaatctttggcatcaatagtaatggtaataatagtatctcatactctgtagctctttatgttttatgaagcatgttaaaatccattaactcattttgaatttcatagtcatcctgggatgccaaataccatctcctccaaattatagataagaaaactacagctcagagacgtcgaatgacttgctggtggtttcatgcctaatcagtgctgtatggccaaacctagaaactaggcttttagacactaaattgagtgttttatatatttcatcatgatgacatgtttagcaaaagctaggttagtatcagagagtcagtaagagaaagtcctttactccctgagaagacatccagcaactatttctgagatgagctctagacctgggctgatttccagtgaacggagtcctgcttattactggtgctccagcattgtttgggagctcctgccatgggaaaatagcagggtatcctattgaccgccagggtgcccaagtgaacattgcatcctgcatgaaaagtgccctccgggattgtaaaaagtgtcaggtcctgttatggtaactaaatgcaagataacctttctgtggaaagcaagcatatgatggataagaaatgattttgtaaactatggaatgatctacaaatgcaaaataccatatgccttgtacatcttgcctgcttgagtaaatgaatgatttttcttatgtatctctctgtgaatattggtttattcgatgctgcagcagtttgcaaactctgttcactcttgcactgcagcccagagacacaccctagggagttggcatgtgtcatacaaataatgtgtacctatttgttataacctaggcttgggtcttgcctcactatctttcctaccaatactgagctattagattctaatggataatctaggaagtgaatacattcctgtaaactttaacaaattttattgaggaacagacatttaaatgtacacacacacacacacacacacacacacacacacacacacccctaggggttttgtttgttttaattcaagaaactaacacgtttgtggaatgaggaagtcattaatgttttttgactaaccaagacctagccaaaaatctatttctctttctgcccttaatctctttctgaagtatcctgccaatttttaatgctgaccgtttctcaatactttcagtctgtagtagtactagagtgcttcacttatcactgtggcaaaacctacttgtcattttagagaacagtaaatgtggatttggaaaatgtgggactttgggtcacgtcagaactctgacttaaatttcaggcaccctttagttggaagtggcaagatacagcttatctgcaaatgactgtaattacaaagatagagcttgcccaacaaagggtttctattttaatatcataaaaaccaaaaggtggaatggtgctccacaaaagactgccttttcactttctaaaaattcttttctggctctgtgtactccacttggtgtgaatgtcatttattagcatgtgatgtctttgtggagtagaggattctgccgctctctgcttgtctgtcttgctctgtttctctgcattttcatctccttttccttgtctcttggctttaacattctttccacctccattaccctttatattagattagatctaacttttaaattatttgatgtatctttaaattttgtgttccctgtacctaatttaaaagacatgaaaagttgtaaacatctctctgaaaataaactaaattaagttgctttatacttgcgtgaccctcgattggttttttttttttttttttctctttgggtcagcaactctcaatagaaaagtttccttatctctagtgtggaagattggactaaatgtccagtgaccttcaaacctgctccagagagtagttcttccttacaagagtgagttttccaatgatttgcctctttctctccaaaatgaaaaacagtaacaaagtcttaattcagggctcttcagattttcattctccctcctttaaatttcactgaatgtgtatataggtctcactatgaagcaagcaatgcagcaggaagaagagtctcttttagttaaactcataatgccttacctagctgcacacaaagggggcatttcaacaattgcaggggacctaatatctattaatagttgcccattctgaagggtttcaggaaaaagttcacttagaattacagacaagtcctcaaacaagctagtcagtggtggaccagactgttgggggtgggggagggaggattgtttaaggttttgttttgcagaaagcttcatcaatcaatcctatctacatcaaataaagagagggtagctaatattgtctaccaagatattaataccttctattttaagcttcatatgctcctcggtgacctcatctcaaatctataagcaaacaaagaagtactgctttagaatatgcgaattattgcttctttcccaagatgcagtccttaaacagaggaatctgaaaacatgtagaaaattgctgacaggagcaggttaaacagaaaaagagggacactctccttctgctgaggtttcagcaccatctactgtccagaatattaatccttccccacattgcactgtgtgtgaatggcacttggtttttcttttgcatgtaatcacaatggaaggcattgtctttggaattcattgtccttgcctcaaggtgtacatttcctttcttttatagtttaagtaaatattcgcttactttttatcagtagatgcagcccgatgcccagcagatgcaatcacacattcctttaatcagcaaagatcttattatgccattcttacacattgactatgatgaaatttactgtatttcactgatactaatgggattttggggggactcttttgctcagtgagtcataagggagagttacttatgtgcagtcactgaaataaacagaaaacattctaattattatttgatgaaaatgtttctccgtgggtaaaagatatctgtggttcccatttatgattcttttttatcttccatcacagtcaaaggcacgccatagagtgattttaattataccttgactcgaagatacaatgtatttaatttgtcattgacagtagtcttttcctagtcctttcagattgtcatttcttttgaatcgtaaagaaagcttcaaaaagaaaatgtgagagggcaaatttaacatataccccccttccctcttctgttattacttgctattttgcttgaggaagtattcttattcatagtgggaagcttaggcacctgcagaaaattctttgcatttagaaagacttcccagatgagaaaccctgctactgaagcatggcacaaatccagaccccggaggtttgctttccctggtcatgggtaaaaataaaaacaaacaagttgacggtgaatgactttaagacagattatatcttgcttattaaaaacaaagaaacaaaaacctccttattaatcgttgtgaccaagttagagacttgggaggcaaccaagagcattcgagcatcattagaaccgtcttcataattaaataggtgctttatgctacacattttgaccaggcagatctaataactttgattaccacctgactgattgtttcccaagtacctatacttggccaccctcaattggcttgtgcatagtagtttccatttgtggcagtcaagcttattaaacagctctgctttgcgattttcccccagtccttgaaaatagatcagtaagcattccactcaggggcgatttgtaaattgctttacacaaggctccagtttgtgctcacgccgactggggtcaaaatttgccttgtgttttcttctgatgtcatttgtcaagttgcacacgttgttccgagaaccaggtcacaatactatgtggctgtgcctctcggtatgaatcgatgaaaaaccttgacttgtgaacgtgccctatgctacttctgtgttttcttctgccacctaaaagggcagacttccttgtcttcagccaaaatacacttattgttctttttccaattggttcctcttcccttcttcttaaagcaaagtcacattttaattatgttaacaaaaagagaggtaagataaataggggtgctattgagagaactagcctatgttttaaaactgtaaaaattctcaattcacagacataattcctcaatggaaaacaaatcttagagaaaagtaaatgtgtctaaaagagatcaaatgtgtaaaggattttccaaagagcaaaattataagcaaagtagacacttaggaacaaactacatatatagatgtctgatattatgtgagtgatgataacctgaacagattttatttcatcaggatatttcggcagttaaagcttacccctaaaatcaggacttggagctgagctcccttccaggaacctggggcagacaaaaaaaattctacccagatttgagacctttaaaggacatttacctgtggccagaatgggcagcaaggccaccccccaaaaagagtcagacctgtacagtattgggtgcaatgtcctttattttgctatgccgtgaagtgcaaactgcacatttttcacataacctgatacaggcctttacagccacacaacagggagaagtgggtgctcacgaggaagaaaaaacttcgcttataagatgaactcccaaaccaaaattacaaagaccttgaggaagtctgccaccataagagacaatcagcaaatagaacaaatggcaccttcaaaagtagcaataacggaaccacctgaaaaggacttttagctaagtatatgtagatttctcaaggataacctcaccaaccccatccatcatttcctacttccctccttaccttcctaacagaatggatttgtttctgaaaagtaactcaggaggaacagaacaaactggaaactgtggtgtttccatttgtttgttttgatagctccttcaaaatgtagatcctaatgacccagcggagaatagtaattataaaattaatgtttctcccatttaaggatgaattattctctaaaaactaaatataattttaagtaatgtcttgctcctgacaataggtattttatgaaagtattaattcaggttttctccctggtgtgaaatgcagaaactcaatgtttaaattttagggaactgatacattttctttattcattcttctttttataagtagcataaaactttaatttttaaatggcatatgctctagaattagtattcgccatcttttttattttattgttctgtggagtattcattttaaatatttacattttaagtactaaagcaatctgagcaaccctccctttcctgtctggcacagaagagtaatcacagtgagtgaggatgcagaatggtgaggtaggttggagagctctatggagacatggctgtgggtgggtatagaggtggtgggcagaggagacagctggcaatgttggcagattggttatactgaacaaaatgtaagttgattaagcaaattaggaaatgttttcaggataagatacagaaatacttatagatgtgtaggtattatacatgtatacacacatagatatttcccagctctgttgctgagaaggcctaggatcaatgaccctcagtaacaatgagcacattgggtctccacctcttagttctcaaagccatcctccactaaaaagaaccagagctccctgacaaaatgactgattctgggactattgcaggaaaaaaagtataatgtgaaccttactggaccagaaagtaaagaaacacttaatgaataatagtaaaatgtaaaacatacgaagagcccaacttaaaaggactcccagtggccaaaatggggacaatttgagcatcagtgtaaataatgatagtaatgtattaccacctgtcaaaagaagccatgaatttatcctaatgtaagtaagtatataaataaatgggggagaggggaacactcttccttagagtagaatgtcagctgatatatgtagaaggaaagatagcaatggagaatcaccgtttgacaaccatcataaaagccactaattcaggaaggagtctttaatggattctaaggctggtgggtacaagtttgatgaccatcaggtactggtgtaatctttgaatacctccccacaaagtactcattatttatttatttattttagtttattattctttttcagacagagtctcactctgttgcccaggctggagtgcattggtgcgacactgcaacctccacctcctgagttcaagcacttctcttgcctcagcctcccgagtagctgggactacaggtgtaccacactcaactagtttttgtattttttttagtaaaggcaggatttgaccatgttggccaggctggtctggaactcctggcctcaagtgatctgcctgcctcagcctcccaaagtgctaggattacaggcatgagccatggtagccagccaaaatactcataagttacaagggtgtaaatggtaagaataagatggagaagccaggcaaacaccaccatatatatatatgtgtatatatgtatatgtgtgtgtctgtgtgtgtgtgtaggtgtatttgtgtgtatatggtagggagaaggggtgtgtgtgtgtgtacacaaatatatatatatatatatatatatatatatatacacatgcatatatatatacatatatatatttacacacatatattgtatatgggggagaagaaaataagcaaatacagtaaaatattagctactgaggagtgtatatgaaggtgaaagagttctttgtacttttctggcaaactttctgtaagtttgaaattatttcaaaataaattactttttaaaatcaagaaaaaagtacaaaatgtggccttataagaaaattcagcaataaacacagatgaagggccagtgcttgcatggtgagtgctgagttagccttcaggcagttcctttttaaaattccatattcgacataagtctggataaataataagaaatacttaatatagcttcctgatttatagtacttcaagattcaaggccttattttcatcagtctcccacagggccactcacagattgtccataagttatctttaaccaactctcatgagtaggaacagaactaggcaccagggacttataaaagtgtaagatctagtccgtgactcccagaaagctgatcagttacagggggagaagcagggcacgtgtaaaaaagacaaatgattttgcacaacaatgcactagcttaatgtcgaagaaagaaaaacagttaattccgatgagcttcatgaaaggataggatcaccagcgaacagggtggccaggaagggcatgtggggaggtggctcggattcataggctcttcaagacagtaggctttttccagcctggctggccactagcagaacttggcatcccctctctgagggcgcccacctccacctgaatacctccagaaatggagattcatgttcttctgtggcagcctatttccctgttggaaaggtcaaattagtagaaagttcttccttctacagagccagaatatgcctgtttgtagttactctttgctttctactttggggcaatgcaaaataaccttagcttatcttctgcctataagcccttcacatatttgaggactgttgtcatgtctctcctaatttacctttctcgtgccaaacactttcagttattttagctgctatggaattattagatctttcactaacccaggtatactaatgtattaatgaatccaaaacacgttcctagtaagctgtagtctgactaatgcaaaatacaaccagattattacctccctaaattggaacatcatgtgttatttatgcaacctaagatttcattccctttctttggcagctgcacagactccatgagcactgaaatgcttaggtattatccatgtgagctgccaatcccccagcatgtacttagtagctgattttttaagtgtagttttttgcctttatccctattaaagtttgcctaggtgaaaaggttggtcccacttgaaatcactatgaattttgattctcatctaatgtttagggtatgccttttagatgtgtgttttatgcagaattgatacagtttatcttgcactgatttttattgaaaaaatggtgccaactatagaatgttgaaattcatccgtagagatgctacctcaggattattgtcatcattaatcaacactctttgctgtggcatttaaatatgattaaaaataattctctgaccagtccccttatgtcatctgaggtttgcttgctgtctgctctttgaccagctccaggcctttgaagaatcccacttttaaattgtccctataaaaactaatttaaggaaaaaagatacaactctactgaaaggcatcatcaaaaccattagagtcaagaaatttgttaacaaaagggatgtgtctccttccacaaatgaagatggctgaaacacacattaaatactatcctgataggcaccaagtgaatatcttggcactgtaaatgaaagataaattatacactaaaatggaaggattggtagggtatcaggaaagcaacattgaaatggaattcgtatcctgtggacccaaaagcacttatttttgcagataataagaactatcagccaggtatggcggctcacgcctgtaatcccagcactttgggaggccaaggcgggaggatctcttgaggccaggagtctgagactgacctgagcagtatagcaagaccctgtgtctataaaacaaagaaataaataaaacattagccaggcaccagtggctcatgcctgtaatcctagcactttgggaggctgaggcaggcagattgcctgaactcaggagctcgagaccagccggagcaacatggcaaaaaccctgcctctaccaagaattcaaaaaaaaaaaaaaaaaaaagaattagttgggcatggtggtgtgcacctttggtctcagctactcaggaggttgaagtgggaggatcgtttgaacctgagatagggaggttgcagtgagccaagattgtgcctctgcactccaacctcagggacagaatgagaccccatctcaaaaataaaataaaaataaaatactagctggacatggtgttgcatgcctctagtcctaccttgatgggaggattgcttgagcgcaagaatttgaagttatggtgagctttgatcatgctgctgcactccagcttgggcaacagaacaagaccctgtcaaaaaatacaaaatataaaacagcgtagtgttttaaaaaatagaatccttatccaatggaccccaaaacacttcattttagagacaataaaagctataaatcagaaagtctttccaccagcagtgaaagtgagaatgtaataaggcttggataagtgttgtatttatacatctaattgtggatctgattattaattgagtagttaatattattaaaaataatggttaataattaactcttcctcatggttataatccttagaacaaagcagttagtttgccttttgtcatttatacgttatagaaaacactgtagaaagtaaaagaattttttttttaactctaggagaattaagcacttggtaaatatatagatttttaagcatcagtcctctggagttcagaatttatcattctacacagtatgaaccaaccacaagtaggaaagtttagggatgttgttggtcctatttattgttgctatttaattacatccaaatccagccgtcagttcacatcttcagttctaattgcctttgagagttctatgcacggaacaatagctgaagtgactcttcagaacagaagtcataaatataggttcttcctgatctcgatgaattaaaaccaaaggagaggagacagtttgttttgcaggaagccatctgtttgtttgtatacagggtttgtattcaaattttaggaaattaatcaagtaaaaaacatcaaaattcacaacacagaaaacaagagtactgaacaaacatacactttgagaaaaccaagtcgctaatgagattttgaacctctttagtttaatcttttcttgtccctaggagacctctctggtatgtgtacagtgcatgacgttgcattgattcttgctgctttaaggctcagaacatgaatcggcgacaagtgctgagttaatgaatcagcagctgtcagcacaacaactgcaccaacataatccttgactcagggaacttctctggtccttgcttaaaagacagctaagtttaccaataataaaaatctgtcccagatccctacatgtgcataaagaggtgaacgtttctttaggaaagaaatgtcattcagaaacgtgagccagaatttcaaatggctctaggctttggggtatgtgccaactccttgctgctagcccaaaagttgtcaggagataggaagacaagacagttttagggactggagcctgggcatttgactccacactcataagtctgatgtgtaggcttagagctagagccaccattttaggcataaaatcatcactgcttgttacctgtctaaggcagtaactacctgacacgtgcagtgaagccctctgcaaccatctgcaccccatggcagaaattctctgaattcctcctgcgtttgaatatcttcagttgactacacataggagtgtaaattgctgtattatgcccttagacttattcctgcatgatttgcatgtggacatcgtgttttcagtgaaaagaaaggcagaatcgcacaacagacaatatcttaatgactcttagacatcagtctgctcatttgttaaatagggatgataatagtacctatttgttaggaataaatgaaataatccatgtaaagtgcttaacagtgctaagggactcagttattatgaatgttcttattccttcagcctctgttatatgtgttatccatgtaaacacaatccatgcttggcggataaatcaagaaataaatgaattaaaatgaaaatctaaattgcagaatcagtgggcagctgtttaaagtagaactaggcaacatctttatcaaataaaacccatagaggtatatcattttagcctgggatctgtttcagtcttcattttttcttgaggaaaatgtaaatttaaaaacgtcaaatgacatgttaagtcaaaatggggctattccttgatgtttgcttagagtaagatttgtacttacctcttttcctcattaaaaaaaaaaaaaaaaaaaaaaaacaacttcatcactatctattcctgatggtaagtgaatcaatatagcggatttttattatgtagtcctcaaaagcctcggtctttcaaatcaggggttttctatcccattacctctttgctggcagtacctgttgttcacttctcatttcatggacatcactcatttaacagtgactaaaagcacattaatctacttatcatgatcttttcctatttttagaaaacaacaaaagtatatcccactactagattataacctatttagaacagagatttcccttttgtaactgagagattttctttctgtagttggataaaaggatagaaaaaatgttttaaatactctctttaaagaggaaattttagcatgggttatcagcaagtaagactcacaaaaattctcctgtcagatataattacaaaattcccagcggatattttaatcccagaggttccctgaataaatatttatgtacctcacagcctgaaatgcaatcccgcgactatgggagaggattagtcagtgttcttttattatttggtttggttttggtttgtcttctttgtaattgtttgattggctcggtttggtttagtatgtagaaatttctggaatatggcctaattcagaattttattctttaggcatgtatgcggcctttacattgaattcaaactgcttctcactagtgtactctctgacaccatttatgaaatcatgttgcagaaaaataaggcactatgggtgtgaatgtagttttggagttcataaactgtctcagctaagcaagcccattctattcccagtttaaactataatgtaaagggtgaattttaaagcgaattgatggtccttatttttaaaaagtaatatacctgtatcattttgtcagtgatgttcattacagcattatttattatttctaattataaatattagaaaaatgtctaataaaatttgctaaaatgccaactagtttcaaaatggttaaaactgtaagcttaaagcagattataaaattatgttgacaaaggaataaacatgcctatacaatattgaggagaaaaaggaaaatcgtatttgtctcatttttataatggtgtaaaacaaaacaactgaaaaactgtgaaccaaaaagactgggggaaattataccaccatgaaaatagatgttttatctgggtaggatttgtttttctattccttcttttaattttcctgaatttcctaaattacctgtgctaaaacatttattacttttacaatagaaaaaaagagcctaacaaacttcaaatcaacatggatttttcctgtttgcactcagctgaaatgtagctttctagtgaaactggagagagacgaaaaccttttcaaagaggcaattcagagcaggctgccagaaagtaagcccttccacgagcatctttagagatctcacctccatgctccctggctgagttctgttgctctgagaaggttcacataatgagtgttttcatcttttcatattaaaaatgacctcctggcctgagtctgagcttcccagatgactgaggtttgctggtcacagcctcagaaaaaataaagcaaaattacttagtatttcatcctgctcttggagtctacattgtatttccacacaagctcacagactttgttgttgttattgtttgttttgttttaactctccagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggaggggtaagtattaatagcaaaaactgactcaaactaacttgtttagaccaacttaacaatatatttaaagttactattttagaattttgttcaagtaatcttatggcaagaaactcttggttaattcctgctcctttttgcacaataaatgtggcatcactcattgaacaactctatatggcaggactgctccctaactggcaccaatcctacaggttaattattcattcctgtgtatggattagaaactaaggctcacaggcattggatgacttgccttggcctcatagctactgaattgtggaactcagcttaaaacttcaaatcccaaactctgtgtcacatatcatatcatatatcctagaatctgaccaagaaaatagcttaaggatagtttccttctgtttttaggctgctaattaaactccctttgaccttgtagaaggcacgtcattgtgaatttagggttttctttcttgaatttgaaagtctgatggggttatttactatctccaggtaatttgaattcaaaatgattggattttcaaaatgccttcctttccataacggtatattatcattgaacacataacaagaagaggttaaatctgggaacaattcctatcaatcacaatcattgtcaaaaaatttttttctgctctaacgcacctctgtgatcccattgacaataaagatggactccggctgccatttttatgatggagtccagccaaaacatagcggaatacaaaaatggggccctgacttgaaaagctctccccacttcctaggctgctataaaaatctgtccaccccctttacgttgagaataagtggcctaaagtcatccatgtgatatagtgagagcatattttccacccaactacagtactagccctgttcatcacagtcttactacctttatcaaacagggtttttgcagttgagtcacagaatgcccaaaacaatttcaatgactgttgtctcagttctatgccaagagtggtatctgattggtacaactttagatggcacaggaaagaagttaattcgttacatcagtggatgcctgggttcactagggattatctcttgggaccctgactgagaaaggctggatgaaattgccagcgtaaaccattctggacctctttcacatggttcagcttaataactttggctaagtgaaagaaatattaactacttcacaaagacattggagatattgaatatcctgaggtctaggaaagtacatagcccaatgtctaccacaaaagaagtacttgataaactttaatggtggtattaattgaaggaagggtaacattgattgtaataacaggaaagtgtaaatcgagaacattcttcataaattaagcagaatgttctcacattaaaaccaatttcttgggcaggagagatattaaaaatgctaaatctcagaatggcgcaagcaccaaccaatgaaaacagatgcccgaccaatcgaagtggacgtcctaccattcagacacatgtagcctttatgccagaatggtgccagggctaaggcagaaacagggacacctaatgaagtcaaacactgatgactaccttttgtaaagacagctgtccgtagagctgctcacattcatctttcatatggaaaatgtctatctcccctgttaaactagtgctaacaccaatcaacttctgctgagaaatacatagaaaattaaggacagcacaaccacatgtgagatctaagtgtactagccactaggatcattaatgtctgtggagtcaggacttgacaatagaagagataagcaagcgcaattttgaagtcaagcctatttcagcttcgacttcctgggtcagcatggtggaaatgatgcttggtatagagttaacctattgaggttttataaaagttattatttcattgtcctctgatacaccccatccccaccgagtattctgtcaggaacacaacagactgcggtggtggaaaataagcagatgctgttgttttctttggtaggaacataaaaaatgtagatcttagttaatagttgggtctgggtgacttcaaagggaaagagaaagttattgtggtctgctttgatgagactcttacctcactcctcactctatttttttctttgtttcagttttactttaaaaacacaaatccagtcaaaatgtgtaaataactacagtacttctgaatcgcaaaatcaaaattttctattaataggttgctgtgctctgaaatatccaggctgcaagtttctttgacatttaagcccttcatgaataaagtgaattagatagatggtataggcatttccctaaggccaatgtggcttcccaccttccctgcacgcatcccctggggcatattttttatttaaacctgtattcgaagtccccatatgtgaaatttcttaggtaaagtatcaataatcttaataatgatgatgataatagtgataattcctgatacttgcaaagtgcctaatcatttatcgggtactttcttatatacacttgacccttgaacaacacaggtttgagctgtatgggtctacttatatgtggattttttttctaccacactcagattgcaaatacaatattcgtgggatgtgaaataacccacatatatggaagactgacttgtcatatactcgggttccagagggctgactgcaggacttgagtatgtgtggattttagtgtactacggtcctgagtcctgagtccaatcccctgtgtctaccaaaggatgactgtaatagctccttaatcctcacagaaatcttgtcaaataggttaacaattattttcccattttattgagcaattataagacttgatccgtaaacagtggcatctggatgagaagccaagtgttacaaacaaaagacgttttgggttaaaataccatagcttttcctgaattagatttaacatcttggacatgtctgtttcacaaaaaaatggatcatggctgtcagtaataccagtttagagttaatctacgcttcaaggtttcagaagattttcacataacacagataatctcatttgattttcacaacctagcatgaaggtcaataaaggtcttttgaaagtcagtaaatcaaggccaagagagattaagagatttagatgaaatcacacagcaggaatcagcccaagacaactaagcaccaaaactgtagctcttccttcactccatgctttggcatctcttctaatcgtatttctaattggcaattctatctcttccattatcctgtgaatgtgacactctgtactgaaacgatggagataaccaaatacatattaattttgaaatagaatgaggatatggtctttccggatgctagtctagtgttactgttaagaacagggactatatgggttcaaatcctggctctgccattttctagctacgtgactttaggcaagactcctaacctctttgtgctggaatttcctcatctgtaaaataaggataacaagaatacctgcctcagaggacatgtgagtatttagtgagtttaatataggtaaagtacttggaagctgcctgtcatatagtaaataccattaaacatcatccattactattgtcattggagaaatagcaacacaagagtctgtgtcaatttcctgttgtatagtttggaatgggaaaatgaaggagggccaatataccctaaattatcttgtcatccattacgggtttagaatgaagtgtactttttcaaatctggcctctagggtggtctcttcatcaagcagctattctccaaactttggattaacagggctatgaaccaaactccaaggtgtagcagtgttcttcaggtaaagtgctgcctttgtgatagcctgtggaatcatctcctcacatttattaaaagtactgtgctggcgaatgctggagaaatatttctggggcgcatagacatccaaaccaggatgtaattagtcccattcttctgctaatcaaacatgcatttggcatttggaaaccaaatgagcactgttccacactaggtgatgcgagatttccttggagaatctggtcttcctaatcctttcattccaacctgggagcaataacaatgctggctctaagaaagggttgagcaataaaatgcagatacttccaaatgtgggcttgcttccgttttccaaatacagagttctaaagtatccgaacgccaaccaaggccataggctgagggcatttctgaagaaactcacaaaactagatcgagagccaccgtagtacgtaggacttatgtagcatgtaacttacgtccttccgacatgggtgccaaactgctccagagactcagagaagccagacacctgaggtcttgtcgaagatgtgttctgaaaacgtcggtgttcccatctctcaggcaggctcacatatttttaacaggccatggtttgcatcactaatgctttcatcagccagtgtaaaataaatccattagtcaccgtgtccttcatgtgataatgatatttagagctcattaaaaagtaattgcagccactttcccctactttatcagcaggattcagctggtgatttgatgatccgaaacatccaactgaagcatgctgggaaatatgtctgcatggtccaaacaagtgtggacaggctatctgctgctgcagacctgattgtaagaggtactggattttgttgttattgttgttcttgaaatattttcatgatatctactgtagcgcagagttccagaaacctcagtggtttagaattatgggaaaaagtcaggcagaagctgaacattgtaaacagtggctaacagtccacagaagtttctggttcatatacagttcctcagtgcggcttgtcagaaaatgcaccgaacacatccagtaactttacactagaaggataattgagtaaatcgagtacccgattacggctgttggagttgatatgaccttctagaacaaatttaggtgaacaaaagcagatagtttaaagagggattaaactgtccctttttatgtttcatctgggccaaactgaattagtatcctaggccactggtataacagcagcttaagtaaagtcatcatcaggtttatccgagtttccttttttccctaaacttcacagtgctgttcggttcctaaaatagggttttgggagaggacacttcctgactgcctgggatgtagtaaatgagctgagagttgatgtaaatactaacatttttgagattctcttgaatattatcagcatgacctaatttggacctaagagctatgacccccccggctgagcaacaccaactgagtacattccaagcctcaccaaaccggttggcaaaggaactgtaaatggacttttaagaaatatttttaaatgaaaattaaaatcttcactaaccagtgtacataccagaatccaacctatgcatgctcaggggttttctatagcattaaaatagaggccaatccagacatcaaaataatatcttagctagaatctccttcatcagaatccctgactgttggtgttcaggcatctttggccggctggcagagcgcatggcaaaacttcgaacgcaagaaaataaaaatttagggtatgagcgttggaggcagggttaatctgcatgcacagagaacaaggtattattggaagccataaagagtgttgctgtatcctctaggcataatgtaaggggggaaatgtgtgggagttaccaacttaaactgattgtgaagagagggttcaagagaaatagcaattccaatgtgtctgctttgttcccctttcaattgcctttaaaaaaactttcagcaacagtgcagacaagggctggaaatgagaaaaaactttcaaccgaggtagatctgcccacagaataacttatagaaatgtgtttatttccatttgaaaatacaccaggctggtctgccctccccttgggaacaaaagaattctgttgctgaaaatttatcctctatttaattaggataatgttcagatcagcagttaaaacaccaataaattagactaataaatatttaaatcagcaatacttgaagttcttaaatgatattgtatacttcatttcacagaaaataacattaaataccaggaggaatttgcaaacgcagtctaaaagaaaatctagtctaatcagttaataaggccaataaattaatgtgccatttaaaaccataatctttcattttatctccttctgctctgcccttgcagcttttcttgcacattacagagggggaggcaggaatgtatttcaccaccctgaaagacattttcatatttgaaacgtatagcagctttgagtcttggctccagattctttgattttctgaggcctgttctatttaacctatagcactgtaatggcagccagaaaggccacccttcctgagggagaagcagaccccagaatcaaactaatcttccctttgccattgcctgaaacaaaatcttctacatgcccctgagtgtgttatcattttgttcagaggacaaacatttgtacatttttcattttgaaagagggagtccacttccctaaaacaaagttggtaaacattctgtaaggtcgtagctatgcatcggtaggagagggtggcaggaagataaaaaaaagaacaaacaaatccaggaaactaccatcttctctccagtgtccaaactcataccagcccttcattttcttcctatagagaggccaacaatggactcagatatttcctatcgatttaattctttgaagagttcagagggaaacacttttctatttgtggtacttagattttaaaggacatcagtgcagcatccattaaaaaaaatggtggggaatgctaggatgagaaaactagtgaaaaaaattatattgtcttctagactttatctggttaaaaggggtcccaagaccaaaggttacatcagctctatctaggtgacattagactgacatgctgaaatgtcaccatggaaaattaatcagttccagcatacagatttccagacatttcattcaggagtgggagggagaagataaatttagtctcacctgtgggtctataaaagtgatttttaaaaaaggaaagggaatttagggcatcacgtaaacggtgaaggagtgaatcctagaacaaaggctaacttcaggaaattgctgttaattttgcactgctctgtgagaggtttcttttttccctgtccctgtgacatggcctgatagtatttgggtagtacatttgattgctagactggggattagcaaatccttcctaggaacatctccttatgcccgtctaatgggcatgaggtttgtcattatgtcccctcaccatcaccttccctcctgaggtggtcaattgtaccttgttaaaaatgcatttaactgcctggtaagagattttcatgttggaaagtgggatagctgcgggtctttgctctggctctgttgatattttgtctttacctgccagctgctttccatccctctatttctttattagtttcaagccttcatttaaatctgatttcctcccctttccatggtttaagtacatggacagaaacaacgaacatcaggaagagaagtagaaaaatacgggtatgagttgcagaaactacagatgagggtctttagtatctagcctaattttgaaattgctttgaagaagggagcgccttgactcttgcgcaccggccattttcacagcagttcccttgcacgcaagtgtgtgctcacgtgggaagcagggttggatgtgaagagagtgctagtaattacagtgcagcagaatgtgcagagcaacactgtaaccttcaaagttttaaagccatttgtgcttaaatctatattctcagtggtagaaataaccatttccagcagactatactctttatgaaatcaggagcaatatctatcttttctcactaccgtatcctcaaataacactgtctgacccatattaggaacctataaataaataatgaattaatgaatgtgggctcttatggtaccccaatactctctattaacattaagtattcagttgtaattatttgtttacctattagtttttcatattaaactgtgggcccctagaaggaaggggctgtgtttcattcacctctgtggtttccaagcccaggaaagttccaagcacgtagtaggagttcaaaaaggatttgacaagtgatgaatctgtgaatgggtagataaatgaatgggtcaatgccccattcaagtatgtggctcctttacttgggtgtttgaatacactgctccaattctgggggtcttgctctttcccaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacaggtaccatattggatgcttggctcagagacattgggaactcagcatactggacacagcactgtggcaaggaacgtctaagttctcattcagacactactacaaatgatatattatggcagtgtttcctaaacctcggccaactgtactatcattaatatttttctttatatcaaatcacagttgggtttttttaaactcatcctaagcaatagtatctgtgaaatggtaatgtccaggccagatttggtggctcacgcctgcaatcccagcactgtgggaggtagagttggatggatcgcgtgagcccaggagttccagaccagcctgggcaacatggcaaaaccccctctctacaaaatatacaaaaattagcctggcatggtggtgcgtgcctgcagtcctagcaactcaggaggctgaggtgggaggattgcttgagcccaggaggtagaggttgcagtgagccaagatcacaccactgaactccagcctgggtgacagtgagactccgtctcaaaaaaaaaaaaaaaaaaagtctgttgtgctggttgtatatgtattttccgtaacacacattaaaaatatattagttataaaaataaaatgcatcaatctgtattacctaaaatcatctgtgtagcactgtggttcactttggaaagcagcggattctgcctgactatagtcacttaatagtcacagacttcataaagtttacacagtgctctcaaaaaccaataacagaggattatagggagcctcttcacttgctgctgtgttttttgagacagggtctcactctgtcacccaggctggagtgcagtggtacaatcacagcacactgcagcctcgacctcctgggctcaagcaatcttcccacctcagcctgttgagtagctgagaccacaggcgcaggcccccacacccagctaattctctaaaattttttgtagagacaggtcttgctatgttgcttaggctggtctcaaactcctgcgctcaagcaattctccatcagcctcccaaattgctgggatttcaggcgtgagccactgtgtccagccccatttttttagatggataaatttggggataaaaagacatgagatttctttttaaccaattttacaaattcttaaaaaaaaaaaaaacattgttagcagcaacacttccatcctgtttccctttattacatgtatacagcacttcctattttttaaaagtttcacagttatttctctttgcatgtaaaagaattcttataccaaccccactctgtcagtacctccaaattgactcattttcttatttagatttcatttaaggataaattggatgaacaagtagttattacaaacaaagatacacactcctctagacagcaaaagtaggctatatggccttgatgttttgaaggagaatatgcccagtgttgagcaattcatataaatcttgttgattttaacccatttgtttttttcactttagtttactaatccttagaaatgggtttctgtgtttccttctgtaatcactgagtcacaggtgtgctttaagaaggaaatatgagaaaaatatagaagttaggagatgaattctagacctgactgctaatcagctgatctctatacatcttcattttcctcttctgttaaatgggcacaataagaattgtttaagaatgaatataggccaggcgcagtggctcacaactgtcatcccagcactttgataggccaaggcgggtggatcgcttgagcccaggagtttgagagcagtctgggaaatgaggcgaaatcccgtctctactaaaaatacaaaaaaaaaatagacaggcatagtggcatgcacctgtagtccctgctactcaggaggctgaggcacaagaattgcatgagtctgggaggtggaggttgcagtgagccgagattgtgccactgcactctaccctgggcatcagagagagagagagagagaccctgtctcaaaaaaagaaaaaaaaaaagaaaagaaaaaaagaatataatacttttacctttctcagaggatagttgaaatagtgtgtctggcactatacaataaatgcggaaacacatgtgaaggggtgatagtaatgattgagtcaggtagtttggggtcttgtggactgtgtgtcttttatgatgtcatctgctggtatctgattagagtgtgttagtttaacatacagagatagttctgagattacctcactgaaacaactgttgatgcagctaatatcagaacacctacactgccctgaatacaataatgatgaggatggatggatgttcctatcttcctaacgtaatctctgcatttgttttctgagaacctatgaaacagcccccaccttttgttgtctttcagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctcgtgagtagcacccgagattcagatcatctgttctgccagctgctgttccttaggaaaagcgtttgaattcttgctgctcttcagcgctcatgcggctctgtgttagctcacccttccctttaaatgtttataatgatagaaatcaggccaggagaagcccagctgaacacgcaacgggtttcaatcaagagttgttttcttcattaggtccacttgtacagcaagagacacacggtgcttagtcctctcaaaagccagccctttcttcattggttcatttgtcaccaagattctaacagaatttcaaaaaaaaatcccacatttcaaataaaattatctcacataagtaactaatggcaaagaataatttgtgactgctctggacacagccaccatggggtaatcctgtttagaatagaaataaaaaataatttcttcagaaatgttcacttagattatctttcttagggtataaaccattcccagaaacgaagattcagaacatcgtgctcattcgaacaagaccagtcagcaattcagtatggccctctgcatatgcagcttgaatgagcacggggagagaagaacaagttcatcagggtcagccgtacttttacttagctggtgtaaagcaagaggcctacatgtgccgtcttttatagagttcccgcctgtagagaggccagtgtgttgaaggaataataaggtccctacacaaataggagttctgaccctactctcagaaaagcaaaaactcatctagatctatttgattggctttaaccaaggagacatacccagtcaccagccacataccccagtgagacctttttaaatgtggcccggagcctttcagttacgtgatgacaatatagctagtcccctgctttcttttccccttccaaaaccataattgaattaattcccctcagcaatcctgaggtggaagctcgcataatttcctctcttttatagagaaaactggtgatcaaagaggttaagctcagtgagccgggggtcaacttctgtctgccacttccttcaacactcagatcaaaactcttcctcccagaagccattcgcccaccccagctctgagcagggcgctactccggaacgccccccgcttctccatgctgactgttccttaccctggttgtcgaccttgctctaactggtgcaggcgctcctccactccaaccagcttgtaagctctgcctgggcagagcttgtactcttccctttgtgtatctccacgtggctcataaacgcataaccaaacattaggaccagacttcagtcctttcctcccttcgggaacccctcggcctctagggatggagctgaacaattggtcagacgtgtcagataacacgtgtgccttgttgaatgggaaacaggtaattaatagcagtctccttggtacatttcacttcctcgagcggtcgccgtgggccccttgacaatgctgttgctgatctccagagacaaaggggcgtgcctcagagtactcactgaaagtgagtcacctctgccaggcaaccttcctggccctcattcgcctttgccgcctgacataacttgttttttgtctccttgtgcagtccccgaagtcacaccagcgaatgtcagtggtggcggaggcagcaaatctgaactggttataacctgggaggtaaatgaatcacagaataaaaggaacgtacacgcatcgaagctattttattattttcctccatgttagacatagctgggaagtttcctcctctgtttttaacagtgaaaattcatttgggttcagacactccctctcacgtagctaatggctagcaggaaggacggcacttgcccatccattgttgaggcaagttttaattcaatccatcacagtaaaaacaattatgaagggaagacaacacacgttacaaaaaaaaataaagaaggctgtttcagagaaaactagtttttcttttcttcctgaattgctgcatggccaattgatttaaaacgtctgccagcaatagattcagtgcaccagcacaatttcctggcaattggctttgcttctagaaggggccctcttttaggaggtattttttaaaacaacctggaggaaagttagtcaccaatttattaaaaattggctttgagagaagaggtgggagctttagaaagggttcttcatgtttttgaaagattctaaacagccccagaaattaaaatctctcatttacccaaagcacagcagtgaaagaaatcactcatccctccagctgaactcttccctctgagagggaggatcttcagccaagatggtttttcttccttcagtgagatcttttgtctatttggcaatggaagaagattagtattagaggatacgtgttggaaatgtggtttttcaggagaccgatgtccagtgtttttttttttacaatcatttccaaccatttcagagctgggtctgccccatcaaagagcaagctctggactgcagatcctcattacgttttcaaccctgtccagtacatcataactgtttaagatagactgactgcaagccctaaatttaaaagactgttaacaaaacgccaaataagatgggtggagaaggatgtagacaagaatgttacaagggaaacaaaaacgatttttgcatttgagtgaaactactgtgatttctgaagaccaccttccttctttcccagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaaggtatcgtttatgctgcctagatcattgactgttaatatttcttcaattctaaaatgtggattgtagcacgtacaatcaatttcgcatggtacatgtatcttgaaggcatacctgatttgagaagaggataatgtaaacaatttggttcgctgtccaccatgaatctcttgaaaagatagcgactgctctgtatatgaaaacacttggctgtccattattgattccattgctaaggaccagaattgcaaataccatataagatcttcatatctatctatatgttatcattactttcaaaagaattttatttttgcctttaagtgaatatcaaaatataatttgcattttcttaccacttgtattttcataaagcatatggtacttgtggctcacacctgtaatcccaacacttttgggaggccaaggcgggtggatcacctgaggttgggagttcgggaccagcctgaccaatatggagaaaacccatctctactaaaaatataaaattagccagttgtagtggcacatccctgtaatcccagctactcaggaggctgagacaggagaatcacttgaacccaggaggcggaggttgcggtgagccgagatcgcaccactgcactccagcctgggcaacaagagcaaaactccatctcaaaaaaaaaaaaaaatctcacttattaaagaaaagagtaagtcatgaagcagtgtgattgcgctcactgtcatccacaccatcattatgtttaacatttctcacacattattatcacctccatgctatccctgctctcgggatgcctctcacacagtcttcgttacctttggagttcgtctatgttgttttaaagatgatgctcagaatgggaccatgttaaaacatctgaaaggtgaatcattgatttagagtcagtgaagatgcaataacttattcccaatcagagagatcatccccttagactcagtagccctccatgatctagctgctgcctctctgtctgcctcagctgctgatgcctttccctgcatatttcatgttccaaccattgccaaaggatttacaattattcaaacaagcttcagcccttttcatagccttcaacttctcttagataatagttcatgtctctggattatgaaaatgagaggaaaaggggaaaaggacagtcagctgacttgactaagattcaagagagctggatgacacttcaggttcacactgcaatctgtatgatcttggataactcaggtatactctgtgggcctcagcatctttggctgcaaaggagaggctagactgactgtttcccaaatttcagttatttttgccagatttctgccatagctgtgtaccatttgtatatgttcacatttttctttcaatagtcttccttaaaaaaaatttagtgggcaagcacagtggctcatgcctgtaatcccagcactttgggagggggatgtgggaggatagcatgagcctaggagtttgagaccaacctgggcaacatagcaagatccaagtctttacaaaaaaacattagccaggcgtgttggcacatgtgtgtgtggtcccagctacttgggaggctgaggcgggaggatggcttgagctcaggaggtcaggctgcagtgagccatgattgtgccactacattccagcctaggtgacagagtgagaccctatttcaaaaaagaaaaagagaagcagtttagccatgtcgtaagcaataacatttgtgagatgctaattaagaaggatctgtgttaagggaattgctggctatgaaaacttggtgcttaaacttaagtggttcttctcttctacccacacctaaattcagaacccaaacactggacaaatattcactaccaccaactccagctattaatcactgcccctctgcaaaatgagggtttggcttacaatcattaaggacgattctataaccatgaattattttaccttataatgctagtatctacaatcctgtcctaatatagctgatagagtaataactatctccatattcatctacagaacccaccaaaccaccagccagtatctttgccagaagtctttctgccacagatattgaagttttctgggcctccccactggagaagaatagaggacgaatacaaggttatgaggtaggcaagacatatgtgccttgggtctgaaagagagtctatgccccttgataagtcctccaagtcacattcttataggaagagacccacattcccactaagaggcattggttttaggcctggcttccagctgaacattaatggaagcattgaatactcagctgtgagactaccctttttctatgttatattctagaggtatttttcgaattatatgcaaatctaagcatttacgggatggttggcaaaatgagctttgacttctgatatgcccaggatcactttgactcaaaacaaacatgggaaaaaagaaaataatgaacgacggttgtgtcaatgtaccgtctcactaggaagctaaggacaaaaaagggacccttcttactttggataatttctcaggatatacagagtcctttgtcctgatagctctgctcatgatgtagtatagaaaactaactccatcataagaatctgcgtacaaaattacctgatgacattgcaaatatccccattgggtatggtttccaaggtctttctgtttatcttcttaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccacgtaagaacagacttgctcagaaatattttggggattcatcacacatatcccaagtttattccttatccccacctcccaatgatcatttgcatactaattagtagcatgtggattcaaatttccctcagcattttaactgaacctttccgtataccacgcaaaattcattgctgtggaggacagaaagataaatgtttttctcctcactgggaagggctacttcttttagctataaatgttaggcgaccaactgaatctttttccatttgcaatgctgtatctcatcagattttagtgaccttgaagacacatattagtgcaatagcccattaaattgcctccactctcgaattctagtaaggagatattcctcagaatccattgagacttaataatctgtgacttcgtatatcttaatttttttatagcaccaagtcaaccccccggaaacatcatatggaattcatcagactccaaaattatcctgaattgggatcaagtgaaggccctggataatgagtcggaagtaaaaggatacaaagtaggtaatttcttttttgcaaaggcacctaatcgtgctgtgagtgggggcagtctcctccatgaattatacagttgtctgcattgtcagtttccctggtgatgctctcctaccctctaggaatcgctgcctccaacacggtttgatctgagttgtataaatagtctatggcaattggtcaggatttagacaatcaccttaactttagtctcaggcagcatcaatcagaaatggataaagaccctgtgtttgggtctccaaaaataccctgaagaaccactttttaaacattcctactgtcagcttcgttttgctcctgtctcggtttatatatattttttagtcaacttagtagcctcctgatattaccaatgattaatcatttttgttcgtatgtttctatagtcaagagttatataaagaaaaagagaaaagagagaaaaagcaggaaaagtggagaaaatgtttgcctgaccccataaatgttggcttgtctttaatgagaaaatgaaaagaacatgtctgtagccttcttgcagcaatcaaaaagggttataaatatcttgcaacgtttccagctacctatttgctacctaacaaaccaacctgaagctaggggctaaaacagcaacagtgtatcattttttatgactttgcaatgtggatagggccagaatggacagattttagggctggaataactaagatgcttcttcacacacttttggcttcttggatgggataggtgggaaagctgaggctggccagtgatcatgctctctatgaggcctttccccacggataacctgggcttcctcacagtatggtgacctcagagtagtcggatttcttacatagttgtcagcttcaagaggaagaaagcagaagctgccagcccttttaaaagctaaggatggacgtgggcagttccaagatggccaaataggaacagctccagtctatagctcccagcgtgagcaacgcagtagactggtgatttctacatttccaactgaggtactgggttcatctcaatggggcttgtcggacagtgggcgcaggacagtgggggaagtgcaccgagcataagctgaagcagggcgaggcatcgcctcacctgggaagggcaaagggtcaaggaattccctttcctagccaagcaaagctgtgacagacagcacctggaagatcagggcactcccaccctaatactaatactgcgcttttccaatggtcttagcaaacggcacaccaggagattatatcccatgcatggctcagagggtcccatgcccggctcagagggtcccatgcccacagagccttgctcgttgctagcacagcagtctgagatcgaactgcaaggcagcagtgaggctgggggagggggcgcctgccattgctgaggcttgagtaggtaaatagcggcctggaagctcaaactgggtggagcccactgcagctcaaggaggcctgcctgcctccttgccctctgggggcagggcatagccaaacaaaaggcagcagaaacctctgcagacttaaatgtccctgtctgacagctttgaagagaatagtgtttcccccagcacggagtttgagatctgagaatggacagactccctcctcaagtggttccctgacccccgagtagcctaactgggaggtaccccccagtaggggcagactgacacctcacacagccaggtacccctctgagacaaaacttccagaggaacgatcaggcagcaacatttgctgttcagcaatatttgctgttttgcagcctccgctgctgaaacccaggcaaacagggtctggagtggacctccagcaaactccagcagacctgcagctgagggtcctgactgttagaaggaacactaacaaacagaaaggacatccacaccaaaaccccatctgtacgtcaccatcatcaaagaccaaaggtagataaaaccacagatatggggaaaaaatagagcagaaaaactgaaaattctaaaaatcagagcacctctcctcctccaaaggaacgcacctcctcaccagcaatggaaaaagctggatggagaatgactttgatgagttgagagaagaaggcttcagatgaccaaacttctccgagctaaaggaggaagttcgaacccatcccaaagaagttgaaaaccttgaaaaaaggttagacaaatggctaactagactaaccaatgtagagaagtccttaaatgacctgatggagctgaaaaccatggcacgagaactacatgacgaaggcacaagcttcagtagccaattcgatcagctggaagaaagggtacctgtgatggaagatcaaatgaatgaaatgaagcaagaagagaagtttagagaaaaaagaatgaaaagaaacgaacaaagcctccaagaaataagggactatgtgaaaagaccaaatctacgtctgattggtgtacctgaaagtgacggggagaatggaaccaagttggaaaacactctgcaggatattatccaggagaacttccccagcctagcaaggcaggccaacattcaaattcaggaaatacagagaatgccacaaagatagtcctcgagaagagcaactccaagacacataattgtcagattcaccaaagtcgaaatgaaggaaaaaatgttaagggcagccagagagaaaggtcaggttacccacaaagggaagcccatcagactaatagcggatctcttggcagaaactctacaagccagaagagagtgggggccaatattcaacattcttaaagaaaagaattttcaatccagaacttcatatccagccaaactaagcttcatcagtgaaggagaaataaaatcctttacagacaagcaaatgctgagagattttgtcaccaccaggcctgccctaaaagtgctcctgaaggaagcactaaacatggaaaggaacagccagtaccagcctctgcaaaaacatgccaaattgtaaagaccattgatgctaggaagaaactgcatcaactaccgagcaaaataaccagctaacatcataatgacaggatcaaattcacacataacaatattaaccttaaatgtaaatgggctaaatgctccaattaaaagacacagatggcaaattggatagagtcaagacccatcagtgtgctgtattcaggaaacctgtctcacgtgcagggacacacataggctcaaaataaagggatggaggaagatctaccaaggaaatggaaaacaaaaaaaaggcaggggttgcaatcctagtctctgataaaacagactttaaaccaacaaagatcaaaagagacaaagaaggccattacataatggtaaagggatcaattcaacaagaagagctaactatcctaaaaatatatgcacccaatacaggagcacccagattcataaagcaagtcctgagtgacctgcaaagagacttagactcccacacaataatgacgggagactttaacaccccactgtcaacatcagacagatcaacgagacagaaagttaacaaggatatccaggaattgaactcagctctgcaccaagcagacctaatagacatctacagaactctccaccccaaatcaacagaatatacattcttctcagcaccacatcgcacttattccataattgacctcataggtggaagtaaagcactcctcagcaaatgtaaaagaatagaaattacaacaaactgtctctcagaccacagtgcgatcaaactagaactcaggattaagaaactcactcaaaaccgctcaactacatggcaactgaacaacccgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggagatagagacacaaaaaaccattcaaaaaatcagtgaatccaggagctggttttttgaaaagatcaacaaaattgatagactgctagcaagactaataaagaagaaaagagagaagaatcaaatagatgcaataaaaaatgatcaaggggatatcaccacccttgagagtgggtaacagggttagaccagatggtaggaaaggacactttctgagttcttcttaatttccagctcagtcactcccccttctttttaggagtggtactggaagagccagacaccctacacctcctcaactacaccccaaggaaggtcactgtaactggctatacattttgaattgctacatatacatgtgaatgtttagagatacataatttaaagctacaggtatccacaggttccatactctcaaatgtggatcaaaaatattcaggaaaaaaaacacacaaaaaaatacaatgaaaatgacacagattttaaaaacaatacagtataacaactatttacataccatttacattatattaggtattatgagtaatctaaagttgatttaaagtatacggaaagatatgcttaggttatacacaaattctataccattgtatatccaggacttgagtatccacagattttggtattttagggaggtcctgaagccagttccctgaattaccaaggtaccaatgaataactctctctctttctctctctctctctgtgtgtgtgtgtgtgtgtgtgtgtgtgtatttgtgtgtgtgtatgtgtggtacctcccgtgatatctcacgtcccatgatagctcaggaaactctccctagtgtcacttttagggtgagattagaggctgaataaaaagcggatctgattgcaacggaagagttgacctttgctagagaatttgacccattaaatatggctattgtttatctcagactgaccctttccaaaattaagttttcctcccaaatactgaacatgttggggtgtgggtttattttcccttcttcactaagttgtctgaattctttagatctcagcttaggtagacagtctcaacaagaagctgactttagaaagtttaaggccccaaatattttgtcaacacaaatccttaagctactttatggcattagagctaaaaggagagcatctggttttagtatcacaaattaaactacctgcagggccaggcagataacataaatgagttctgttcagtccattcagaaactactactaatacgtctactaagcactgttccaattcatcttaactttatattttattttgttgtattttgagacagagtctccctctgtcacgcaaggtggagtgtagtggtacaatcttggctcactgcaacctccgcctccagggttcaagcagttctcctgcctcagcctcccaagtagctgagactacaggcgcccaccaccacgactggctgatttttgtatttttagtagagatggagtttcaccatgttggccaggctggtcttaaactcctgacctcaggtgatccgcctgcctcagcctcccaaagtgctgggattacaggcatgagccaccatgcctggcctcatcttaactgtataataaccatgaagataggtacagttattattgctagttttacggatgaagagctgtggcatagagtttagtcacttgcctttcacacagctggtatgttgaagacctgggatccgaatacagcagtatggatcctgagttctacatttagccacttggtgcttctgcctaccagccataaataaatagaataagtgataacaaagtactgcagagaaaaagaggctagagtgaggggaatagagaaagccatggagtggacaggagagatgtattattttatagaaaggccaaggaaagccacttttaagtggtgagatttcagttgggccttggcacctctctgggaatgtcccaagtactgcaaaaaaggaagtgcaaaggtccagaggtaggcatgtgacaatgtagcaacattggaagtgttgggactatcaccaactgcagagtttgtgattgttcagaatgagacttctcaactccaaccagttgttggcagacaggaatatagatcactggcttagtctattttattctggatcgcacttttgtagagtcttactcaggaacagaatacctgagactgggcaattaatatgaacagaagtttattgacacccagtgctgggagggagagggatagagagctgactcgcccttttacaacagtgctaattccatctgtgagggtgagcctaatcacctcatggcctaattatctcttcaaggttcacctgttaatacagttaaaatggcgaatttcaacatgagttttggagaggacaagcatccaaagcatagcaaccagtgtggccatatcttccagtttttcagtagaacccacaaatttttaatgtctaatttctcggtttttaaatgttcatgtctaactcaaaaaaaataacactatgacagccaaacaaataatatatgcaggctggttatgacccatgggccactagttttttgctgtctaactcccttggtttgtgttcccaaagacagatgccagagagggaaagcaatttgcccagagccctacaggtggtagccaaggtagtcttcgttaaaaatccaggttctgaggccgggcacggtggctcacacctgtaatcccagcactttgggaggccgaggtgggtggatcacctgaggtcaggagtttgagaccagcctgaccaacatggtgaaaccccgtctctgctaaaaatataaaatcagcagggcatggtggcgcatgcctgtaatgttagctacttgggaggctgaggcagaagaattgcttgaacccgggaggcggaggttgtagtgagctgaggtcacaccatcgcactctagcctgggcaataagagtgaaactccgtctcaaaaaaaaaaaaaaaaaaaatccaggctctggagccagactgcctaggtttgaatgcaggatccgccacttaccagtcatgagaccgggcaattgcttcacatctccacatctcaagttctcatctttgaaatcagaataataacattgccttccttaagaggttatccacataagcatttagaacaagcttgtacagcccacagcccacaggctacatgtggcccaagatggctttgaatgtggcccaacacaaattcataaactttcttaaaacatcgtaagatgttttttgcaattttttaaaagttcatcagctatcattagtgttagtgtattttatgtgtggcccaagacaatttttcttcttccagtgtggtccagggaagccaaaagattggacacccctgatttagaacacacagtgttcagacattaaatagtggaagtagtctataatatttgctattatcattattcccacaaatccattctttccccttgtcttccaccctagattatatcaaatgcaagcacagccttcaatcagctcaagcaagtgtttggtgtaaataaaggctttacaggactttatttgggttctgctgcagtccataatactgcaagactgataagcagtgctgataaaagtgctgctttttcctggaagtgtttcttttggatttatatttgaaacaagttgaatcctctgagctcttgcaaggaccagaggtaaatcaaagcagcaatttattcctcaaagccagatgtgaccttgcatcccatcagcccattctcctggagggccgtgatgagaagctttgacactcctgaatgtgcctgaggatttatctgtgcctaatcatcagcaaggggatgctgggtctgatacaactgatgctgcggagaagaaggggacacttatgaatctttctaccttaaggaaattgtgttttccaccttgtgttagagagatataaattaaggtgatgaaatgccagggaacagatgggttctaaaccattctaaaggaattttatgaatttcacttgtgtctggttttgtcttgagacacaagagtgaccttatgtctgtagcctcagcagatcagaatttataagggatcttagggaaggatgagctaatctcgtgcttctcaacgcatgatccctggaccatcagcactggcattagctgggaacttgtcagaaatgcagattttcaggtcccatcccagaactaatcacaaactccaggaatggggcccagcaatttgtgttctaacaagttctccaggtgattctgttcacgcttgaatttgagaactacgcgtctaattcatctaatcatgatgcctatcccatattaacatctcctgatgatcttttagaaaacaactacagcatggatcccacctctgtgcagtcttaggcaggctagagtggaactggagcggggttactgacctcctcacagtcaacactttgagctagagagttctttgttgcggggctgctctgtgcattgtagactgttcagcagcatccctggtctctctatccactacaacaggaggacatgttttgacaaacatgtctgcagacattgccagatacctccctgtgaggcaaaattgctcccctgcccctcccaccctgttgaaaaccactgagctacagcataagtattttacaagcaccccaatggttctaacatgcagccaggaccaaaaaccactgacctcatccaaccctatctttttgtcaggggaaactacagaggatgagctttagtggttctataggtaaaggcacactttcccagacctgtatattttgttcctgattggagtaaatccaatcacagcaggcaatcccaggtaagtgaatgtgtttttaggaggctagttggccacctcatcaaatgaatccacctccaaactcagaacccatggggggcccaagatgaaaacaggactgttgcaagctgcagatatgtccagggtgacaatggttgcctcttggctacctagccccataaagtggggttccagaggaaaggaatgggaggttactactcttgcctttccgatatcttctccctgtgctgaaatgtcctgtctctaagagtcgtgatcataacttattgtgcctggcttgtgctctaacctttgccatgtatgttctctgattatctttaagccttcagagatactatttcttacatgcttcctctaagctaggccatcaccagattcaaaccttgtgcaatcttttgtatttttatatttttgagacagtcttgctctgtcacccaggctggagtgcagtggcttgatctcggctcactgcaacgtctgcctcccgggtgcaagcaattctcctgcctcagcctctggagtagctgggattacaggtgtgtgccatcatgtctggctaatttttgtattttttgtagagacagggtttcgccatgttggtcaggctggtctcaaactcctggcctcaagtgagtcacccaccttggcctcccaaagtgctgacactataggcatgggccactgcacccagcctccttgtgcaatcttgaaaacacactccagaagactgggtattattgtcccccttttacagatgactgaagtgaggctctgaaaggtgaagtggcctgtgatcccacagtggccaagtttattctgatgccaaagcaccgatgtgtaactgagcactgtacatccttaaggagctactcatattttccactttcccaagagtgtcaactgagcctccgagaggctaggcagtaggtagaatcacgttgctgatgcccctgatataatatcctttcagctctttccttggaataaaatggtagctgcagtcatggccctcactgcaaatgagccttccaaatgcaagtgggcagccagacaacctctacatccctgcattttgctcgtgcccagaggtgaaaacaaatgaatgctccatatttgggacctttgtgaagacggcaggtgacacctgttctttctgtattggcaggtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaagtgagaatgcctttttttctcccttttctcctgcctgtcttatcttatcagccttccagatgagtcagggcttgaaagacattcagcctgcaaaagcagacttaaaatagaaatggagaacactaccccccttctccagatgtttgctggccataggcagtttcatgcaaaaatcagtttgcccgtgttgactgatctactcagttgctaatcaaaaatcagattaaagcagacccgaattagtcactaaggtttttccgtgtcaacctgtgtagtttgcattgcatctattgtagccccagaattacagtttagaaagtgaaaagcattgactcagtcagaaggaacaaggacaagcattgttaagtatgccgtagcagtttttctccagtgaaacagtgtatgcagttcagtatcttggaaatatttggaatttactacttattttcaatgggtatatgcaacatgtgcatcaatgtgtatgtctctctatagtcaagattatcttcactttcaaatgttgttgaatagcatgggagaatagcatattctttttgagcaaatacattcaattctgtttttacaaataccatgtttgtaagtatcttaagagcatgatttttttgttgttgtgtgtgatctcatttatttaaagaaaaaaaacaaaatagccaaatccgtggagacagaagtgaggctagtgattggcagtggctggtcagtggggaatgggggtttaggcactgggtcttcatttggggtgacacaaaagttatggagcttgagagtggtgctggttgcacaacactggagtatacttagtaccactgatttgtacattttaaatgagttaaaatgctaattttgttatgtgtattttacagcaataaaaaaaagactgtggttagatatctaagtgtagactttcacaggctttcagatttcagtctggagattaggggagcagtgaaggctggaggtataaattttcaagacattggtaaaaagatgatattttaaattatggacaaaatcctcaccaccatcctgacttttagccatgtgacatccctctgctaaggggtgatatgccagtgtttctggatggagtttatatttactgcatcttttttgcatacaaacacaaaaggcatttttgtcttaaaagggggacaattggattatactttatcaaacaaagcctctaacttctatcgaaagggagctagatttttggtgagatgtggaagtaaaatctccaggccacaaaaatacaagattggggcttatctcgcttcattaaaaatctgactttatacttcatactttcttatcattgcagggattgacatttttagatagactgatgattcctggttttattcattacaaaaacatatattaagcaattatattggtgtaattattagataacaaggaagtgactgtgaaccaaacatgatctgtttcaagagatttttcatcatgttggtcaaagagaccttacaagattgaagaacccccgaatgacagttgatagcttcttactatgaaaagtgtaagacccataagaaaatttaaaaaaggattgaggctattttgtttgcagaaaaggggtagatttagacagacatgggtttgaaccccagtttagccatttactagctgggtgatcttagataagttactttatttctctgggcgcaaattaccgccatctgttaagcgaggtaataataatacctggccttcatccagtttttgcaagatttaagtgtcatattcatctgtgcccagcagaaagatagagttcaaaagggagcagcaattttcattttgttgaatcatcgacatagcatgctgtttatcagtattgttactagtaatattgaagtttcttctcacattagataggaacctccttactttacaaatgctttgacagaggtacagggctgtcctataccctactcccaggtttgtagcttggtagtcatagaactgatatttaaaagccattaagaccttgatcatcatttccagtagaatccatgcagttctgctgtttcaaaaagccccgtggcccctcttccctttgaagccgggatggggctgttttgagtgaatttgttctctcttttcagatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttctttaggaatggcattatacagtacttcctcaaagcaaatctagctttgtctgaagtttctttggaaactctgcaatgcactgaagacatctgtaatatgatgttaccaaagcagtttacatatgtccttatatgcatattttttattatatatttagtgttttatagaattttttaaagttaacatataatgtagatattaattttttcctcggctgtaaaatgctatgggcaacacaatcatgcaattataatttgaaaatatttcctttaaagacagagtttgaaactcatcttggtaaataaattgcaaattactcgtacagttttacaaggatctcatggcagaacagcggaagacttggtccgtaactcaaggctgttgtatgcaaactactcttctagtggttaatgcacttgacatgtacagtatgtttcccatgccgttgtgattttgacatgtacagtatgttttcatgccgttgtgaattttgttgttcaacccaacttgagatggtttcaggaatggctgcaatctcaaaagctcaatgtactgcccaagaggcaccttgtgcaatattcccatccctgaatttagcattgtacaggaagattttcttttcactcaactgagttagcattgtctttgtggtagcattatcttagacattaaatttgaagtaacatatatcctgtagtaacatagacccaaagttactatagtcaaccaagtctttcaaaggataaaagatcattttattatctttaactgtatctattttgaatgtaaatttaaaaaaagtaattctctgtcaatggattcgtaatttctttacaaaatttcttatatataatatgtgtatctctgtaataatagagcccttcttttgaatcaaaattacatatggactttggaagattgctcctatttcaacaaatagttgctgcaagaatttttaatatgactctataaaagctctttagtacaattgtatggtttcttgatgattctgttttgcaataggtagcctagttgctttatatgctttaccttctaggtcttaaaatcacacattggaaaatgacaatatcaacaaaactgtattcttatgaaaagaactatttgttacaatgagaaaggttttgtgagtaaaccctactggacagtgacataaaaggcaatggaattttctataaacattttctcatgtaaacatgctgccaccttttcttctttctcagagaactcaaatttgctatagtttgtcatttttgcttacaaataatataacttttcaaccttctagttatatttatccaataaagtcataatcgggattccatttgtgtaaaaactagggtggtaaccggaaaaaaatattgtcagtatttcaagctgtgttcctttcttagtttgatatggttacttctatgttgaaataaaatttaaaatcacatgcaaaaaaaaaatcagcaaaataataaaatgaacgaaaaaaaatgacacccagggagttcccaaccccagtgtaaatgatatttaccagtgatctagcatatgtaatcttttttaaaggtattgttaataaatattctgtcatttgtaaaga

SEQ ID NO: 2412 - DNA, 165748 bp, Homo sapiens
cgttctatgttcccagtgggaacataccagatggaggctttgatttggtaagtccagggtagaaccaagcatttgcatttctagtaagttcccaagtaatgctgatgctgcttgtctgggaaccacatagtgagaatgctctatgtttaggttgtccacccatggtattgtgaagctgaagattaaatgacatgcaagagaaggtgttcctgctactctggaaagctaacagcttactgtcacatcaggcattttagccagtctacacaaagtagaatgagagcgctaaggcaattatctttgaagaaaggaaagggaaatataaaatgtatttaattcacttggtaattattcatctttgcacttcattctgtctctgtagtcacttcctttttgcccaaaaagactgatagaattatagtcatcatttagtagaatgaagtgtgaactacaagagcctgatatttaatatctttgtacagtttcttctctttgtaacaggtgttatgagagttaaaccatcttcataattaggaaatggggaatctaatatttgagcagtaaacaaggctgtatttcacagaatccagtaatacttaagctggaagcaactgctggggccaaccctttgatttttataattaaggaaaataagatccagagatacaaaataacttattcaaggtaatgcagtgaatgggaatcacagctagaactgcttttttctgctattctacctgtgttacttttcctgccaatacaacattttaatacaataggtaaggtgaaaaaaatccatcaatcatccggatactctttcttgcgttttccattaccagtgtcacaaatgaaaacatctggatgaacaactgactttttcactttctattttctaagttggtcacctggttattgagtccaaaaaaaccctttttttcttcttcaaattacatgtaagactaaatgtctagagcctttgtgctacagtcctttgcctctaaaggcaaaactgtaggcttgatgacactgcaaatggtgtttgagtatctctaaggtcatcaataaatgaatacttaagcatcttacagcagagcatactaattccccatggatgtgctatgtatatgtgatcacaagataatattcagccctgcaaagaagcttaaaggacagagtaaccaaagactgaacacagtacataaggtaatttcacagtagggcaatagtttgcttaattgtcctagacagaactgatattgataccctcaattcccctgtcacttaagataaagtcaacaatttttgtttctttctttcatctgatagttccaataaagtatgttgctacagtttttaaggggtacgcattaagcaaacgttgcgaataatagagagaattaatacaggagtggaggcataaagtcctcacctaataagaaacgttaagccatgaaaaaaagagtcatatcaaggacaatatattgaaatgcaattcaagtcatctcactctatagtcccagagaaggcaaaatgtcacagttacatttttttattcaccaatgaatattgtttaaatttacttataggaggttttgcttaagttgattcatttatctagaagttcctctgcttgtctaagcaggagggctcaaactgttggtttaaggactcctttttaccctgaaaaattattggatacctcaaagagcctttgtttatgtgagttatatctacccatatatgccatataattaatttaaatggagaatttaacttagaacttaatttactttaaaataacaaaaatacaaccagtatatgttagaaataattaacataagaaaactgactatatttttccaaataaaaatatttaatgaaaagagtagcttggtttatatttttgcaaatctctgtaatgtctgtcttactagaataaaagtgcattctcctatatacttctgtattcagtctgtcatgatattttgttttgattgaagtatatgaagaaaatatggtctgacacatatataattggaaagagaggacataatggactctcttaaggaaacctggggacctacaatggttcttagattgcactttaagaaggatacattcaaaagaatgctaccattgtcatttgtgttagggttggacattttttgagaggctctggacagagaatggatgttggagccaagcaggcctgtgtaccattgctaactgagctactttctgaatctggatgttaatgtctctgggccttacctataaaatgagtacaagtctacttaacctgaatattattatgaggtttagaaatgatgtgcataaagtgaagctgattagatattccatatattagtagtttccattattggttgcatttgggactgaactcaaggtgtataagggaaagagaaggggatggattcagctgagtaagagcagattgagggaaacactaggtagaggctttgaagattaaaaaaataaaagaaagaaatatagagaaatgaatctgtgtaaggttagagtcatagcttgattgatctgggtataactgagtaaatcgggcccaacagcctttttgaaaatccacatattgctgatttacaatgtttttattctataactcatttataaagttctgaactgacttattggagtggaggacaaagacccttattcaccaagagctgtgaattcaatgggcatagttggacagaaagtaagagatgtaggtaaaatcagatggcagaagacttcattttcatttatgtatttgttaatttattttcgagacagggtcttgctctgtcccccatgctggagtacagtggtacgatctcagctcaccgtgattctcgcgcctcagcctcctgagtagctgggactacagacaggcaccaccatgcccggctaatttttgtatttttaggaaagatgaggtttcaccatgttggccaggctggtttcaaactcctgacctcagatgatccacctgcctcggcctcccaaagtgctgggattacaggcatgagccaccacacctggtcagatggcagaagactttcaatattaacctaaagatatgaaataatgataatgttctcctaattttcataacatttacaggaggcagagcacattcagaaatcttacttgttatctcgcatacagattacttcctacagttatatttgctttatgtattcatgaatacctattaatagaaatatgccagctttgagttgccttctagtgtatcttcatatagttggtttttatatctgaacttgagtttatccttgctatccgtgctatctgtaaaaggattggcctatgggagatgccatctcccataccattgccagaagcaagtcagttgtaacttatgtggagatgaagaagccataaataagagtgtgtgaatgaagtacaaattaacagaaaaactaggagaactatgaatcctgttggtttaagagacaatctaaaggctaaaggtttcacttattaaaatcaaaaggaggggctgggcgcagtggctcacgcctgtcatcccagcactttgggaggccgaggcgggcggatcacaaggtcaggagatcgagaccatcctggctaacagggtgaaaccccgtctctactaaaaatacaaaaattagccgagcgtggtggcgggcgcctgtggtcccagctactcgggaggctgaggcaggagaatggcgtgaacccagaaggcagagtttgcagcgagccaagatggcgccaccgcactctggtctgggcgacagagccagactctgtctcaaaaaaaataaataaataaaaatcaaatcaaatcaaatgaaaaggagtgttagacatcattaggtccaaacgaatctgaattcaaggagaaaacaggcttccaatccccagactgcatttccaaagccgttcttataatacaagatatcagccagtatcagcaaagtatgtgtatgtttctcaaggtactttttttagcatgaaatttcacaagaaattctcaatatttaatacaaagcaaggctgcagcaaggaagcagccttgcgttgtgttaaatattgagaatttgaatgaatgtagaagggagtgccttccaagaaccctcagagcttcatggaattgagtttgaagacccctgtaaggagactgattggtgtgtggggagtggatgagagtctgaagccagagaagcacagattatcagtgctgaacaaacaccaaagatggaccttgccctgaaatccaacatgcatatttcttgtagagctggtccttcttttcagtgacttctgccaactggaagtcaggggtttatgagaagactgtaataataaactggaagactctcttaagtagcattggaaaatgactatttctcgtgccaatactaggaacactgaatttgaggtaatatgagaatttcttgatgattctgtcaattgcataagaatcccaggcaggagatagagatttgggaagcatctatgtatataggtggtaaactaaagccaagtaattatctccagactcataaagtctactatcattaaaattcttcagcaatgtcagtgaaactcccgcattccctggagatgattcatcttctccaaaattgtgtccgcaaccagaaataactgtgaatgtctacaggtcatctttgtaatagtaatttagagggttttttttttttttttttgctatcacatcctttcttttatatttttaaatttctaaggcctaaggcatatgttggcatttctttcagttagaaatttctgtttttagaaaatcgaagcgccaaatactcctgagaattgtttgacccactgagtttaaattatatctgcctgcaatataaattattattggataagatgcttgtacaattccagtggctggaatacacaaacgctgatttaggtcatttctggcagttattgaacaaaagattgaaatgaagagattgtttatctatccaagagacaaagtgtgtcacagagtcaaatcccagcacaagcatttaacattatatttgaatttgtagtttgagaacaatacttaaggagtcctagaagaattcttttgtttcaaatcttgaaagaatatggaagttcaaaacagatggttctcttttaatatgtgaatgtgtttaattctgcttaatatgtgggctctgtatatattacaaaaaaaaaaagacatttagaaatggcttctgaaataatagtattgaactaacctgttcaggccttcctctgagttgatacaggttgagtatctcttacctgaaatgcttgggaccagaagtgtttcagattttaggttttttaggattttggaatatttcgacccaagcctaaacatgaagtttatttatgttttagatataccttatacacacagcctgaaggtaatttatgcaacattttaatattttgcataatttaatgcatgaaacaaagttttcactgtatttgactatgaccagtcttatgagatcaagtgtgaaattttccacttgtggcatcatggtggccctcaaaaacttgtgaattttagagcatttcagattttagatcttcagattagggatgttcaacctgtgtttagacatggagttgtaaaatatagttgaaccttgatattaggcgataaataccctgtacccaatgcattatcacaaaaggggaggggctaatgatgtgtcttataatatgcttaactgggatttttgttatctaaggactttgaactaggtaaccccccccaaatatggagatacatgagtcattttcatcaagcacatgacttcatttattctagtttgaaaaactcactcgtttagatatgattcatccaatctaagtgagcaggagtgaaaacgtttactacatgggcttttgccctgtagatttgcaaatggcgtgttaagatagactgtctctctttgtcacatatataatatgatacttcatttctgatcttcatgggcccacgttcagatattcactttgagaggaatatgtttatatcagttcaaatttgtcttctatgaattaattttactttaaaaataaagaaagtgccaggtgatctcccacagacactgaattttttgttgatttcaccttggcccgcacaaataactaccactgagtattctcatctggttccttgacctccataaccctgtgggaagagacagaatgagccctcagaagtgcttaactagttagagctttgcaaggccttttcaaaattctctccagtccctcccttctctgcctcacctgcttcttgagattgcaaggttttgcttccagctttctgcatttttgcaaaaaagcaataagaaagcccaagtgttacaggaaatctatgacattgaaatctctctctctgcatgtgattttgatgtttcctttttgaacttcaacttgacattgcttcataagttacatttgcccttccatttttttcctcactctctttcaaaagtttggcttcattgttaatattcctcacatacttctgtggcttttcttgtttgctttgttttcatggactctgtaggggtcaatattcagcaggttgaatgtgaaatcaggcatgcaactgcattagccatcaaattctccaagcagagaacctttttagcttcctttgcattagcagcaggaagataaagaacaaggaagacttgcagctcttttaagggtgtaggttataacccttcattcaagttgatgtttgttgatgttctaaatttttttgaagttgacccttttggcctcccctcatatgcagcaatgcatcatcccatcagtagaggatttgtaaaactgtgttttgctcgttgaaaaacataaaattgcttatagatgagaaaagaaaaaagcagcatttattcaagggcctagagacctctgctggttaagtgatttgttgagtgtctttctagttttgtttattattgaaaaggtgaaatacagtttggcctcaacagtagcaatttccttttgaattaaaattatggatgatttgaaacattgttgagtgaagatactgaggtcaagtcagctggaagagatgttaagaataatgagtagcatctcctaattaaatactgatatcaactttgattattaggtttaccttggtaggcattaccctgtagaaatgccctgtgaacacataaagttccagaatgacagctatggttatcttctgcatgactttgggctgaaggtcttctacctgaatatgtttatcattattcttaatggcatgaattgtgcttgaggcaagatttgatatttatgaagactttttatggaacatggaattaacattgtctttatatctattgaaaataaggaaagaaaatgtgacttcaatgaagtacagaaaatgtattatcatttgggcagcgggggtagtggatagcagtgggcaatgtgggaattaagtgctactttgaattcttgtgttagactgtgggcaggacttgatttcctgaggaggtttgataaaaatcagaactcatttaaagatttggggttctagggtcatattcctgtagataacattctatcaatacgaaatcaataataaacaatgatgatagtcttaaaggagaaaggaatcataaaattgatctatacaacatgtgggagtgaagtatattagtgagggacaagctaagctattctcacaaaggaggccccaaaataaagtagcttagatgaaaagtttatttctctctcacattattttcctcaaaaatggcaggtggatgtggagctgctttgctccacacagtcattcatggtccaaggctgacaggtcagcattttcatcctatgtagcttccatgtctgcacccaaggctatttcaattgctggtcttttccaatcagtgtgaagggaaaaagaagaggttacggaaaatatctttaagtgaataacccagaagttgctctcaccactttcacacacatacagttggcatgaacttggttacatagttacctctagctgcaaagcaatctggcaaatgtagtgcctacctggaaatataccagcctggttaaaagtgggagggggggtgatgggaagatattctctactgaaaggaaaaaaggaataatagatacttacaggagagggacagttaattttgccatatggatattggtagttttatccattttgcatttagcgattaaaagactacaatatgaaccacaaaaatggtattcagagtagggtataggcacctccctgaatgtctccccagtcttgttatttgcataacatctggaaaaggaattttattataagtgtacttttgccctttgattgaatatgataaaaatagattgagtacacactgaatatacacctttctttgctttttggatgcctatagctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggtaagcaagttaatggtaattgtgccttagtcttgactataacgtttaatatagcctcattgccgtggaaacgggagaatggtgaattgtttctaaaataatatgcaatgaaacagcattatggtggaaaaagtgagagtgaatgcaattgataaatagaaagtgcacttaaatccagttctccagctttcaattaagctcttgcactagatctgtggtcttcaaagattaacatatgtgactttataatgggaaagttatgcaaaaggtctggaacatgaaattgtgctaagatacaaaggaacatacattccagcatccactacaagagaaggggcattgacacaatacaggatatccatctaaatagagaaacactctgacaaagaaatctgaatgaagcaggggtagagcggagaccctgagaatgaggaacaattgtgtccaatttaattttccttatgtattttcctgccgaacctcaaatattaattgaaatttgacattttcctcaggctccaaattgagaggcagtctttcatgctcagatttcttcctccagtaggccacccagaaaagagtgcctgctcggagcaatggccctcacatgaatttacatgacaggaagagaaaggggactgttttgcctaactcaccccctgcctcatgcaccttctccatttgctggaagggctccagcttgtccatgattctgtcaattataaaagccaaactcagacaaattgcaggggtataggtacctaggtactggtattttccttcttttgtgtaattgttaccaaaatgccagggagttggtctaggtcctgttgcttgctgtgcagagagccaatcactgagagagtgagtattgccaggaaataaggctttgttcaggtgctttagtcaaagagaatgggagatcagtctcaaatccatctctccaaccaactaaaattgggagtttatgtagctggggaagggatgcagctgtgtgcaggaaggaattaggtgggggtacagaggcaattatgacagatgaagggtctggtgtctcactgtctggatgccatgatctagtgaatttgagtcccttgcttgaggatcagcctcctgaggagtgaactcagtgagaccaatgtaagtttcaagttttaaaactaggcaggtcaatttctgggtttattcaaaaacaggtaattatcatttctgtgggacacttgggcttgtttcttaatgtgagggaacatgaatatctagatttgatcaaagtctaataaagtgtccactcagctaactcacaaccctgcggcaaacagaaaactagtacctctttatatatatgtagaatggcaggtctcctggagaggaggagatcctttttgatacttatgaaaattgacacataagttgtatatcctcagagtgacaaataaggaggatctcctgtgccacgtactaactttgcccccttcagattggccgccaccagatggtcctcagcttaaatcacaccactgacagcaataaactaagggaatattaaactattaatacctacattttttagtaaacctcaaccaatattaaatatttgcctctgtttcatccaagattgtaatcctattaaccttcaaagtatcacctgctcaaaatgtgagtgttttaagcactctaaacagtaaatttagttttatttccgaaaccccctaactctggtcagtacaaagccttaaagtgaaaaagcattttaagtttcaagttattctatttagagaggatattaatctgaatggctccactattaaatcaatgagaactcaagagaatcctacaatttaaattccatttaccaactgatgtactggttgttccatttagcatctgacctgctacaaatttagctgacagataaatagatcatgttatgtaaattgcttatatgatggctgttttcttcccattaagcttccttgatattacacatggtaaaattgccttaaagtctcagttgtagaaggtcattgtttttatgttcctcttttctttcacaggatagaattcaaattgagcaaggaacactcaacataacaatagtgaacctctcagatgctggcatgtatcagtgtttggcagagaataaacatggagttatcttttccaacgcagagcttagtgttataggtgagtctttatactggcaagaaaaaaaaattaaaactctttagatcactaaactaacttgttctttgccaagcataaatgttcaatccaagaaaaggagtaaagaaatctttaggccaaagatgctactcaagaaacaagtaataagcaagtctataaacaataacaagagaacgctttctaaatccgcctcttctgatgcttacaatggggaccatgcttcccttggcactcatttttattcctctattgactgcacttctaaattgagcaaagtttttgagatgctttttggagtctgctgctgatttggtgcaaacttgagcttggagggaataagagctgacttggtttggaaaggcttatttgaacagctgacagaataaaccctgctcttccacatctgaatttttccagactgtgcattaatgatctttcttccaactacatgtttgatcgtgtgccacttcctccctcctcttcagctgcattgacctttctgttctgcatactcaccatcctcccgtcctctgcaggccactggtacatactgagtgcatcgtctgcctgaaacgcttttccttcccctcttcatttctgtaactccttctcagttcgcatcttccatcttcattggtgcttcctcagaaagtcatgcttgggtcaactattcctattacagatttttatactatcttttacctctcctttatgaaagatgccacagttacagtttacacttttttttgtgatctttctatctttttcttccactgcattttaacctccccgtgacgtcaaggatcataattggttcaattcatcattttattcccaggacttaatacagtattgaagcacatagtatgcactcaataaacattgaatgaatgtaagaatgaatgagtgtgttaaatgaaggaagaaattgagagattattttattaaatggattaatagattaggtcagtaaagaatcgaaaacatagttgagtgaaaagataaatctatggacgttaaaaaaaaaagttaagaccaacagcttgcattatcctgtagaaaaattttgaatttgtctattattataaaagaagagatgataatgacaactgaaaacacaaaaacaaatgcaaatgatttgggaactgcctcctattttagaggctttcagtagtcattctccttggtgagagcataatggaagactatgaataagagaaaaacagcacacaaaggagctaattcacgtgctctgataaattgtccagtttcagagtcctgactttcccttatgaaaaacattcattggtgcctagcatgtaaatcttgcatatagaagtaaatgttctcaagtagaatgtacttccattctgtgcaatgtaaaaaaataaaaagaaagaaaaacttccacactgctcttctcactaagttcgttagcactgactcaaatcctatcaaagataacgattgtgagatttcatggggatggagcctttttcaaagaggcctagtaatggttttatgctcttggcatagatagcatcagcatggctaggcctactggaatcctaaacacacatacttctcaccctataaatattaggaacaataattttcaaccccttccaggacacatatgatgattcccttctgcccggatttgctaactattggtacttggaactgagtcttttggagtacagttcaccatggcaggattgcttaggagtttattccaaaacaagtgtgttctctactctactctatatcagctagttggaagaacagctaaaagtgagatgtggcctaatgaaatgaatcatagtgtctgaaaaccctctatatgagcgctagccaatttatcagtctagggacccttttataattttaagagattttgtagatccctttattaaaataagaaaatttgatagaaacaaatgactccaacaaagtgagaaaagctgcttaatgatttatatctagagtgcctacccatagctgaaaataacagaatatatgtgtatgcgtatgtgtacgcataatggcttaaaaccactctgcacagccctcccctctctccctctagtactaggattcaaggcctgttagctgggaatcactgttccaacttttacattaaggagtttatttaaaaatcatttccaattggaactgtctaattacaaatgaatttttgatctgagctcttaagtttcccgacgccagcaaactagaagtgttagtctgtttaagctgctataacaaaaatactgcaaacatggtggcttatagacaacaaatgtttatttctgatagttctggaagctgaaagtttgagaccagggtgccagcatggccgggttccggtgaagtcccccttctgggttgcagactgccaacctctcactgtgtttgcacatggcagaaggggtgagggtctcttgggcctcttttataagggcactaatcccattcataaggtgcttcacccttatgaagggcttcacctcataggggcttcacctcttaaaggtcctgcctcttagtaccatcaccttagcggttaggatttcaacataggaattttggagggacacaaacattcagactatagcagtagagcagtcaagataaaatgaaaatgcctgagaaattatttaaccatgtttcacataagaacaataaaggcatgtcatcaaattatttaggccaaacaagttgtaaaaatgtaaggcttgcaggaattcaggaaagggaatttggctagggggctgggctggaaagctaagccctgaacaatttagattttgacaaacacaaagaatagtccagatcagaatgaaatggctggaacaaaggctcaaaattataaaatatctgggatagtttcctgcacatagagaatcttcagtgctttttaaagctgttgactcctcagtggatgaatgggcaaacaacatttggtatatgtgaacacagtagaatactatgtagccataaagaaaaggagaaaatcctgtcatttgtgacaaaagggatgaacctggaggacatcgtgctgtgtgaaataagtcaggcacagaaaaatatcacatgatctcactcataagtagaatctgaaaaagtttatctcaaagaaatagagtagaatgctggttgtcagggtcgggggaatcggcgggggagggttgggaagatgtcgttcaaagaatacaacacttcagttagatgggacaaatacattcaagcactctattgtataacacgatgattatagttaataacaagatatcgtactctcaaaaaatgctgagggagcggatgttaagtgtttcaccacaaaaatgataattatataaggtaatttatgttaactagctggatttaatcattctacaacgtatataaatacttcaaaacatgttgtatgtaatagatacaattgtgtctgtcaatctaaaaagtaaaataataaaaaaaataaaaattttgattcaaatacataaagcatatatcggaaaatttaaacttgaaaaagaaagatggtggccgggcacggtggctcacagctgtaatcccagcactttgggaggccgaggcaggcggatcacctgaggttgggagatcgagcccagcctagccaaaatggtgaaaccccatatctactaaaaatatatatatataaattagccgagcatggtggcgcatgcctgtaatcccagctactcgggaggctgaggcaggagaatcacttagacccgggagacagaggttgcagtgagccaagatcgtgtcattgcactccggcctgggcaacaagagtgaaactccttctcaaaaaaaaaaaaaaagaaaaagagaaaagaaaaagaaagatggagaagtcattaaggaccaattttggagattcttgaatgacaagcttgcaagttccctatttaatatcccattttcccttccaaaaattcccagtaatatatttcaggtaaattgaagggcagttaaagattgagtgtgtaaacccgtagagtctctcttaagtgaataagggagaagacatctgcctatttaaagatacatagaaattaatattggttaacttgggtaagacataatatgattgttttccacaagtcactttgttccttatatagcaggaatagtttggctcttttggatcaaataactaaattgtcattacctatgctagaatcatgaggatgctgaattgaacaaagaaacaaaatggaaacaagataatctcttgttaagattatctcttggccgggtgtagtggctcacgcctgtaatcccagcactttgggaagtcaaggtgggtggatcacctgaggtcaggagttccagaacagcctggccaccatggcaaaaccccatctctactaaaaatacaaaaatcagctggacatggtggtgcatgcttgtcgtcccagctatctgggaggctgaggcaggagaatcacttgaacccgggaggcaaaggttgcagtcagctaagattgcaccactgcactccagcctgggtgacagagtgagactgtctcaaaaaaaaaaaaaaattatctcttgataatctgtataagaaagaaaaaatatatatgttggttccacctattgattaaatatcaggaacctccaatgctatagaggagattccttttaatgttgggtgatagccctacggtcatgaataagagatggttaggaagcatatatttaataggtttttcccttggttttattttatgtgttctgtcttggtatttaatgtgtatgtaacatgtctatttaatggatttaaactgctaaataattaatctgtgtgctgggtgatttactcactggatgggcaaacgccatagagagacttttatcttgaggtcagtatattggtaggcctggttatgagtacatcaaatggaagtgtccttgtctgtgactgaactatgacaattggcagtttatttttttcccaaggcaactcctcctagatcttttctgctgtcttagcctgagtcatggatgagattcacttgtgggatatatccctgtggacatccctgaggtgctgtacaactccctgggtgataaccatcattccactcctctcccccactcatgaaggtgtattacaattagagtaaatagagtcttgtaatcatggggaaactgaatcttctatacgtaacttaaaaagtaaagataactaagttaggtattttgttggtgaaaaaataacttttctaaagtaatagttctacccatgtttagtatttgtgtccactcagatgatcatattggcgatggggactgctgattaaattgccaaacttgaaatcattgggtaaatatagaggatagctaaggtctccaaagcaagtctgaggcaagtattcaggtatctgcaattcactgaaagagtgttctccaggaaaaacctgtaaggaaaagcagaataaggaagaaggaggaaccaaacaaggatggggtcttaggtaaagtctagcctaagtctaatccagaagggagatttctggaacataaactgtacctcagacccatttccaccttgagataatgaggctagctttttaaaaaatctccatgttaatcacttcctaagctacctcttaagtggggttccagaagtggtgggggtcaaaaatctttgattttgcttatatatgtgagaatattgtgaaaaaagttttttgattttacagtgggaggagccatccctaagggtgagtgggtatctgcccagtggtcttttgaatatgacttgacttttccaggactgtataatggaggagaagtagcttctatcctgaggaaattatgtctaatggttcagtatcccgggggttctcctggcctgtgtggtggaacacatctgaccctggcaggacactcaaataccatcaagtaactgatggcccaattaaagtgaggtgcaaccttgagcgattatctggttaatttggcatctacccaggtgattggctcccaaattagaaaaacattaaggctaaactaaaagttatttcatagggactttcacaagtgctcatctgcatctgatttctcaactgcctcgttgagccaggttacaaaataatcagatgtgctgagtgtgatcagcatcgaatgagaggacacatgcctttcttacccaactgcagtcatccaggcaagagctttacttaagttgtcatgaagaggggagctgtgcacttggctctcaaaagcaaatttggtgtctttatcaagttattgatcatatacgtaccagtagtaggaggatgtcattactcatcttactgtgaaaactgacagaattacacgtgaaagcctttgcaaacctaaaggtgtttataacaatataagaaggtttgggcttttttttttttctcttagtatccataccaaacacttagagatagccatgaaatcaccagtaaatcccagttctgtgcttctcaatttttgctgcagattacaatcatctggggaactctttactatcctgatggcataccatactcgttatcaactaattcagtctctgatcctaggacccaggcatttttccttaaagctccccaggtgtgattccgaagaacaacagaatttgagaactattgctttaattgatcaggtttaaaaagccattgaattttcctaaaatattgattatcaggctttatcgtgcatcacagtaatctagaggacatgttaatacacagattgctgaactctaccctgagaatttctgatatagtagctctagagtggggcctgggaatttatatttctaacaagtgatgttgatgctgatgctgcttatccaagaccaccgtttgagaaccactatcctaaaataggaaatctgtcctacacagagggcttttgttgttgtttttaaaaattgaacatagtctccctaccaaaacatctgattttggatcaaaaagcactctgaatccgaagtacccctgtatgagagaaagagcaggcatcagagattccaaccatggctgaaggccccatttcaacaagagagtgaataggaataaagcacacagaatgtcttgacagactaccatgtgaggcttgagctaaagtgctgcatggcatgactctggtagttaaagccaactgaggggagacattgaaagctgataaatattatgataaatattatgatcatcccttacatcaattcccccaaagaaatgcagtgagtcagagtttaaaatattactctagaatgcagcctaaggcatcactgagcattaatactttatatacaatcctataaccaaaatatctgaatcttctgtaaaactgctgtgaagagatgatccatcttgaagtccttagtccttttcataaaaatatttccaataaatttctcataaaatgtagaacttctctcttaaaagaagaaaagtttgcatcttctagtaaagaggcaaagtttttcatcagtcagtaagaaatatgttatttttctctttgcccagtctgggattaatttaactctattgtattaattctagtgagattgttttctacccttcccctgtttgaattgagtcatattgtaaatgtatttactactttatgtcttttaccattatctaccccaagttctttgaatttgtgaatgaataaataaatgaagtaactatttttccccctccaccaccttctggcaaaattgattgcatttggggagcctaatctaaggagtattaattagactgacattcaagatttggtagtggggggtgattcatcaagatagtcaaaagggaagccccagaccctttttccccaatggaccagttgccattgaaagaaataaaaccagttaagagatttctgcactccagtcaagtgtaaagccaatagcattaaagcactgtagaaaaatttatggcactcgcttgctggagcacctcccactccccacagcgtagcacagagctatcagtagaaaacttccaattcctaatttcttgctggggagggaaagaaaagagtggaaggtatatccagtgtttttacttttgagggggaagtactacctaagggagtggtttccgttttgcctgaatctaagtgatgacagaaactgggctatgtgggaggccccctgagaacaaagtcttatcaacatggcttggtctggtatcaggctgtaccacagacactaggggaggtccagtaccaacagagggaaatttaatgcttcctgcagcactagaaagtccacagtacctgataaagacaccaagggaagctcctgagtagaaaccaacaaatcttcaattaggggattacatacaaaagcccagagaagatgcatcatcagaaaaggcttgagagatttgcggaatctctagctggactgattgctctcagactgcaaagactaggagaagtgtctgattttttaaatgccagaattccagcagaagataataaagcacacaaagaaaccagaagacatggcccaaccaaaggaacaaattatatctacagaaatcaaccctaaagaaacagaggtatatcaattaccaaagaattctaattattctcataaagacgctcaaggaattaagagacagtacagatagataactaaaggaaatcaggtaaatgatgcatgaacaaaatgagagtatcaacgagataaaagatgaaaatgagcccaaagaaattctggaggtgaagaatatagtaagtgaattcagaatatagtactcaatttactagagagattcaacaacaggcttgaccagacagaaaaaaataatcagcaattcaaagacagaacattagaaattattgaggcagaggagcaaaacggaaaaaataagaaaagtgaagaaagctgaagggtctatgggacatcatcaagtgcaacaatataagtgttatgtaatttgcagacaataaagagagaaaatggcagagagcctatctgaagaaaaaatggctgaaaacttcctgagtctgagcaaggaaatggattcacaaattttagaagctcaagaactgcagctaggatgaatccaaagagatctacactgagacacattataatcaaagtgtcaaaagtcagagaccaaaagaaaatcctgaaagcagcaagagaaaagcaacccatcacaaacaagtgtgcatctgtaagattatcaacagatttttcagcaggaactgcatgctagaagggagagagatgatctactcaaagtgctgaaagaaggagctgccaatcaagaatactatatccggtaaaactgtccttccaaaatgagggagaagtggagactttcccagataaacaaaagctgaatgagtttatcaccactaggtttaccctgcaagaaatgctgaagggagtccttcaagttgaaatgaaaggatgataaacaacacaaaactatatgaaaatttaaaactcctagataaaggtaaacatacagacaaatataaaatcctgtaatattgtaggtacaaaaatcacttttataaaaatctggtatagaatgttttaaaaagtataaaaggtaactataaatctatgttaataactgtacagtataaaaggaggtaatttgtgtcatcagtaacaaagtggggcagcaggatgtaaatagtttttatacatgattgaagttaaattgttgccagcttgaatagattattataactttaagatgtgctatataattacagtggtaaccacaaagataatatctatataatatacaagaagagaaatgagcagtgaatgaaaacatatcatttttaaaaataaaggaaacacaaggctgggtgcagtggctcacgcccgtaatcccagcactttgggaggctgagacaggcacatcacttgaggccaggagtttgagaccagcctggccaacatggtgaaaccccatgtctactaaaaatacaaagtttagctggatgtggtggcgcatgcctgtaatcccagctactcagcaggctgaggcaggagactcacttaaacccgagaggcggaggctgcagtgagccaagatcacaccactgcactccagcctggatgacagagtgagactctgtctcaaaaataaacaaattaaataaataaaaattaaaacaaataaaaatcgaggaataaaaatctcctcttttgaagacagaaagaggagaaagggtaaacacaaaagctacaagatacataaaacaaatgaacaaaatggcaattgtaagcccttccctatctctaattattttaaacataaattgattaaatgccccaattaaaagatatagcttgactgaatggattaaaaacaaacaggatctaactatatgctctctgtaagagacacactttagatctagggttacacgcaagctgaaaatgaaagaatagaggaaaataatccgtgcaaaccagaacctaaagagagcaagggtgaccgtattaatatcagacaaaataaactttaagacaaaaactgtcacaagagacaaagaaaaacattatataatgataaaaggactgattcatcacaaagatgtaactgttagaaatctgtatgcacctaatattagaacttccaagtgtatgaagcaaacattgacagaactgaagagagaaatagcagcacaatagtaggatactttgatactctattttcaatcatggatagaacagtcagacaaaagacaaataaggaagcagaggatgtgaacaaccctgtaggccagttggacctaacaagcatataaagaacactgctctctactacaacagaatatgaaatctactcatgcacacatggaacagtgtccaaaagagaccatatgttagggtacaaataagttttaacagatttaagaaaattgaaattatacgtaatatcctctcggactatgacggaatgaaactagaaattgatagcagaggaaaaacgggaaatccacaaatatgtaaaaattgaacaactcattcttaagcaatgaatgggtcaaagtagaagtcacaatgtaatttagaaaatatcaggagacaaatggaaatgaaaatacaacataccaaaacttacggatgcagcaaaagcagtaataagagggaggttaataatgatacatgcttacattaaaaaagaagaaatatctcaagtcaatgccctaacttcgcaccacaggcaactagaaaaagattttaaaaactgaaaaatcagtagaagtaatagaataatatatattagagcagagataaaggaaatatagaatagaaaaatactaggaaaaaaatcagtgtaaacaagagttgatttttaaaaagatcaaccaaattgacaaacccgtagtagactgagaaaagagtgtactcaaataagtaaaatcagaaattagagacatgaaacagatgattcagaaataaaaagagtataaagaccactataaataattattcactgaaaaattggataacctggaagaagtagataaattgctagaaacatacaactgcttaagactgagtcttgaaggaatagaaatgtgaatagacttagaactagcaaggagattgaagtagtaatttaaacttcccaataaagaaaatccctggaccaaatgcctcagtggagaattctaccaaatacttaaagaagaattaacaccagttttccccaaacccttccaaagaattaaagaagtgggaccacatttaaactcattctgtaagcgcagctttatgttaaaaccaaaaacaaacaaggacagaagaaaactacagaccataaccctgatgaacattgatctagaaattgtcaacaaaatactagcatactcaactcagcagtacattaaaaggattatacacaatgtcaaattggaattatacctgaaatgcaaagatggctcaacatacaataatcagttaatataatatactgcagaatgaaggaccagaaccacgtgatcgttccaattgatgaagaaaaagcttttgacaaaattcaataccatgtcttttttgtttgtttgttttttcactctgtcgcccaggctggagtgcagtgttgtgatcttggctcactgcaacctccacctcccgggttcaagcgtatctcccacctgagcctcccaagtagctgggattacagacgcatgccaacatggctggctaatttttgtatttttagtagagacggggattcaccatgttggccaggctggtctcaaactcctgacctcaagtgatcctcctgccttggcctcccaaagtgctgggattactggcatgagccactgtgcctgccctaattcaataccttttcatgacaaaaacactcaacaaagtagagaagcaaactacctcaacctaatgaaagccttatatgaaaaattttacttctttcctttccaatttggatggcttttatttatttacttacttattctttgtctaattgctctgcctaggacttaatactaggttaaatagaagtgctgagagtgggcatccttgctttgtttctgatcttagagaaaaagctttcaatttttcactgctaagcatgatgttactcatccactttacagtcagaaaattaaaaatggaattaccatataatctggcaatcctaacatttggtatatattcaaaataactgaaaacagcatcctgaagagagatttgcacacctatattaattgcagtattattcacaatagtcaggaggtggaagcaacctaaatgtccatggatagttgaaaggatagaggaaatgtgtttaagtacatacaatggactattatttctgttatgtattacaacatgaatgaaccttgaggacattatgctaatgaaacgagccagtcacaaaaagcaaatacttcatgattccactttgtgagatgtctaacatagtcaaactcatagaaacagaaagtagtgttgttaccaggggctgggagagaggaggaggaaatggggagttgggtaatgggtatcaacatttagtgttgcaaaacgaaaacattctcgcaatgagttgcacaaaagtgtgcatatagttaatactactgtactgtacatgtaaacattgtcaagatggtaaattttatgttatgtactttttttttctttttctttttttcaatttttttagtatttattgatcattcttgggtgtttctccgagagggggatttggcagggtcataggacaatagtggagggaaggtcagcagataaacaagtgaacaagggtctctggttttcctaggcagagggccctgcggccttccgcagtgtttgtgtccctgggtacttgagattagggagtggtgatgactgttaaggagcatgctgccttcaagcatctgtttaacaaagcacatcttgcaccgcccttaatccatttaaccctgagtggacacaacacatgtttcagagagcacggggttgggggtaaggccatagattaacagcatcccaaggcagaagaatttttcttagtacagaacaaaatggagtctcccatgtctacttctttctacacagacacagcaacaatctgatttctctttcctttccccacacttcccccccttccactcgacaaaaccgccatcgtcatcatggcccgttctcaatgagctgttgggtacacctcccagacggggtggcggccgggcagaggggctcctcacttcccagtaggggcggccgggcagaggggccccccacctcccagacggggccgccgggtggagacgctcctcagttcccagacggggcagccaggcagaggtggcgctagacgtctaggtggcacttcctagacggggtggcggccgggcagaggctgcagtctcggcactttgggaggccaaggcaggcggctgggaggtggaggttgcagcgagccgagatcacgccactgcactccagcctgggcaccattgagcactgagtgaaccagactccgtctgccatcccggcacctcgggaggccgaggctggcggatcactcgcggttaggagctggagaccagcccggccaacacggcgaaaccccgtctccaccaaaaaatataaaaaccagtcaggcgtggcggcgcgcgcctgcaatcgcaggcagtcggcaggctgaggcaggagaatcaggcagggaggtcgcagtgagccgagatggcagcagcacagtccagcttcggcatcagagggagaccgtggaaagcgggaggcggagacgaggcagagggggagatggtggaaagcggaatagggagaggaagagggagacggagacggagaggtgtactttttaccacaatttaaaaaatagaagatttagcagtatttttcaaacttgaagactcatatgtattacttgggaattttgttaagtttagattccaatttcaggtctgaggtagggcctggaattctgcatttctaacaaacttcaaggtgatgccagtgcttctgctctagggatcacattttcagtggcaaaaagttgtgaaatcatagatctcttctctgtcttgtagtggatggagttccggagggtgtacatttaacaagcttctggtgatttttatggtcaattaaattgagtttatttgaggtgccacagatctgtaatctgctttctagatccctttcttacccattcttaagccatcacagcagagtacctttctaacttataagattgtgtagaggttggaaggaggacaggactgttctgttggtataatgaccctgtgtccagttaatccatgcttccattgctacattatccaagagtgcaacatgacccaacaaaacctctatcagtcatgtgaggcattttttttttaacagaagaagagcattggcaccaacaatattccatctcttctttttccagcatgagaagaccatggttcttctagactcctaaagaaagtcatttgtacttagtgtaaggcgtgttgcttttggtaaagtcttttgaatgtgatgaaaatgaacatagcacaaaggcaaaatatatgctctcattgcctgcaaaactgtttctggtgctttattgaaagagcatgataagcaagatatcagtcactgccgcattgcataaacatagctcttctacattgtaatatggttctggtgagcctgcatgtctagaatagagcctgtatcactgaagtgcatgaaactgctgtgataacttgtctcacaaagcctcagggaacacattatttgagcaagtaaactcaaggtgaagttcttaccttctcagtcctgggtcagctgttggacatactggggaggaaagaggagaccatgtgcttctgccgaacaagacccaaatctggggaaagctgaacttccagggtgcacttgccctgttaccttctcctaagtacatgttgtgggaaaagtagggaaaggcggttagctgctagagctagctcagcagcaggagctcattctatgtatctcttctcaacccagcgttcagtgacttcatgttgatagcttgaaattggccaaggtaggaatatttacaccacagaaattggcaaggactacaaaccaaattctttggtgttttattttattgttttgttttatttagagagccacttgtaaaacatttactatcacaccagttcagatgatttagtagtataaacagcccatgtggtatttcttggataatttgtttcattagactgaggtacaactccaaagaggatgtcatgtcctgtacacaggactggaagttcacgaagccattcataaccctatatgaaggggagaaagagatgtagtgttcaggcaaagcctcatgagacgggaatttcctgttttgaactgaatccctgatttctttcctgcaacatacattcattcatcaaatattgattatcaacttttttataatacacaaaagggaaagaggctcttacttgaattatgccagaagtcagacaaaagaaagattgttgctttttggctggtcatggtggcttacgcctataatcccagcactttgggaggccaaggcagtaagatgacttgaagtcaggagttcaagaccagcctggccaagatggtgaaaccccatctctactaaaaatacaaaaaaaaaaaaaattgccaggtgtggtggcacacatctgtagtcccagctactcaggaggctgaggcaggagaatcacttgaacccagaaggcggaggctgcagtgagccaagattgcaccactgcactccagcctgggtgacagagcaagactctgtctcagaaaaaaaaaaaaaaaaaaaaaaaaccagatcgttgctttttaaaaattgacttaattcttcaataggttcattgattaaatatcaactttgtatcaagcaccgtgccaggcccaagggatatacagatccaggatacatattcttgccttcaaggaactgatgttctaataatagctaataacaagagctactatttcctagctactgaaattctagggttctcactatcatagtctaatgactctcttctgttcatttagcagacttcgcatactgtacactacctgcataaccaaggacttgagtttgtataagagtttaagacactgacatgtaaatgaaatatcaccaatttggactgatataagaaagtcgatgtgattacagagtgtttaaaatgcagactgtcttattatctttatatggataggatgggtcaaaggaggttaacaagaatttagcagctgaagccctacttaaagcattatataagaattaattttaatcaacatgttgattatataagaaataatgttctaaaatgtctttaaaatatttttctgggaataagagaaaacctccacctatgtttatgtaactgatttttgagttttcaagtcttttataaaaaaaaataaaaggccatacctaatcctacttgttggcagagaaagatgagagatcttgaaatggctcccgtgctcaaagtatttgtcagttttcatagagcccgaagtgccgatattgaagatgtatttcttatccataccagcatgtaatactcagcaggaaaaaggaacaaaaactccaaaaggtcacatactgtatgattacacaccacacacacacagactctctctcacacacatatgtatctaaaacattctcagaatgactaaactatagtaatgggaagaggtcagtggtttccaggagttacagaggggaggtagaaggaggctggatatgactgtgaaggggaagcaagaggaagatccttgtgacaatagaatagttccctatctcagtttccatggtgcttttgcccagtctacatgtgtgatacatacacattataccaagtatcagtttctttgtttttgtatttaactgtatctacataagatgtaaccattgggggagacggggtgaaggatgcacaggacctttctgtattatatttggtactttctgtgggtctataattatttcaaaataaacattttctgttttcaaacaatgatgtgtttctcggactctaagaaaattttcagcagaagaaaagtccgtgataatggtgactggggtagtgcagtagtggaaatagcagtggagaggggacgtatgaagttcttaatctggatcaaatactgtgctaagtactttatgttcaatacatgtattattttatttaatcctcaaaataatctcatgattgtaaaattcttttgtttcataataacgcccaaaggaataggagtttttaaacccaagagctgcccgtggaagaagcattattagagccatcaggaaacagggcattcagtgaattagaccgaaacaatagaaggatggatattaggaacactagaaggggcacatcatgctaacatcaaaatggaaaaatcatctacttcagagttgtgttgagagtctccttgtgaatatcattcataataagagagcactgacttgttttttaaaagacagggtctcaccgtcaccaaagctgcagtgtagtggtgtgagcctagctcactgcagccttgaactcctgagttcaagtgatcttctcacctcagctttccaagaagcaagggctacaggcattcaccactacacctggctaatgttttattttttatagagactgagtctcactgtgtcaccgaggctggtcttgaactcctggtttcgagtgatcctcccgccttggcctcccaaagtgctgggattacaggcgtgagccaacacacctgacctcagagaaggctgatttttgaatcagccattctaaaacagtggacctagaaagaagaaatcttctaccagtagccttctttctagatagcaatccaacaggccaaaagaaatttggggtctcataatctgataccaatattttctcctcagtagtgaaaagatttgaattaatgcatttactctaagcttgtttttagggaatgatgaggtaatagttaaagaaagtagacaacggttaaagtaataagaaatgctgaacttccaaaaaagctggccttaatattctccatcaactggcagtgttcccagtgatgcttctatcacagactgtgatagaactggcattacacaataatcctttcttcttcaataatgtagtaagacatcacatccatatatttcccaaataggactgccactgcatatctagttaaggagctatcattctactgtttctcttgagaaatgacactaaagcaaaaaacttttaagtttttgaggggttctattggccacttaaaatacccttgatatatgaccaaaattcatttaactaactaaaaacaaatagttgtgaattacatagagggcttctctcagccagatgcttctcatagataatctaataaagatcattgaaaaataataaaaagttgcatttctcacatggaggaggacccataatacagttcattctaatactgagggagtggtgccctctagcagtgcatgtgagaaatattatcatttaagtatattaaatacagcaaataaggagctcccagtatctcagctactctcagacataaggggcaatttgacagttctgagctactagaaactactgaagtttcacttccatgtgcactaattttttaagtgccagcgaaggttagattctaatagtgcccttctggggatttaccaataacttttaaaacctcattacctgtgaatgtcaaatagaacaggtccctttcacttttccttcaaacctcccctaggtcagtgtttgaggatgagaataaagggtacaaataggaaaaaggatcatcctacaagctgaacagcatctctggtgcaaaagatgctcacaaaatgggagaatgttaagaaatccattaatagctcaagtattcaaaaactgatggagttctgacaattttcccttaaaagtaccacagtttatggttacaactgataaatttgcagggttagataacttcagaagctaattaagtaaattgagttaacaaaagaaaagaacttgattttttttttttttttttttttgagacggagtctagctctgtcccccaggctggagtgcagtggcacgatcttggctcactgcaatctccacctcccaggttaaagcgcttcttatgcctcagcctccccagtagttggattacagaggtgcaacaccacgcccagctaattttgtatttttagtagagacggggttttgccatgttggccaggctggtctcgaactcctggcctcatgtgatctgcccacctcagcctcccaaagtgctgggattacagacatgagccatcatgcccggccttgaatttttaattccattttaattagtgaaagatgttccagccagtcttatctcgataagatatccaaaagattatatgcacaccaatagtacattacaaatgcttttgaaactgaaaggtgtgttttctggtttctgtgtgtctgatatgctatttcaaatcctgtaaaagcaaaatgtagttttttgacaaatatgcccatgtgttgtgcacagtttgatttatgtaaactcatttcaaatgctactgcagaatttctcctgaatggatgaaaaatgtccgcctaaagtgataaaattatatgtgtagaaagatacagttttaagaagggatttttatatgatacagatttgtaactctatttcacaaaatatcatttaaaaaaaaacttcaagaatacctgactttttttttttacatttttctgtcagttcaggggtttgcattgagtttgctctgctgaaacacttttctgtgacttagcttatatgggattggtaagtaggggaatgatgtcagtataacatagaccctggatttgttcaggtattttactaagtagcagcaaccaaacacaaagcctacgaacacagattaacacagctagccaagggaaaatacctactgcacatgattcccattcatgccacattcttcctgttggtgcagtgtggccacgtactccaacatgggagtgcttattgcgtaattctcaatctttctgcaatttgcacttatttcatagcttagcaatctcaactcttccttctttcttccatcaagctaccttctcatgcatgtgcacacacacatacactgtattttttgtagtagttattatgaatttaacttatctttttaatcatgtttatatttaattatgtttgataattactaggatggttattgtttttgtagtgttctcgttacataaatattgagtaggtgtcctgaccctatctttttcataaaccctacaatttttattgcatgattttgcagaccatagaagaaatgcgtttatctcattaaagcaaaaacatctgtacatctgtacttgcactctacttattaattgcacttattatcattgaattactcccagaattatagacttccctcataaatctgaggtaaacagattgagatatcaattgcctactagattcatttttaaaattttaccttcgcatgagaataccagccccaggtgtacattgcatggccctattaaaaagtgacctctccatctttatttgtttctaggcagttaccgaaagtatttccacaacaaaagaatgtaatcaagatttgacttgcttccactgaagcttactttcatttttaaacatcattagcctatgatttaggaacttttaagaaattggcccccattaccccccaagcccccgcattcacataacacacacctcaagttctcctttaagtaatttgtgatttatatttcaattttacattcaacatggtcttaaatattaaattccaccaggtcaaactgcaatgagtcaggcttttaaaatatgataaaattaagattccaagaaatgaatccttccattccaaaatctcttcttgcacattaattcaattaactcagaagaaaatagatattttccaggaaaaatgtcttttattttacttttgtgcgaatacaaatatgtatcttttgttttaggaaagaaataattctctgatagtatttccataggactatgttactggtgttagcatgagtgaattttttagaacgctagtggtgagcatataatagagctatctcaacacctacactccaagaacaagtcacagcttctcctaaatgagccaagcattgcattgggcacttgcagtgaaaagctaaacaaaaccctgtgtttaagaagcttacggagagtgacaatagagacagttcagcatgttctctaatagagatatatatgaagagtgctatgggacaaagcagaggtggcgaccatatcagagagcaaatgctttaacctacacaattaaaaaaaaaaatcttatggcgttcctaattttgtttctttccctttcaattttctgaaattttaaaatgtttgttcacttgaacatacaataaattttctttaaaagagtccctcaacagggagatgagaatattctgtgtcttgatcttcatggtggtgtataccaaattcaccaaactgtacacacacaaatgtaccttttaccaaatgcaaattatacctcaaagtttactaaatccatcaaaacatacagtgctacatactttaaaaaaattagcttcctccctttgatgaccaaggtagcaataagtgtattagagaaagaaaaagatgctgggtgtggtggctcatgcctgtaatccccgcactttgggaggctgaggcgggcggatcacgaggtcaagagctcgagaccatcctggccaacatggtgaaacgccatcactactaaaatacaaaaattacctgggcgtggtcatgcgtgcctgtagtcccagctactagggaggctgaggcaggagagtcacttgaacccgggaggcggaggttgcagtgagccaagattgcaccactgcactggcaacagagcaagactctgtctcaaaaaagaaagaaagaaaaagactaaggaattatctcatggaaggctgtcttgcataataattattttttgtactgtctttcagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaaggtactgtcttgaattattttcaatatttggttaacctgtaaaaatgtgttggtctgttattaataattctaaggggaaggtggggtgactatctgctgttcctgaactaagtgttaaaaaaagaacagaagctttggaaggatgagtggtaagttattgatctttatagtccttctggatttgggaattctacaaagcactccgtgcagagatagatcacatgatccccgctgaagactgccagagctgcctgaagatgaacagttagaaacatcctccttaatttaagcctgaaatttttgtagatttccccacctttccccatcctaagtcctttggtatatgtaaataagcccatgtcttatttgctatgacaacccttcaattatttggcagtggctattatgtctcctgttagtttctccttttttgaggctgtctcaaaactcattcaaaactcattcttttcaaaactcatacttcaaacagcagagtgttatgctttttatttcaactacatatttttgagaaaacaggttttttttctaatatctaaactcttcatctgtatatttcttatacatgaattacatttagaatgcatgtagtgtatacaatgcaaatatataggagttatttgaggttttacattagcttgcacgaaatggcaggtgtctctaagaccttttcttggctgtcacccctgtaaaatatcccctacctttttctataatctacttaatctgttgcaaaatggtaattatgcgtgaatctgtttgtcacctataagacaggatttgccagctgtatatataatgattttaattaatgctaaaggtcaggtactcaaggatgcaagaaggaagcctataaaaatgtgtacgtatctaccctttacacctgtacacctttggatttgcatatacatattagacctgatgatgatggtgttgtccattttaatgtaaacctgatatggtttataaatggtgtattcatactttttttaacacttgctatggactaaggagtaacaaatgtattaaatttgtggtatacatccctttctgatttctggtgtatcaagaaagcagtgtagttcattgaatgttgacatggcattcaaatttgtagccaaacctgaaaatcaatagcataattgcttattttgcagtcatcaacatgagattcattttctgttttatttacttcagtgtttcttaaaatgtggcacgtgagattacttttaatagctatgtacttacttttaatatagttgaaatataactagtatgtaccacatgtatttctcagaataaggctacattttaaaagttttaattttaaaatgacactaagaaaataataatatgggtattagacatgtcaaaaatcatgaatgaataaagttataataacactgtaggtcaatcaggagaagctaagctatgctactgtaacaagcaaccctgagttctggcttataacaacaaaaggcaatttctcttttgcacctagtgtacatcaggggtttggtagtggctctgctcctctctaaggccagcctggtggaccaagatgctctggacgttgccattgcagaaggaaaagagccaaacatgcatgggttcttaaagcctctacttagaagtgcaacacttgcactttcactcacatttcattggccaaaacaggtcacatgttcctgcaactcagcagggaaatataatcttgctatgtgcctggaagaaaagagacaacctaatattttgaacagtattaatgactgcttacaactgctacagcttaaccattgttacaagctaattaaattacctttggggaaatagtatgccagtatcaagaattctatatgatatgtgaatttaattgattgtttccaccacttgacttaccacaaagcttgtctttatccagatttcattctatctattcctgacttgactaataaggtccaaatatgcttcaacatttattttgcactaaaatatatatttaaactgaggaaactccccatcattacctaattcctgctatttatcgcctccaccttctctgtcagcaggctagtcccaaactatcaatattagcacttattctccacatgagtgctgtgttctcacagttctgatcctcgttcccacctcactcagaatgtattaaccagatatgatgattttgttaatgtaaatgcattaaaaaactggccaggtgtagtatataggggaatgctggggacttcagtgtttgccccatccaagggagacacctgccactcagccatatggagacacaggtcaggtgcctgctcatcttcttgttcttcaagagaaactagaaatctagacttttgtttgagcttccattttttaaatgtcagcaactaatttttattttgatgatgtacaatataaactgtgtgcttatagaccaagtttacttcatgagccacgggtttttaacttctgagaacatgaagtggaacatttcatagtttctgaaatgggtgaacaataagaaagattttatgattgttttctcattggcagagaagagattctgccatttttctcatttctttctgatagagaagagggaaaattaagtggatgagtgagaaaaagcaattgtagatgaaactgatgagtaaaaaattttagaacccctattttgggaaaggattgacctggtagaccaacatgaagtgcaaaattctttgactacacagctttgagtaataatttctaatgcactgcctcattagccttaattctcttttcagatgtagaatcttaggaaacaaaaggcaagtctttaacctttgattaaaaatattattaatcccttaagtaaaaaatactggcataacacagtgaaacaacactttatgatcaagccccttttattaatgttctgcctagattctgtgttttgaaagactttgctaaactcttacttattgacatttaatttcaattttaattaatcaactgcctacaaatgagtttacagtagtggtattagaagcaatattttaaaaattaaaaaggttttgtctcatctaaccatgtggtgatattgtagttagctaagtggatatagattcagaaacactggtttaacattaacatgttcgttatcttaaaaatatgtttaaaatatgttattgttttggcttcccattcttttggaaatatacagcatattcacactagccttatctatgttaatccaagcatctaaatgaaagattgaaaagtcaagtaatttcatagcattcttcttgggtaagcagaatatccataaacataaaacatttcttattgtcttgtgtgtgtctccagcaatcagtgtaggcaatatcaggcatttaaaacagggaagacctgtcacacagctcaagagctttagtcctcaggagaggtctctagtcaccataaaggcagttggaatcatttggatgaattgaggaattaagcctactaactgaataaggttgattattttatttactgttagtttttagacagaaggtactttgaggcaggtaagactgaagttgacctattaaaaacaaaaacattaaaatacagaaatagcagaatcattaataaaaatcctagaatcctaggattataaggagctatacaacaattgtatcaacccagggtggatgcttttggttacaagtaagagaaacccaactcaaaaggacaaacgagaattcattggctcatgtatttgagaagatccaggatggattgcaactgcaggtatgacagggcttaggtgctcacacagtatcatcaggactctgtctcgctctcttcctgtctcacctgcacctttggctgttttggcttcttttccaacaggctctcctctcctgctagtaggatgactactggagccatgtactcaccctcttttccaatgtatcgcaatgtccactgatcaggcagacgtgagtcatgtgcttatcctaagaggcacatggggaagcccatctcaaaccacatggactgagaatgggacaggggttttcccaaagaaatcgagctgctatcaccagaagaagagggaatggatgctgcgcagaggctgatgccaaactcccaccataattacagagcccatcttccatgccagggcagggatccccacaatggctgggcccacatccttccctggttactaataatgatggagaccttactaattgttagattatgtccttgcaacttccactcatttttggtttcactttgtggaattttactgacaaatcagattgttctccaccacccctcccttccctttctatactgggaggctaccctatgttctctttcaattcttttctaagcccagatgtcccccttgtatctgattttcttcagacagcgttgtttggcatcctctcactgttttggtcatttccaagcggttttaataagggaaaaagtagctttatttatctccacagaaaaggatgatgattattattgttatactagagagaaaaaatgaccttcagcgagtttggattagtaaggcaagcaagtgaatgatataacatagaaagaccactccctgccaatgtttatttttaaaaattaatgtggtgcttagacaagaaagtttagttgtctggaaaaatcactgagacaaaatattttacttttcaccgaagccaaataaattaataaactgtcactctcattaatgttgagtaaataaagtcttcttattcttatgcttaagggtttccccccacccttttaaatattagactaatacattatgtcaagcaaatggataataagcaggtataggtacgccactgaatttttccaaaaagaatctcacacctacagtctgcatgtcgcaggcttgggtttagaacagcagcatgactctgttttgtgaatctagccaattccagtttcattccatggatgcagcactcactgggtatttacctttgcttagcactagagagagagaaaaaaaaggagacatgaacctagctagccctcacggtgctcatagactagcgcagaggcccagtagcacaatatcaatataaatttttcaacaatcctgaggcatatgttataaaggtgatgtattgagaaggactactggaaaatgtagggcagcgatagattgtggaggccttgtattttatgtctgtggagtttagacttgaatcagaagaccatggacagaattgaaggattttatgcaagggagtgtgcagtcatatgcatgctacagaaaaattactgtgcctgcaacatgcagaaggaatcagggtagggcaaggttgaggatgcagagagggcaattccaggtagcagtctaggaagaaaatcacaacacgtggatcacatcagtctcctgagagtgaaagagagaagggtgatatacggactattaaagggtagaactgaaaacacttaatgacctagtaagtagaaggattgaaaaaaggaggaggaaaaagaggaaatgcctcctaggatcccatctttaggaactgacgaatggcagttcctaataccacttgccgcagtagtaaacagagaaggagcaagactgagagggggcaaataaagaggttactgttagcatgttgaatgtgaggtgcctgcaagtggtgacgtcattcaaacggggattcccattcaagtgtcacctgctcagagacacttttcccagtaacatacttaaaatggtaaaaccctcaccttcttttcctaatttatatattttatagtatttgtcaccatcccacatactatgtattaacttttaattgtttatttatttattattttttagagacagagtcttgctccattgcccaggctggacagcagtggtgagattatagctcactgcagccttgaactcctgggcaaaagcgatcctcccacctcagccccctgagaagctgtgatcacaggcacatgccaccatgcctagctaatttgttttgttttgtttcgttttgttgcttgtagagacagaggcttgttatattattgcccaggctggtcttgaattcctggccttaagcaaacctcctgtctcagcctcccaaagtgctaggattacaggcagaagccaccacaccttgcccacattttaaccttatcatcgatcttctccaccctccacccattggatcgtaaattccatgagaatagaaatgtgtgctgcatgtgcgtgcatgtgtgtgtgtggccggggtggggggtgggagtttggcttaaacagtacaaatttaggccgggcgcagtggctcacgcctgtcatcccagcactttgggacgtcgaggcaggcggatcacgaggtcaggagatcgagaccatcctggctaacacggtgaaaccctctctttactaaaaatacaaaaaaattagccgggcgtggtggtgggcgcctgtagtcccagctactcgggaggctgaggcaggagaatggcgtgaacccagaaggcggagcttgcagtgagccgagattgcaccactgcactccagcctgagtgacagagcgagactccgtctcaaaaaataaataaaaaataaaaaataagtacaaattgagattcttatagttctggagataaaaattctgatatgggcctcattggtctaaaatcaaggcttcagcagagatacactcattctggaggctctaggggagaatctgtttccagcttctacaggtcacctccattccttggctcgtggtcccttcgctccatcttcagagcttaatgaaaaagtgagggaggcaagtcttaatcggtagaggtttatttcgccagggttgaggacatggctgggaaatacatacgtcactggagcatctgttactggtgctcttccaaaagggggtttgaggatttttcagtatttaaaagggaaagagcaagcaagagagaaaaaaaaggagggagggtggacaaagatgcagatgcttacagtctttatttatttatttatttatttatttatttatttatttagagacggagtctcgctctgtcgcccaggctggagggcagtggcgcgatctcggctccctgcgagctccgcctcccgggttcacatcattctcttgcctcagcctcccgagtagctgggactacaggcacccaccactatgcccggctaattttttgtatttttagtagagacgaagtttcaccgtgttagccaggatggtctcgatctcctgacctcgtgatccgcccgcctcggcctcccaaagtgctgggattacaggtgtgagccaccgcgcccggcccagatggttacatttttatgaggctgtgatcggcctcaggaaatgtacattttacgtgtgaaaagagggcatcaaggaaaaagtcagttatgcattcgtcgcagggtcagccaagggataatttctggttttgtccttttcctctccgtgggaagataagctggtaattgacgttgtcagggtgagattcaacggaatttggttttagggctagtttatacaggggatatgtatcctgaaagatttaggggctcacaaggaatttcatttgtgacgcaggccatctggggagatacgtggccttctgtcattgtgggaacctggcttatgggtgaggctgtgatacagggttgtgaaattacagctatcggtctgggaacaaaaggaaagcagtgttgcgtgactcagttcccaagcttaactttttctttggcatagtgagtttggagtcccaagattctattttctttcacgctagtaaaggcaagttcttcccccatcccaccactctgacctctcttctgcctccttcttccattttgaaaggccttttctattgggctttctgtatatgttttattccgttctttaacactacaacactgcctggcatagcataagtgctatgtgagtgtccaataggaaactggaagtatagatctgagttctggaatagagacagagatacagacatcagtagataagaagccatggagtgcattggagtgcatatgttcatccagagagagttctacagaatgagaacatctatggctcaaaggaaggtaccctgaggaacagacacattcagagaatgagcggaagccacgcctgctgggaggtttgaaggagactcaaagaggtgggagaacatctaggagaaagtaacaaacagaagccaagggagaagaaaggtgcaacaaggagtaagcgcttggtgcttccaagaccctcaaaaaaataatggtgcaagcatgactgctggatttaggaaccttaacgttaccttgggcagagtacttttaggccactgtggaccagttttgaagacacaataaaattgtataaacatccatattcttaggcatgtcttgccaaaccgaaatacatgtttaggtctgcctgacccctgcagtgtaatcagatcaagtctagcattctgtgaaaatatccaactgaaataagaatgaaattcatgctcatgtgtcttgtctatagacactggtatctgcctccaaagtgaaattggatcataaccctaatttgcctctcttcccaaaggcttttggaagagttgaaattcatgtaagacatggaaggaaatcccagtgcagggctgcacaactctgtgttgcacacaaggtgtgaaacccaggtccaaagacgctggcagtctgggaggcaaagcaaatgtgatggcaggtatttgcccagaaggccgatggaatcctggtgtggaaagtaaagtttattgcttcaggcattctgtctctgttctggaggcagagtgtctatatatgtgctcttaatgagaaacctgccctcaggatatctcttacagttgctgcagagctataaagctctgttattaggaattctgccctggggaacaattatgttattgcaataattagaggcagttcatctccataataatggaaatcctgccttgtaggcaaaacaacatcaaagcaacaggagcgtcattgctctagttagaatctgctgccctgcttattggtagtactatcattttaattttgcacatgcagttacgaaagagagcttataccgctcttcaaattcagacctagaacttcttgccgttacttcagtttgtctctcctagagccatggataaaatagttacggcgttgagctctcctgaagtgcagttgcaaaagtgtttagggagattggtgttttaaaaatgtttgtcagaatccacaggcccagtcctctgggagaccccataaacttaccctcagccaaagccttttctatgtgggtatagtatggcatgttattttatggccagggttaaaatgatgactaaatccggtgactacctgagatgggtctgaccctttgctctagtcatgtggcatagtaataccagaagacatacatgtggttatataactcaagacatatatatggaatttgtatatgaagctgctttttaaaaagtgtccaatctaaaggtaacatttgattttcaaaaaaaaatcttttgaagtgtctcacatattaatcccttccttgcaagtaagtcctttgccactcccctggttttcaggccttattgtctcttgtgtgaattttgcaatgattcaaccaacctcttaaatgatttcattggaaccagccctcacccaaatcttctacaagatgaaacttaccacaataaacctctgagaaattcaattgaatgaatatctgtcacgtatctccctggtacaagatgtatttgagattatgaacataacctaatttaaatcaaggttctacatgtgtcacggaaaagggacgaaacagtttcttccatgatttaccagagacttttttttatcttatcatagttataaacttcatatttacagctattggttatttaattaatgttcattttccctaagaggctgaaagggccatgctgaaaagtgccatttgtgttggagcatacaggttccccagttccttgtgctatacctagagtagaatagacactaatgttcttgtatgaaatgaatgaaccaacccaaatcgtctgattcttggaggggattgaggagaaggtggtggtagtatatttaggtgcaaggagcagcgggaaagaaatgtatttgaaaggaaagtagagtgaaaggtttgagcaggaggagataaaactgggacatctctcagaatccagttgagaaaagcattccatggcaagctaagaagctggcatttcactgggaaacagagtgaagtaatgattttgtcttggggcttcacacttccttttaagttatctcctgtcctccatcggttgagttcagtgtttgtactcaggtagtgtctgccgtgacttaccatgcacccacctgggaaagcatttcaacttcctaaggcagtgtttctccattcctagagcaaagatccagtggttgttcccaaatttaggtctgcagctcagtgccaggctgactgcagcaaaatcaactgagatgtgttttagaaagcagagtcccactctccatcttcaaagatgctttctcgggaattctgagatggggcccaggaatcagaatacttgtttcccataggattttaatgcacactcaggtatgacaacgtagcagtggcttcccattgacttcaggatagacactaagtcttatgagatgaccagtaaggctctatatgctactcaggctcctgcctgctgtctaccagctgtctcacttcactcacctttaccctcagtttttgagccacacggaccttctctcttttcttcaaatggcttcttcttcctcttgctgcaaagcctgagaacgtgctgttctccttccctgaaatgctcttatccaggccttgaaaaactaagtccacaggccacatccaaccctccacctgtgtttgtacagttggcaagctgagaatggttttacatttttaaatggtaggaaataaatcaaaagaaaaatctcattttgtgacacgtaaaaattatgccgatgtcaaatttcagtgcccacaaataaagttttactggacaggacacagccatactcattcattcacaaatggcctgtggctggcggcttttacactgcaagggcaagattgactaagtgggactgagcctacccagatcaaaaagcctgaaatatttactctctggctctttacagaaaaagtttgccaaactctgatctaactcatggtacatttctggaaatgtggggtattaaaacatcttcatagtaacatgatcttcccccaccttgggttttttgtttgtttttggtttgctgtgccttttatttgttctttgtgacttacacttttgattaaattgtcacttccagcatgtccgtcttatgcaaagcaaaggggaagtgaatttggtgggaggtccgaattatctcactttgctctctagagcagtacctcccaacttttgccaggaagaacttcttttcatgcccccaaaatctgaactccctggagaaatcagagcccaagggagctttaaatgtgaagacacagagggtgagggatggtggcagtggagagaaaagtagatacctggtcatcttccccatatttctgaacaaccagtaaaaaaatgaagtaatgggaaatctccatccttggttgaggatccatggttttacgtggactattttatacaggtgctttaagtttatgctgataaatatttatgaatggtctagttccgttggggaaggaaagagaagacagcaatcacaggacttggtttctagagttttataaaattcagctactgtgaccatgtatacacacatcaaacaatttagaaaccaccagtgaagcacaaattaacataatatagtccaaacagaatccacagcagtgcttagggaacagactgggaagagactctcagtcaggcagagtctgccaaaatcgacttccaacaggaagtgagtttaagcctttgtgaaagaaaatgctccacagagagaggaagagagggaagggagaagtctccatgctggagcccatgtacgtgcagcaagtcatgtacaagaaatgaggggaagagagggactcagccagggggaggagttgccatctgtagcatttagatggaagaggtggaaggacaaacatcaacaggaagaagctacaggtttaactagagttgattaacactgtaaaataatatgaatgaatataaaataatagtgccagaaacacggtgagtcagcttaactgtgaagaagtttgggaatctctagccattaagtagaaatgagactttgatctctcgttatatcactaatgtatttttgaatacatttgaggctttggggatccttggggattcaggttacttattactttggctctagtcctgtatttcatggttatcttgtggccatttttatctctgtaaaaaaaatgagcattttcaaccccccatctgtcaataataatagtaacacccagcgcttgttttttttttagtctttactatgccctctgcttaatttcttttaatcctcgtaaaaatgttatgggatcagtcctattattgggactccatctttcagataaggaaaccaaggctggaagaaagcaatttatttaccttacttaaggttgcaaagcttgataatgttaaatctggaattcaaatctaggtctcactcattgcatctatgtctaccaggtttgcctgaggaaggaacaagcactagatgcttctttctaagctttaaaagggagataaagctttcgttacctccctggcataggactggcatagcagcttttcctgttactcatttcatattttcagtaataaactggcagctttcagatccatagctttatcatttcctgagagggagagaggtaggatggtctgatttcagggctgggttagaaccatgtaaaccctttggagaagaggtaaattaagtccttgaactacctcagccgtgcctttgttcagagaaaatagctgtgtatcatcaagtggagttaagtgatcatgaaaatattcaaaccaaagtggcatgtcattaagagcaattagaactgaagtgatgtgactggatattaaaaccagacaggcagtgctttgtgccttctcagtagagacaaggcagatgatttgggttcctcctaactttgtcatctctagaaataaaatctgctagacttcttagatgtattgatgccatgtaaatattgaaggtctgggatcatatactaagtttgacccctatatttccattatagagttttctcctcatatttcagtcacagatatgccagagttaattagatctctactagtaaatatccatcatgatgtttctaaatcccttttgccaaatgatctaattagagcaacacttggctttctatataattacaacatatggcacctagagggtacatatagtagaattataggttgcctgatgagaaatccaggtggtgggtaaaagactccattaaatagagtaggtgtgtgtgggtgtgtgtgggggggtatgggcatgggtgttaatgtacacaattcctcctacaattctccctagaataagtaatattttgtaattcagctgtccttcccacatgaaacaacatgattatatcatggaacaggagttaaaatttaaaagaaaacaaataattgatgacattaggataaattttttaaccttccatgcccctaaaaatgatcacatgtagtaagtcagcaaggctgaaagcagctctgtgtaagatgcattatgtgatgggatgtattcctccaagcaagatcacttacccaaactgctaaatataaaacaaagatgggaccataaagaaagaatggtttcttaatgcctatttgtaatctctggaagtagagtacccaacttcagtaggtgaagagttcagtgttggtttgttgaatttgaaaagcttatcctgcactgttgtgctggagcccagtagcaagggctcaaaagagtggattctgcacatccattcccagctctctgttcagcgatagctcacattcatagcttgatgttagccatcggcagaatatttacaccatggaaataggcccacttcaagggcagtttttccagagccactgtggtaaacattgacagcacaccactagctgtgggcatatgcagctcagagttggccacgccagtttaaagtccctgggacagatcaggtggagaaacatgactttccaaattgttacttttgaagtaataagggtgtgggaggttcattgagagaaaagagaaaagcaaaagggctgtggacagactcttctgatttatgcagagtgtgcatgaaagagaaaaagaaacagaaaaagttgtcagaaagctaaacggagaaccacgaaatagggctgctgtgaaattctaggtatcatgaatggacagtggtcaacaatgccaggtgtggccacaaagtcattcaggatgagaccacaaatgatatatatttggtgacaatgaattcacaagtgaccttgaaataaatactttagataagtgcaaaagctgtacaggctgcatggtaagcagccagatgcagtggatctttttgcaggtgttaggtaaggaatcggaagcttagatatactgcaagagagtgacatatttgtggcaaggatctcattaggatggaggagattggggaatatttatagcttgagggaaatcacactgtgtcgaagaaggagttaaagatgtaagggaggggagatgattctcaaggagagagcagaagaatggactagaaatcaattattgtgggaaatgatgaggaacctctgttctctgtgggtaggaagagaagatgagtaaagtctcagagaagttaagggtaaaaggagttgaggaatttcatataacatacctttgacctcaatctcaataatatgagagtcaaggtcatcttctgaaagtctggtcatgggggtgattgtgcacttgagcaaaagggaggcctggactgtgttttatggtcaatgtgatagaaataacatttgaattgagctttttatattttcagttgcttccacacacattgactttcccacatattgatttgctctaaagggttttattccaaaagaggtggtttgttccaaaggatgcataaaattgttatagaaaaaatgaggttgactgctcttaatatcaggaaagatgtttttcaggtgaatgcaatgtgttccaactcagaaggaaaacaatgcaatttaaaattactattatcctttctcattttctcaaggactttccctccttcaatcattcctgctctttctctacatcatcagactctcccttttcttactgttcctattggattgttccttccagcacatctgcatcttcctcatccactttgcctcctttgctctgtctactttccctctctctccaggcaatctcctcccctcccatggctgtaaacaccatgtgtgtactgacaaccctgaaatgtgtgtcttcagtacaggattctcccctgagcaatgtatggttaacattcttcagaaggaactcactcctgccaccagtctccaccctgaaccttagtcagttatacaccacctctctctgatcgcttgagcctgaaacctagaaatcactgctaatttctgtttcatcaccccatttatcctatgcatcaataaattttaaaaactttacttccaaagaacataatctatctccttctttctatgtgcattgctggtgcactggcccaaccaccctcatttcttgtccagatggttgcagtagccccgacgcgtcgctctgcttctatactcgctcccttccaatgtgttctctgtaccatagccagaatggtaatggaaatcaaatctcatcacaaatgcttaagatagaagctaagctgttgaacacaacctacaaggtatggcatggtctggctccttgctgtattatttttgtgttttgtttcatttcccctcccttacatctttaactccttcttcaactgcctctccctacctgtacgtgccagaggtctgaggccgtgtataccgcacttctcactataacaccagtgcctcctttcctcttcaatttcttctttgcatttttctgaatttgtaattccatatttatgttttcattgagttgactgttatctgccttcctaaactggcctgtaagctgtgtgaggacaggatctacctggttccgttcaccactatttatccagcactagccctggaatacaacttagggctttagtcaataagtgttcaataaatgaagaaagaaatcaatggacttacagcctcttttcacgaggactagagacttctccaaaaataaaagcaatagtaaagataaaagtaagtaatttagggagttggaataatggagaattgtcagtagaaaaataaaaatggcagcaataaaattagcacatagaaatactttcagtataattcacaggtctggttgtatctgtcttgctacccaatcaaagaaagaaacataattagttataattatcgtgtttataaaattaaaaacaattgtttgtccaatagtaaaatcttagcaaaaccttcctcatgagacgcaattactgcagttgatataagatttcatagatgtgccttataattttcatacatttggcaaatcatgtggtgatggaggacaccttagtaaattaacttctgtgaggtagggccaaatatagagctttttaatggtgaagcttgatgtaagggtacagttgtaaatactacatcaatatttcccaacacgagttcttgagatggggtgggaggtgatgtatagggtataaagtggtgttctataatcaaataagtataagaagtacaatttaaacattttgtattgcagactgtctcagaatccttaatatgttgattacagtgataatcttcaggaagcgtggttcccaaatttatctggaaatcaattttgctgcacagaatacatcaagggactagggtttcagggagcaaaaacttcggaaagctttcctctaagtggatgtaagactttatttactttaggaattccatgattaattttcacaaccatgattgtataaggacggattagaaggaaatgcaagattataattgctggcaaagaatagggagtgcacctattgtgtgtccccaatctagatgaggtgtatactatacagtagggcaaagagaaacgtgagggcaaatgtcagaatgccgcctttagggtggaacaaagatgcaagttccttgggagaatcagcaagcaggagaatcatttagctcacaactgattcctgtccacaaagtcaacaacaaagaaggctgggtaaaagctacagagagtctcaagtttttcctgatgtatttttccacaggctgttagacctaaaactgaatagctaaatcgaaagcaaaccagctatcccaatatagcataacagcatgaacaactcaagcctgcaattagcccagggagaacaggactttacttctagttccctcaagtgtggaagaagcaaagagagcacagtcaagtgagaaggaacactcggcaggttcttagcaattgcaccatcttcgttcttgatttaacatccagcgtttcatgttgattagtgaatacttggttatagagacacaaattttatttagattgtttgtttatttttagactcctaggtaatatataaatatataaatatatttatatatatatatatatattttttttttttgagacggagtcttgctctgtcatcaggctggagtgcagtggtgcaatctcggctcactgcaacctctgactccctggttcaagcaattcacctgccttagcctccccagtagctgggattacaggcatgcaccaccacacccagctaatttttgtatttatagtagagatggggtttcatcatgttggcgaggttggtctcgatctcctgacctcgtgatccacccgccatggctggtaatatttataatggccacaaacagttccctagcaattgatttggaagtgtttgcaatgctgggaacagatacccatatgatgcactttgcctacagatgtttgtatttgtatatgtgattatataataatggaattgtagttccatagtaaaaaataaaaataaaaatccattgatgaatttttcctcagtagctctaataacctttacctgtatcactcaaacataatcacaagccaaggtcatggttcagagaaaaaatgaatttttggggggttttttttttggtgttgctttgtttggtttggtttttgttccacaccctcaaataccaacagaaatataacacctcctttattaaattttatattaacagcaacattttgagataactagagcataaattttttttaccatttcattctcggaagcacaatagcacagagttaaaaaataaatctaagtagtagaattttaaagctaagagcagcatctagtctaagaactccttgaactggctcctcctccatgtgactgcattcattttctttctgataatcatgaaaagttgagctccatgatgttggtaacgaaacttttattatttctgctcctccatagaaccattttgtatttatttttgaatatgtcacacattttgctctccttgaatactagactctattaaacacctaccgaaaacacagcaaagcaaaatgtaagaaaactaacaggaataatttcaaatttcaaatgatagcctctgcctttatttaacaaatatttgaggcaactgaagtaaaaaataacatgaatgctctcttgaactttaccagaaccttgtctaaggctactgctactgccttagattgcgtgtcctgaaacaaactcagatgacaggttgcatacagaaggtttataggggagtgctctctgaggatacacctgcagggaagtgagaaaggcagaaatgagcagagagagaaactgtcctacaggttggttgcaactgggatttcagctagtcccactgagagctctggagctcagatagcccttcagaatggtcttaccttgaggcaagggaatgtggtctttaaatccctggatcagccagtcatgggcctcagatcatcacctataaggggtataagcttagtggaggcagttccccgtttcagggggtaattcagtaagcgacacagctttaagctgccccatattcttgggcagagtttttggaggtagaatgctttggcctgaaggagggaaatctgggtagagtactctttcctataattataagagatgactgtatggcacccttatcataggaagaaacatttggaactactcattatttttaaaaaaatgtcttatgttagccaattagtcttcaacaggatgcccggaggaatctgtctgaatttctcatcatgttcaaagcataagttgtaattgattctttcttggcaagggaacgcagtgtgattcctctgcctcatttcctttttccgatcctcccctcaaaaagcagactcagggaatatgacctagacagtatccccatttttagccttggggactctccattttatgaattccctttttccttttccacagacactctctcttaaaatgtctgggcacctccccctctcagcctttatcctctcttgcttactttttgtcaaagattgtcagtaacttcatttgaggaaggaaagaagggagggaggagacaggaaggaaaggaagaaagcaaatctgaagaaaataaaaaacttcgacatcagatcaataaaaccacctcttcgcctagttcctatgactttttatgcaagagggtcagtgtcttttctctgctttgagttgcaggaaagaaggacactttaattagcctaagttagtacatggccattgcctagaggatagatttgtgtcaaacctaaaaaatcaagggctagaaaaatagaacccattatatatacatcacaatatagttatgcattcaaattcatttggaatttttcaaaagtgagatagaagattttaatgtggaaatgttctgtacaacttatagatgcatgtcatattaggtaagagtagggtccagagagtctcatcttctttcaaggatgtatatcttttcctgtagctaatataatctctgattattaggatttcagggctaaatgaaactttagagataaacagatgagtgggtttcaactaccagttgaaaactctggttttcagccatccctgggggatgcagcatatcactattgttgaaaatggttcattgcacactgattgtcagaggaagtggggatggggaagaggtaaggggagaagggagggtcaataggagtgtatgagaatctcaggcaaggggatgctttggaaaatccctcctgaactttctgtcatgcgtggctttccaagccgtgggatttattggtttccccaggacttttgttttacatttatggtaaaactgaggttagatgattcatgacatgtctcataattaactattgacgtgtatatgctcatgtaacgtcatgtctcactgtaaagcaataaagctttctagcaagaagagtatttagaatcccaccagaaggttccaaaaatcatccaaccaagggttcactgaaatgagctttctttggcaagcacagtatattagctggctccacgtttaattttttaaaattaagttccaacatttataatttggtacatgccctataatccagacttcggacatctcttcaaaaactgaaggatctgcaacagacagcttgcttttttttttctttttttttttttttttgagacagagtctcactgtgtcacccaggctggaatgcagtggcgtgaacatggctcactgcaataatcccagacttctgggttcaaacaatcctcccttcttagcccccatgtagctgggaccacaagtgcacaccaccatgcccagctaatttcttaacgttttgtagcagtggggtctccctttgttgcccaggctggtctcaaactcccgggctcaagcaatcctcccaccttgtcctcccaaagtgctgggattacaggtatgagccactgcccctggccagcctgcatttctgtatggcaatacttatccagagctaagaagagttatccttttagcaaaaacatgaaatcttcagttagccatacaatccttgtatcccaaattaagatgtggtgtcagttgctgcttatcattgttttcgcattgtagtttttcttacagtaaaaataaaagcagaatattttttgcgtctgtttctctatcaaagagtgaaaataagaaaatgtagtcaaaaagaccacacacttcaagaaaatacaggaaaagaatatgttctcttatgccccataacaaattttcctgtgtacaggcaaagcatgtcatgaaaaccttcttgccagcttcattcatttttatgacctgcttacctcctataggcaatagtgcttgtacatctagatctagctctatccctttatgttaccaatgatcattcagaaggagaagaaggttttaaatccctcagactacctgtgaagtctggacaagaacctagttcctcacatctataatagtacagtgttctttttattttaccatgaatggttaatagtggaaactctgtgttttctcttccctggagattgtactaatctactcttgttattttttggttttttgtttttctttttgtcttcatttgctctgtcatactgacgtgaatggcaggttgtcaattaaccctcttcccagattgtattaaaatctgagtataaaagctacagccagatccctatctcttccattatagataccagacatctaacaacacccaagtgagggttttctttataatttttcctacacagctgattgtcagcctaacttagtgcctggtagataaaacggagaattaaacttgccttttaggccaggaaattattctgttctaacattattgctcatattaaaaccctgtgccattaaagctgtctctattaaatgaatatgtgctgggtgcgttgtttattcaatttaattgtagggaaaaaaaaaactcatacgagggaaatggttttttgaactggtttttaccagtcacaagccatgtgaatgagtgtccaattaaatagtggctcactaggacttgtgtaatagtaacatctgttaccttaattaaacaagttactatataaaggcactttcatagctcactttgttagagtaggttctgacctagaaactctaggaaggtttgttctctttgtgggattttgttggcggtagcgttcccagttggccccattaaactatagacctgacaagctctgtgatctacaaacctacaatacgttcaagcctacagagcctagaggaaggagggaactgaagtttgtgatgcaaagtggaacaaataaaatagtaaaagtgctgggtaggagtgcttcgtactcattttgatgaacttgggtgttgtgactgagaggcaagtggtggtggtaacagagaaaggagagtgaacaagtatttattgaccctccattgcatgttaggctcgcaggaaaatctgtatctgcaggcataggtctacaatcctgtatccatatctttgaaatccaaaaagctctgaaaacaaaaaaatatttttctgtcttttttcttctcttgttaatctatttgtttatttctggcaggtttggagcaaactcatttggtggcaaaaccaaactgaggctattgatagactttgtctttatttaccccatgttgaatcacagaaataataatatattgggttgtgagatactacatacaccagacttttcttgggatgttatataaaataaatatactatggtgttttttaatattcaaaatcctgaatgccaaaacacaactttccctgagagtttttgataaggggttatgtattagaccatttttaaaaaggtaaaataaactaaggctcagtgatattgttttgctcaaaaatagacaactaatcagcccttccagtgacttcccattcacttcaaatagtctctgcttgccatatcctgcagtgtcctacatagccaggcccctacttatctctctgaccatatctgctgctagctagctctttctcttagctacaatcacaccggctttgcagatcctcagtgacatctagctcttttttgcctcagggcctttacacttgcttttcccactaactgaaacactttcttccctgatctttaatgaacagctccttcttgtcccatatctcagctgaaatgttgtctttgcagagagacctcaagcacattcaaaaaagaccttgctcctgtcatgccaaccaaaacgagtgtgatggaaagttagctgaattcctactggattcatagatgaaataatatcagaaagaatacagatattatgaagtttgttttttctgcctaacgtctagtacttctttgtctgaaagaagcaccctagcgatgctttcaggaagggccttttcccattatttgcacccttccttgcttttttcagtgccaagtgctctgctgttctctacccagtggaccgggttatgggaaggcacaggctaagccaatcagaccctctccttctttcaagaatcagaattttcctatgggcaggacacagagcagagacattgggtggcagctccctggggatattgctccttaaattctactctctagacccccagagctactactggttgctgtcctttccaagccctatttgttctgctttttcttcagtttgtgagttaccccatatcttttcaataagttccccattttgcataatttaactttgcttttttgaaacagactttggtctattttagttacttacaatacccaaaccctaactgatataggcaaacagatagaacatctttaatttgtatgtttttctctaaatctaacttagaaaagtaactctttaatggcatttgggtgttcatcttagtggttaaaaataattatatcttatcccatttgaataaaacaacttaagaagttgaatatctacaatttgaggaaggggagcaatttgaaacattttgcttcgcaaagatgtttgcatccagcttaactgcttacccacctgattaagtaccttatccatgactaatggagttgtcgaacatgtggacttgcagagactcatggaattaaaatggatgtatcccctccagagagccctgtttcctcgaagggtagctagcactggagtgggatgctgtgtattcccacaggcatgtgctgacatgggagttgctgaaatttggaggctgaaacattttggctgcctttgtgcaaactcaggttgtctggcatctgcatcctcccagaatgagtcattgtatgtccatgcttcattgattcttgctgaaggagatttggacaatgggcctgaacctgccaaatgagtttgggaagccccaaacacatcggtagcttgttatataagcatcttgtgctcagcagttaggcctgccactgtctgtgatgagtagcaggtccctgtcatagtgacatccagatgaggttatttgcttacctctgtgcatgacatgtgagcccaaagatgctggactaggtcctcttccagcaaaatggtgcgcattgcccagatggtcttgcataagctgagaaagaatagagaaggcaacgtgtggccactcacctagactctcatttgagctcccttgtcagtgctttatgaatgtggaggatgaaaagatatcccagcattctttgatgaattggttttaactctatatggagaccttcctgaatcccaagataatctaatctctatttccacagcccatgaacttatccttataacatctgaagttcaaattatttatttagaatttgtgtcctatactagaccttacatttcatgacaacacgagttgcctatcttgatcattgtcatatcttatgcacttagcatagtacttgacacataatggacattaaatacatatatgatgaatgaattcactagctgtatcactttgggcaggttacttaatctctcgaaacctaattccccatctgttcaatggtgataataatggtaaccatcttagaaagggttatatgaggtaacccacgagaagcttagaattgtgtcttttgttgttatcattgataataaataacgaacaatgaatcttccctctactttcaaaaagggaagtcatatagaccagtggtcccctttttggcaccaggaactggtttcgtggaagacaatttttccacagatggcgggtggggtgggaggtggttttgggataaaagtgttccatctcagattatcaggcattagattctcataaggggcatgcaacctctagatccctcaaatgcacagttcacaatagggttcaggtcctgtcctgtgagaatctaatgctgctgctcatctgacagaaggcggagcacagactgtgatgcttgctcacaggctctcacctcctgctgtgccacctggttcctaacaggccatggaccagtaccagtctgtctgcagcctgggggttggggacccctgttctagactactgtgtaaatttagttcgtgcataattcgtctaaacttattggtaatacatagatatttactgtcttctccatgactccaagaagtgttttaactttacagatgaaaaggtcctacaaggaaggtttcagtcgttcatatgtgtatatcagaaaaacaaaggtggctcatctctccacagtagtttcactggtgatattttcattgcaaattcctttttacaggtgtcaaaaatcatagtatgtgggaatgtctgcctctagtgaccttcaatgcactattaaaaaaagaagttttgttttggattgccaggattttaaccttcaaactagcctgtgtgtcatggatccctgcactagaaggcttttagaaaaacagataaactaaaaggaagctttacagactgaacatcagctacaggaagacctaggtgattcccaactctatacccaggtgccaggaaggttctaaaagtcagtaaacacagagaggccattctactacccctggcctgaggccccaaattctggtgaaaagttctgctgcccttgtagtatggagctttttaaagcaaaggcagaaatacttagaaaaagaaagaggatgagcataagatctaccttctcccaaagcagccttatcgaaagccttagtgagatggtttctaggatatagttggaacctgtctggactcacagctccctatgtatgttgaactcttagtccaagactctcttggatcttgaggtaactacagtaccataaaaaggactagatttggggaatggcatcagagccagagctttgccatctatgtagtcttgagcaagtcacttaatttattgtacttaaaatggacttaataagaaacacctgcaatgttctgctcagatttcattagatgggaaagtgctttttatatggctctaacctctaaccactgtagagtttttgttacatgcatttttaggtctatgtgcattttttcaaaatgaaattatataataccttattgttttattatttgactctttgattgacagtatatagtagataccattccctactgaagaatataacattttcattctatgtttttattttttatggcgcaatcatatggcattgtatgactttgtcaattcactacaaatatttattacttaattttgaacagttcagtttcttctttagaactgctgtttaatctactacagttcacatcaattgcatcaaatctctagtattctaattagaatgcaataccaactatgggaattaccaagcagctgtattttgggcatcttcaccaacatggttatagcaacagcgaggatttgttgagtgagtgcctaatatgtgctaggtattttacatatactgtaccttgtataaatctcccccaaactctccagctcattgtcattctgctcattttgcacttgaaggaactaaagctcatcaacatcaactaacttaatcgtagacatagagatgactaagtgacaaaactggaattcatctgtaggttatttgacttcaaaacgacataaactgtgtccactatatgaagcatcttgcttgatctcaaactcagcacatttggatttgatctcaatgtcttgcccttgtctcaaacatgtctccaccgtgtgccaccattttatgaatggtgccatcatctaccaagctcccctaactggtagcctttccttccaactgccctgagatgacctttgtgaatgttaattccccccagattgttaattctaatgaccagcttccattcttcaatttctcagcaccatttgacacaggcggtagatcgctcctccctctgaaatccttgtttcacttggcatccaggaccgcataggcccctggttttttttttttctagtccatccaggccacttcttctccatttgtctattgggtcctcctccattctacaacttctaaactgacccggggcacagtttttgggccttttttgtatatgtcccttcttccttggtgtcttcctctagtctatagccttccaacttacctaaacactggagaagtcatttatatttccagcctgaaattctcccagaatttgagtatattgaatgatatattcaacacctacctaggtctttgcaatctatcctaggcaaaaatgtcctgactccaacatataaattgtcttcccccttagtgaaaggagaggaaagcagtgaagctttgctgggcctattgatttggatgacacgtgttctctgaatcacctagagggattcattgattaattgagtcattaatgcaccgattcattcattcaaatattatttagtgactacatcatttgccaagtaccatgctaagaatctagataaaatgtttagggccaattatctaggaaataagttttctaaattaagtcaattcttaggaatcaccttttggttttcatactaaacagggaatggagtatttctgaatcattaattcccaaatcaacttttctaaaatatgcataatcgtttccaaaatggagatttatttagatgtcacacaagataattgcagctttgtaaacctaacctaagggaaattgagttttcattcagaaaccttatcttgattgcctagacatcacccagcatcctctgacgcctctgcttgatgtccttatgtcagcctgtcctcaggagagaaagaggaaacttcaccaaaatgaacaaggtctttcaccttctccctttaggttttaggaagaagctgtttatgaaagttgtcctccagtgcccattgggaacttgcaaaagatcagttactaccgatggacagtatgtctggtctttctctctttttccacatattaaattgtcattgtgtcaaatgtcttgccatcaaatacggtgctgcaaagaaattgcaattatatttatcagttttttttctctgacctttgaatttcattcagtccacagagaatccttctcggtggttcagagaacatgtgtcatccaaatcaatagagccaacaatctctgatttttctctccccctttcactgagggggagggcagttcatatattgaagtcagaaccttttaagcctggaatggatagcaaagacctacagctttagtgcatgtaatcttgcaatgcaataacctggtagtcacgcaatctggacctagtaacaggttaccacaattccatatggagttttctagtgttttcatcctgtctgcctagtattaattttgagtttctgtctctggaaaattttgtttagattttaaaatcttggtttttgttctctaatcattttctctcactataagattctgactgtcagaattaaatatgttataaaactaatgtttaaccgtagtctcattccctacgccctgccccctgccccgcaccaccccaatcacctagaatattttgaaggaagaaatgggtggtggataatagcagccaggttatctggcagcgcaacctcattttaatattagctaaagcagaaatagtcaagagggcaagtctgccatgaaaagtcttatgaaacattacaaagttaaatggaccactaaaaaacggtagacagaagagacagccaggtgctcaccaaaatcttacagttgaactttaaaagtcatatataatgagcaagattagatgcaaaatcagccataaaaataaactatttcccaagactcaaggctaaagtgcacctaaatcttatttattagcatgactgaactagcagcacagtaaatcgtaattgcatgtgtcagtcacgtggtgtttattaggccttttctgattttgagtgacaaaatacacacaaactcatctcttctatccaccatgttgactctgttctcagacaggtgtcatcctcattaccacaaaatggctgcagcagctctagacattaaatattcagatattcaattccagaaggacagagtgagaatcattttccagaaagtcccaggaaaagtctcattgtagcttactgactctgattgagtcgtataattatccctaactaatcactatagccagaagacatgaaatgctgggattaatttaagcctgggccctgtgcttcatgccaacatttagtagtggagcctactaatatctcatggcagaggctgaaagagggataggtttttaagtggctattattggatatagtgctaatggacgctggacacaactgtttgaacaagaaggaatggtcaaaagtgacagatattgtgaagaaattggaacccttttgcacagctagtggggatgtaaaatgattcagcatcaacatcatgacatgtcctcaaaaaaattaaaagtagaattaccatatgattgaacaattccacttgtagagattactccagaattaaaagcaaggactcagctagatatttgtacatccatgttcattgcagcattatgcataataatcaaaaagtggaaacagcccaaatgtctattgatagaagaataaataaacaaactggggtatacagtggaatattttccagccttaactaggaatgaaattctaacacatgctgccatatggatgaaccttgaaaacatcatgttaaatgaaataaactggacacaaaaggacaaatattgcataattgcacttatatgaagtacctagaataggcaaatggatagagacagaaagtaggataatggttacaaggtgatgggaagggggtaatgggaagtcattgtttagatgggtaaagagtttgctagagatgatgaaaaagttctgaagatggatggtggtgacagttgcacaacagtgtgactgtacttaatgccactgaattcaacacttaaaaataattaaaatggcattttttatgttatatatatattttaccacagtaaaaaagatataaaaaatggaaaataggcaaagacaaaaatcaaaggggcaatatatactcccatctaagttaataaatgatgggaatgttacttcttttttatttttaataggtaaatgatgctaattttatttcttatttttaattatttaattgataaaaattaaatattcaaggtgtacaacatgacttgtgtatatattatataatgattaccacaatcaaattaattaatgcatccatcaccagattgtacattagacccccggaattgttcatcttataactgcaattttatactctttaaccaacatcttcctatttatttcccctacctccagagcccctagcaaccatggctctactttctgcttctacgagctctacttttttagatttcacatgtaagtgacattatacactatttgtctttctgtgcctggtttatttcacttagcataacatcctccaggttcatccttgttgctgcaatggcaggatttctttctttttaaggctgagtaatagtccgctgtacatatttactagtttctttatccattaatcccgtgatggacacttgggttgtttctatatcttggctattgtgaataatgctctgatgaatatgggagtgcagatagctcttcaacatactaatttcattttctttggatatatacgcagaagtgggattgctggattatatggtagttctaatttaaatttttttttgaacaaccgtactattttccacaatggttataccaatttacattcctatcagcagtgtacaagtgttgccttttttccacaccctagtcaatgcttgttgtctcttgtctttttcatagtagtcattcttagcggtgtgagaagatatcttattgtggttttggtttgcatttctctgatgattagtgatactgagcaccttttcatatgcctttggccatttacatgtcttctttttttatttcaactttattttggattcagagagtacatgttcaggtttgtaacatgggtatattgtgtgatggtgaggcttggactacagatgaccccgtcacgcatgtagtgagcatagcacctaataggtagtttttcagctcacatcccctccccaccttccccactctaacagttcccagcatctgtttttctcattctatgtccatgtgtactcaatgtttagctcccactaataagaacatgtggtgttttgttttctatttctgtgttagtttgcttaggataatggtctcccactgcctctatattgtgacaaaggacacgattttgttcttttatatgccgcatagtattccatggtgtatatgtgttgcattttctctatccagtacaccatcagtgggcactcaggttgattccatgtctttgctattgtaaatagtgctgcgatgaacgtaaagtgcatatgtctttttggtagaaccatttatttttctttgggtatatattcagtaatgggattcctgggttgactggtagttctaagagccactgtgactggccttttgatgatattttgatttgtctaatggatttctaatttagtatttctctgatgggaggctgttgcattttaaatggatgtttccacatattgcaagactgtagcatctctaggcccaggcattcctagtcattctgacaaacagaaaatctccatgcttcccaaacgtgctgtaagaagcattgttgcctccaattaagaaacactggtttatgaggaaagaaagtgccagttaaactggctgaatggcagttttatttcatatggtacattaataagtgagcaccccattttatatactagtttctcattagttcttatatattttaagtaatcaaaatgacccaggcaaggtaagttctgaaccttcagggtgaggcctagatattggaccatggaaattcactggcataactcagtttattgaattctcatggcagcccaaccagcaccttgcctgctacctttgtaatgtgcttcttctaaatgttagcataaacaatctgcatttttttgaattatcccggtgattgcttccctggtgcaactatgattaaaaataagacagataagttctaccccaagtagcttacaaaatgtaagcattataatacaatacagaaagcaagaatccccttaagtagcagtaaaatcacaggctgcaagaatgcagggcaggcagaaagacttccagctgcaggaagcagagacagcttcataaaagaggcaacacttaagaggttcttacgtaataagtaagcagtacatttgtagaaaggttggagaggggtattctgggtatgctatgagtaatccagggaactaatgctcaacctaggaagtctagattttatgaacttatggatccctttataactccagagcaactgacagaaagatggaatagcattccattggctagttgtcttgcccaaataacttgtttgacaaaaaccgtgcctccagggaacagaagggtcagtagtcatttgagtatctgcatatatacaaagacacatatacaatgagaacaactgaggcagaaattgaaagcaaagctctcagtgtctatgtcagagcctttccccagacggtgctaagtaaaatatgtaagcacttaaggttagctataaactattcctttgggcaaggaaataaatattattacaggaaactacagcaattttttgacatcaggaaaagaatatagtcctgcaaagtccttttaggtcaaggaaattagcttctaggggaaaatatatttaaaaacaaagagtcagataatgttttcagagcaagttttcagaaggcagtctatttccagtttatgctatctatagagcgtctgtgtaaagctctttaaaaatgtaaacacctaattgcatttcagtatgataagaccataaagtctttaagtctccacaggtatttatgagttcttggtcataactttgaaagcccttttcataattatgcctatcaacatattgtgaaaaaaaatcattgaggagcttacccttggctttagaaatagtatataccatctaattattattttaatataaattatttccttaccattagattaatatctagcccagagcacatgtaattgagaaatctgtttttttatttttagaatcatactaaatttttaagtgactgatttttcaaaaaaaaaaatcttctactcatcagaaacagtttgggatctgtaaaaatcccctagtttattccagacgtaaatttccccaaagacttttagcacctattaagtttttgtctccctaggtatgagagtttgctgtcagttaagaggaaatttataagaaaatgttaaaaccagcttaaataactttctagttctatttaatgttggtacaacttcaatgaaaacatttcaagtcagcatttcaaattcagctgccaagactcaggtaatatttcctggactcaatcatatgggcatgaaacactgcagttctatcttcaaagtcctttgaaatctgtctcatgatatctttagaagaaaatattccaaaatgaaatgaagaacttcattttcagctgaattttcttaacgtctgtcaccttcttaggtgtgggttctgaattttaaatattcctctttttgaacctgtggagattgtaaaaggctacatccctagtgaaaattggtttgagataattccctggaaaacttttgtcaaggtgtacagttgtcactttggttcatgttagaaccaggagaatgtaatatgtaataatgactaatgcccctttaaaagagcatttctctcttttcttgtctgcagatatttctcatgtctataggtaccgcacgggcaagagccatactttagataaatacaggttttgagtttttttgttttttgttttttgtttttggttaatatactgtctctctcaaaatcaaaaataaaagctaaacacttgaggctgcttataatacaagttatatataataggcctgttaaaataaaacatttagacctgtagaagaaggggaatgtgtactttaataatgacttagttagtattattagtgttttgagtttcctaggattctgagccaaaagagaaatcggcaagctgttaaataaagttcattatatgaaaaacggtgttgaagagagacaactttctcctgactttaaattatacattaaatgtgttagttgaatccaggggcaggttgattgcagtaatggcccctgctttgcacatgtcctgcgtcatgtcctttggtagtgccttcccactttcactcttgacttggccagactgcttgctttggccaatgaaatggtagtagaatggatgcaagcaaatgattttgaaagtccttgcacattggagcctaccccttgcggcttttcaaatcgtttcgctaccatgcgaacaagataaaggcctattgtgccgggcgcggtgactcacgcctgtaatcccagcactttgggaggccgaggcgggtggatcacgaggtcaggagatcgagaccatcctggctaacacggtgaaaccccgtctctactaaaaatacaaaaaattagccgggcgtggtgatgggcgcctgtagtcccagctactcgggaggctgaggcaggagaatggcgtgaacccgggaggcggagcttgcagtgagccgagattggaccactgcactccagcctgggcgacagaacgagactccatctcacaaaaaaaaaaaaaaaaaaaggcctactgaatattgaatgaagaggagacaatggcctagtccccctcatcaccccagccaacacctagctgaaacatagactcaagagcaatgaaaagtcttgttattttaagcaactgagtttgggggttgtatgttatgtggtgatagctaactgatacagatatttagacaagggatatctgctaatataatggacagtgtcttgtacagtagtttttcagcaactgttgaaaaactataggactgtctccttatagcaaatgacaacccttgagagcataccttacataaaaataaagatatttttattttcctcactgcctgttatatcaaatgttgttaaatccctgctagagacaacatacccacctctgaaccagaccaccttgttattagaagagagccatcctttgaagtcacacacaacaacactgcttaatggctagggaaacaaaggctattattaatctaaaatgctttaaacagggcttagagagaatgaaataagcagactggagtttagccatggtgcaatgctttgagggcgaaaacaaagccatccatttagataagctttgaaaaacactgtgtagaggggaattcttctagaaagtgtgtcttaacttctacaatccatttgatactcaaaatttttgtgttcctgctttcagtggcacttcctataaaaatccattgccttttccttcttcatcaaagtctttttaagcttggggaaaatagacttgtcaaaaacatgtcaaagacaattacatttgaaattttaagtcatatgaaagatgtaatttgaaccccaagacttatagactctctggacctcaaaaattatttaggtcaaccctatatgatttttgaattccctccaggaaaaacctaacttatctggatctcttctgccaaagacactcccagtaatagaaacttctgtggagaattatgccccttagggaatttttatgtaataaaatgtttatccctagatagagccattcacttttaagccagacgcctggtgcagcacaggaaatcccaggtttcctttctgccacactcttccgaatattcaaagacagcagctcttctgtccccaggttcaccaaagtcatttctttgttcaccaggctaaatgtgtcagcattcttgggttgcagttaaccaaaataactctagctaactcaagcaaacaggaattttattggaaggatatgagggacttagaaaacccctggaagaagcagttttgaaactaaatgaatctaaggtgtccctctgggattaggaaacaggaaaggcagaagctgtatatttacaggaatagtttgatcagggtgcccctgctgagttcatcaggttctttgtcctgctgttccaggaggaaggagttatgtatgactattgtagctttggttgtaagacacagggaaagggagggcctctgaccacagccttaccagattgaatccagtgagaacagctatcctcaaaagaacatatgagtactatgaaaacgggaaaatggatactgagtaggcgaaaacaacaacaattaaaataatgttgaacaccattctttcatcttcatgtgaagtggctttgagtcccatccgtcttgttcctgtgaatcatccagtgtccttagctgccctcttagttggtgttaattttttcaatgaccctctcaaatggtggtgccttgtagctctagctgcagtttgatcagcgcagagtagaatggggttatcccctcccgcattctggatgccgtatatctattaatgctgcccaggattatgttcatgtttttggcactctcatctgcccatcgagtcagactgagtttaaagtcacctaaaacctagtaattaattttctcaccgtttctctagtctatgccacatctgcccccatcattatcatatctcttcctgtgcctagaatgcactcttctactttctgttattgcctagttaacacttccttttccttcagacctcgctcgtattacctcttactgagactcaatttcccttttatagatatttataatactatacacttttcctttacagtacctcatatgatataatttcacatttatgaatgtgattatttggcgtcaagatggtctagaaagaaaatctaaatttcttattacatgatctagcccaaaccttagcagccaatctcatttcttaccactccactcacccatcccactggcctttctgttccaggaaaacacaaatcctgctgtttccttagggcctttgcacttgatgttctctctcattccccattctttgtctgaccactacttatcatcgattagatcttagctcaagtaatacaaagagaggccttccatgtttaacctaaagaaattccatcatcttttgtgcccccaacacacaccaaaagtccatttctatcataagactgtccatattttcttcttagcacatattactgcactaacttatcacattcatatttgctttatttgctttattgttagtctctccttccactgaaatgtgagatccttaagagtaatggcattatttgtcttatttattgttggatacctaattcccagaagagtgcagggcccacagtggatgctcaggaagtatttgttgaattagtgaattgaagaatggtcataaacagaataaattgtcttttccaatagagtttaagtttcatgaagggagcaaccgtatcagttttgttcactattgcatctttagtacattgcctgacacatagtaggttcttattacaaatatgtttcatgaatgcaataccatatttgcactattagtgtttttgagcattcatagggacatttatatttcagggatatttatgttcagacctgactgatacacaatatgtgagcttttcctctcaattccctatcatgaggaaaagaaattggcatcttatctctacctccacccaaagtaatcggcaatttcattggagaaatttttagccaccactgagactagttctgcataagaaaattagactgagatctagcaatttactagggccatcagtttaattatgaatatccaatgtgagtaaatcagacttcaaatgatacatgtttttcaccaaattgcttagtaactctgtcaactcttccattcattgatctctaaaattggaagacttgaggtgaaattccagtctcctaatgtgtagttcagtgtttctctgactttgggagcatataaatcacctaagaaccttaataaaatgcagaatctgattcagaaagtttgggatggggcctgagattgtgtgtttcttataagctcccatatgtgacatagctgctgacctcaaaccaaactttaagtaaggaactagataaccctggataataatagcaaacaccagttgtaagcaagtgtagcactttgtagttttcaaagaacttatttgtaaattaatttttaaaaatccctacaaagacacaattattcaggtatagatgaggaaactgaagttgagaaaactgacacctttaattgaagtcgcacaactagaaatttaaccaagtttctccttccacaactgcagttgtttccccttcacatcatctgtctggaccacattcacccactcattcacagtaaatttaattatgcttccatcgtgccctactcgaggggttgaagatacagcagtgaatgagaaaaagatcttaccaggttttctgatgtgtaaatggaatgattggcccttcccaactccagtggtctgtgattctattacggtgtgccatgtttaaaaaatgaaattatagaattaaggcattatcttaggtatcattttctacctctgtgctctcagaatcaataaacttaaattcagctgatcatcaccgtcatacaaaacttcctcccacattctttgtctcattgcagacaagcatatcggagccaaatttcacgctatccaatcaataattaattctcctcctaactgttcctcctaaattgtattgttttgtgctcctcctggccactgctgccctagttcaggttttctcttgtctagtctggcagtgtctagaagcactttctctggtgatggaaatattctatgtctgtgctaatgcaatacagtagccacttgccgtatgtgggtattgagcacttgaaaggtgaccaacgcaactgaggaagagaaattttaattttccttaattttaacgttaagtttaagtagccacatttgcttagccatctcttggacagcatgtgcctggatccttgcaggaacttttctgcctggtttccgctggcttcttcttatatctaaattgattttcctcattcattcaccagcatgatctttccaaaatgtaaatctgatgatatcactcccatgccttaagttcttatcctgggataaagtctttgcttcctatgtgactggcaagggtctttgtgacctgacccctttctgaacccaccagccccgctttctgcctcacagttaatgctctgacaatgagctaccaccttttctgcatgtcgtcccctgtatgtatctaactcctacatatcccttaagaatcagttcatctccatgaaaaattatcattgattcatccccacccaggacctctactatgttttcaggatactctatagatacatatatcatttcagggaaccacattattttatctgtctcatatttattggtggtgatagtggaaattcaccagactgtgaatttcctaaagggaagggttatttccaattcatctttattgactgagacactaccataggtagtgagcactactagccattgaatgaatgggagatgaaaagaaggagagatggaagaaaggaaagggggattaaaccagctagtatcaaattttaaaaataaatattggctgttaactgttcgggaatctcaatttttcagttaactttatttttttttacagttgatagctagtataaatctcagttagacatatttggatttttggaggactagtggataggtttcctataaacaattgatcatttgaatttagtttcagttgtacaaaataaaaggcattcaggcactgaaagacaaattttgcacgttctcacccacatgtagaagctaaaaattaaaacaattgaactcgtggagacagaaagtagaataacaattaccagaaggagggaggggtggaaaaggggtgatagttaatggatacgaaaatgtagttagacaggatgaagaaaatctatcattcaataacacaatggggtgactataatcaacaataatttattgtatattttgaaataactaaaagcacaaaatttgaatgttcctaatacaaagaaatgataaatgaggttatggataccccacttaccctgatgggatcattacacattatatgcctgtatcaaaatgtcacatgtatcccataaatatatatgcctattatgtacccatagtaattaaatatacatttttaatgaagaaagaataaataaaaggcattgtatcttctctacatagacagattattttaatcagccaaattatatttccttttgctaaaatgtctgagctttgactatattgactggtggacttttaaagccagaagacactaagttcagccatattgtaactgctcaatgggttcaccctgcctgctgcctagacagagcagatttatcaagacaggggaattgcaatagagaaagtataattcactcagagctggctatgtaggagacaggagttttactattactcaaatcattctccctgagcattgggggatcagagtttttaaggataatttggtgggttggtggggagcagggggcagtgagtcaggagttctgattggttgagttggagatgaacacataggaagtcgtagctgtcttcttgcactgagtcagttcctgggtgggggctgtaaaatcagatgagccagtttattgatctgggtggacccagctgatccactgagtacagggtgtgcaaaatatctcaagcactggtcttagattttacaatagtgatattatccccaagagcagtttggggagggaagaatcttgtagcctctggcctcacgactcctaaaccataatttctaatcttttggctaatttgttagcctacaaattagctggggtctaatccccaggcaagaatggggtttcttatgggaaagggctgttattgtctttgttttaaactataaactataaactgagttcctcccaaacttagtttccatcccaatgcccaggagtgaacaaggacagcttggaggttagaagcaagatggagctgtttaggtcagatcgcttttcactgtctcagttataattttgcaatggcagtttccatatcatttttcagaggaaaaaactatacaacttacccatgattaatcagtaagttagtggtgaattcagtagaaactggtgtgtatatgaacacattcttgaagtctaaatctggaaagaaaggcattttgtttttcaaatacctacttcagaggagttttgtttgcttttttttttttttttaatgacaatgattttggttgagattttacttaaaacaaaagttacaaagttgtgccgcctttggtacttcatgctgtgccagttaacagtggggtgggtcatctgtctatgaaccatgaccattttcagttgaaagttagggaagtctgccttatctcaaaagcccttgccttcaggcttctgttcagatggtatcagctggaacaaataagctgagattgcatttgctgttttttgtgctaatctcaagaacattccaaaaatggtttgtcagcagctgaactgagcacagaatctgtgggcatgaccatatttctcctcacaagaaaaatcactttttaagtttcttggaagttgattacaatgtgctttttgctccctcttcaaaagtaagataagtatcggaatctgtcattttctgctttggatgtatgcctaaacagccaaagaagcgcatcaaaaccaaggaaaaaaatgtggaaaggccaacctaaatgtatatagggtatagtccatccacagactatagctacacagacaaagtgaggtgaagaacttggcagttatctgagggattttcccagtttggttgatgcactcgaccatccagagttcctcttgttaagtaactttttgtctgaattttctgaaaaacagaaatagcactaaagatgaatcctgaactctgaataattgtattgtaagtcagaaaaaactttttgtgatcagccactaaaagggaagtcacaagaagagtccaccactactaccaccaccaccaccaccagagcaaacttgtttacagcctctctgagtcattactgtgctaggttttgaacacagagagcaaaaggactatattgcatgagcttatagactggtgaggagacaaacaaggaggtggacagttataatcaggatgggcacccatgttgacccccttcttctggtgtttcagccatttgatgcatcatctatggacacacagatgtttcctctgtatacactgtctcacaagtgacactgtgtattcatcaccactcttcaggttgcaaatgactgaaatccaacccaaactggcttatgaggcatttttgacaactttattgaagtataatttacattccataaaattcactcattttaagtgtacaacgcaatgatttttagtaaattgtactaagttttgcaactatcaccatcatctcattctacattattttcataatatttcaaagggaatctgctgactcacgtatctgaaaatttcagggtttgctgtatgtgctaagggaatatcatcaagacttcatttttgttggtttcattcttagccaatctattccctggtgaaacgacaaatgacccctagcggattatctaccaccttagtaaccccagcagaaaacatatacctcttttccagttgttggaacaaatgtcttaggatgacacacatttatcctgattggtctaggctaggtcaggtgtccactcctgaaccaatcgctttaaccaggagtgtgtgatgctctatctttggccatgtctgtgtcacatgaacaccccagcagccagagaatggtgttacagccacccaaagtacatggtctgaaagtggggagacatgatttcccaaaggaaaattgggattattattattattattattattcctagacaaagagaaatggatgctgtgcaggcaatacagtagatgtccaatccacaggaaaattgtgatcagagtgacgttgcttcttcccttttgaatcccctgtagtggttatcacacagccttttatatagcaagtactcaaaaaatatctgtggattggtcatggacaggctaaaacatagaacagaccaacaatgacagacttttactttcttattttattgttggggaaggctaaaaaattaggagtatgatttcaattattaaagctaataaactggggcttatctgagaggccacatgggagcatgatggtcagagagcggctggatgtgtgtcagaactcaaaagcagattgcagtcagactcttcccctgtgtaggcattgagtacgtagatatatacacccacacacacagacagttgacccttgaacaactaaggggttaggagtaccaaccctctgcacagaaagaaattcacatataacttttgactccccaaaaccttaactatcaatagcatactgtttttgttgttgttgttgtttgttgttgttgttttaagagagacagtcttgctctgtcgcccaggctggagtgcagcagcagcataatcgtagctcattttaacctctaactcctgggctcaagcaatcctctagcctcaccttcccaagtaattgggactacaagtgcatgcccccacacccggccgattctttcatattttttgtagaaacagggcctagctatgttgcccaagctagtctcaaactcctaggatcgagtgatcttactgcctcagcttcccaaagcactaggattataggcatgagccactgcacgtggactaataggctactattgactagaatgccttaatgataacacagtttataaacacttttttttttaattgagacagttttactctgttgcccatgctagagtggtgcagtggcttgattccagctcactgcagcctcgacctgctgggctcaagcaatcctgccacctcagcctcccgggtggttgggactacaggcgcacatcactacacctggctaatttttgtattttttgcatagatggggtttcacaatgtgcccaggctggtctcaaacacctgggctcaactaatccacccacctcagtctctcaaagtgctgcgattgcaagcatgaaccaccatgcccagccaattaacacatattttgtatgttatatggatcatgtactgtattctttattattttttttgagaccgattctcactctgttgcccaggctggagtgcagtggcgtgatcccagctcactgcaacctccgcctcctgggttcaagtgattctcctgactcagccccccgagtagctgagattacaggtgcccgccaccatgcccagttaattttgcatttttcataaagacagggtttcaccatgttagccaggctggtctcaaactcctgacctcaggtgatctgcccatctcggcctcccaaagtgctgggattacaggcctgagccagcacacccagcctacgctgtattcttacaataaagaaaataaaatgttattaagaaaattataaggaagagaagaatatattgactgtttattaagtggaagtgcatcatcatacaggtccttatcctcatcctcttcaagttgagtaggctgaggtggaagaaaatgtgtgtattagtggacttgcacagttcagacccgtgtatttcaatcccgtgttgttcaagggtcaactgtatatctatctatctatatctatatctgtctgtctgtctgtctatctatctatctatctatatatatatatatttggcctttcttattgctctttcatcagaagagtaatgctagtgaatgatctggaattcagtggtataccataagctggcaagaaacctggcaaattgtaatttatattcacaaaacatttttttcaaactatgcaaatctttacatctaacagaaaaacaataagcagaattctagaacctttggaataaataattcagtaccaatagatacattaaagtatattgtttatagaaaggatcagagttgaaaattgttaaggaacaacctgtattttaaaagtaaattttataccatttttcctaaaaggaatatggttcacagcaaatttcagatccataaaaactttatcttctagtgacttttaagattctctttcttgacaggaacttcaagaatggcaagatatttctttcttccacttaactgcaatgtgactatgaagatgctgtaaacatttgcaaattaggttgtaaatagcagcaatgaaagcattaactctcatagccacattttcggaagtgcactttacattatgtggagataggtattaagaaataaacctgaatgcttatataaaaattatgctggagataggtattcagaaataaacctgaatgcttatataaaaatccagcctcctattttccaagcacagtggtataattacagctctaatttatggcatactttgtaggattgctgattaattatacagacctcctgatgttttatattcttttcaactttgtttccctctgctatgtgaccactacaaagcgagtatccctaaatcacttattattcaggttacctaatttttaaaaagtgaatttgctattaacatcattttcttatatagcactgtaacatttatatgttaaaaattattgtactccttaatgttgcagctaactcatacacacacagacacatacactcactcctacacatacacatacagacacacacactcaaagattttaataaattcccgatatttacccaatgtagacatgtctaacagttctgcatgacttgatctgaaatattgaacacttcaacagtgcaacaaagcatgattcgttagggataatactaaccaatctcatttttaaactgattatagggatccaatttgaataatttgctgctgtggattatttggaaacagttgtagcacattttgtttgttgctcgaggttatcagtgttttcagaacactatcttcctttcatagttcttttgagtttaatagttatacaaaagccccatttaccagatttttcaataaatgtagtgtgctgatgattacaggaggatttgccagaaaactcctttacatatacatagtgcaatatcttcagatattatcctcttctttgctttaagtaggtcaggttcacaatgagctgttctccttaaacccctccccttcatatccttatcaaattccctttatcactgtcacatctaaattactatcttctgctttgccaccaagacatttttaatagtaagagcttcctgctcctttcttaagctcttctctttttcggtcatcaacttccccttggaattaggaaaaggcccttgtagatttgggctattaaataggagaggacccatgtatcaagtccttaaatgttctgtcatcatgagaattatttattggaacccattacctgtgcgacttcacagttctttttagatggtttgtctgaaaagaataaaggctcttcgttgaaatgaaatcgctttctttgctacctagggaagaaaatagttgagtctaattatttagaaacgagaggaggattgctgtaaggacttgagtcgatcatggaagtttctcctatgcaaaacagatctgaaggtacagaaaacataaaaataatatccctgggaagagaacacccaggtattaacttaagcacatagcaggctttattgagttttacagaaaaagtaaatacagctgacacaacctcgagactaaaatttttggtgacatctctgtttatcccagacactgatttctctattcagttttgtgatgtggagagtattccgaaggcctgaaagtgttcaaaaccattgtgcatagcttcattttgggggagaatgttataatttgcttctgaaaactaagtaatctctgacctctacccacacatcaagaaaggttagaaatcagtcctaatcccaggaattgtcatcaatgtctctaaaattctaaagactgaatgaattttaatccaataatcaacatatttaatgtgtgcctgtttgtatataaaggactgtataaaatgaaagggagacagagagatggatacgacctgggatttgagttctggaaatcatttgagtaaatggggtgatgatatattgaggaagtgtaacatcaatgccatgtgaatagattgggcagctttggaaggtcatgaattggccattatgcgatttgcccaacacagtttatacttattcataccattgtaagaggaagttgatcatgggagaaaggttgaaatagatgtgtgtttcacaaggtacaagattggcacttctccaagtactcagatcatcttggatggtacacagtatacagacattaaaaagcactgagcaacatagttctcttacactccttctgagaatatcaaggggaaactcatggttggtcctagcatatctgaacacttttgaaatcctgagtaatccctcttttactgaaacaaaaaaagtagttcctaggctgagaatcctgggagacaagtttacctagctggaatataataccttaggtgggtttttatcacatttatttttatgattaccactatttatggcaagtagatactggtttccatgtatcatagcaacaagtttcctttattctttaattttgaactttgaaacatttaaaaaatattgtgactattggttattagaatgatactgaaaataataacagaaatgatctttgcagctaacaatgaccagctgtttaccatgcaccatcacaggcttaaatgtttcatgggaatttttacatttaaccttctcacaaaaaacctatgaaattcaggtgcttgttaattatgacccccattttagagatggcagtctggagcccagaggggttgagactcccaagtcacacgtctagcagataaagaggcaaagatttaggctgtcttgtagtacatcaatgtggccgaaatggagagacgtcagttcaggaaagcttagaatggatgactgttggtgatgctgagtttctgtgcttcccagaaggcaaagatgcagctgttttagggacagggagagaccttggggattttaactggaccgtgacagtggtgttctatcatgatagtgaatgagctagtagattccactttcattttctctcttagaaatattatgaagttctggtattaggggttaaagcaaataaagcatgatcctgccatcaccaaagagttgcaaattggatgcataataaaattaaaacattttttgtttctggcatggccaatattgctatttgtcttatagaaacctcttctcattactaaattatatattctgtatagtgggcccccctttctaattaataattaatattgtcttccaggcattttagttaccaagtggtaaaggaagcttctgtgatttcaacttcaagttatttttcacatattctttacttttgcttctgctttcagacacattaatagggacacatatttctcaatattaggaaaagctatttcaacaagtaaaattagaaagcaaacagaaaaaaaaaagaactatttaattataaccaaagatctaatggtaaatttaaagaaaatctcttaaatgtggttacattttttacttcttgttttatttctttcctacaccctccaacactgcaggatagcatggtaggaagggtacaggctctctagtgagccctgagctcaaaactccactctatttcttgtaaatgacattgactttggatgttttaatttactcctctggatttcatttttcttaactgaaaaatcaggataatgatactcctcagaattgtgcagattaaatgagataatcaatgcaagcagccaacagcacccaataggatgttgtaagtgcttaataaacttcttaagcatctccatgcgcccaatactcaacttagtatatttacagtttttcttctgggtctcttggtccatttctgtccacgtcttctttatttctaattatttctagagacagctgcactttgttattaaactattcttttacaagctactctgctgttctgattttgttatataaagcttcctgagtgctttatatattttaatgtttttttctcattataaaagttatattacttattatgatgctttggtaaaagtatatggaagtatagaaaataacaaataatattgctttaaataatattactttcctgtccttacccccattcatcctcacaatgccttatggaattatgttgaaattgtctcaggtcctaaattctcagaagaaaggaattctaaatcttatattagtggaaacatggagatcttgcatcaatgaaatatagcaatttaagaaacaaattttaggcaaaatgacatccaaacatgtcctttactttatttccttttcccaaagacatggtgtttctagtgttatatgcttaccatgtgaataaataaaatcacaaaattttaccagcccaagaaaagcatttctcatgttcatcatgcactgtgtcacgaagaacaattaaaattaactctgtgatctttaatactcatccagccccaggcagagagttattgccaggttattttaaagggctttcaaactgttgttcagaggaagttaaacctgaatcaaaccaggttaaacaaacacaagtttattttctcttttgagcaatgctgcagacaagggcaatagggtctgaacgcagcttgttcttcaggtggcctgaaatgcacaggttgttcagcagtttattaaacccaaatcttacaacagaaagcaaattatctctaagggaactttgtcaccagggtgtctgttcaatagtgatgtctattgccaccacagagactacacggaaaggtcaatgacaggtttgcctgaaattaccccgggaggaggtgtcttcctattgacctacattaaatttgttatccaaaatacctttttttccttaagatggggagcaaagccatcttctagaggtctcaattgactctttgtaaattgcaattaccacaaaacaatctttctttctataattcaaaataattaattccttcccatcatgctgagaatttccacgtatcttttgaaatcaagtatgtaagcttgggcaaatttcagctaaaagttaaaataccttttgaattttatgaaaagagataggcaaggaaattcaaaccaaaacaagtctttttttttttttcttttcagagaaaagtcttggtgttatttgctatcaggtaggtctatagcatacagcctacccatgccaattaatctgccaggcttttctaatttctcaactggcacaaagccagagacccctgtactgtatccgtatgtcagctcttgcagtcacaggctaattctcctgttgataggttgaatatatgaatctttatctctgtctcttcattgtcacctctctactccttctacattgtgactatttcttgggcattgtattccaaaattatgctgtattgcttttgcctcaagggcaagtaaagacaatgcctttctcataagcagttcagctttcaggcagaacagcttagaataccataggttgccattttggtgtagatcctcctctgtcttattttggttataattttaataccaaagtaaatatttatcacttggccagagtaacaagaaaaagatcaaatgagagatgtagtttaatccaaccaacaaactgggttaattacagaagaaattaaaattgcaggcaggccctaatcttttttttcctactggacttttattctttgatacattacccattaccacccccaaactgtcttttatactcctcatttgattgttattatatcaccgagagagcaataattgcaagtctctgttagctgctgttggggaaaaggccaagccttctacaggctggaaggaggctgagcagtgggcatgggaggtggtgccaggcccacaaaagcagaacccctcctgcgtatcacttcctctgcccctcgtctaagggcttcaaacaaggtctaacagccctggggggtttcctctcttgatacccgttatgggttaaacagtttccctataaaaatcatattcacctagaatctcaaaatgtgaccttatttgggccctttgcagatgtaatcaagttaagatgagatcatactggattgcataggccctaatccaatgactgatgtccttatgtaaggagagggaaatttggatacagagggaagacaatgtaaagagacacacatccgcaccatgtgacgatggaggcagagattggagtgatgcctctgcaagacaaggaacaccaaaaaacaaaagggccaacagccgccagaagctgggagtgaaccaaagggtttctcccgcagagcctccagcagcaaccaacctggccaataccttcatgtcagactgccatcctccaccactgccagagtatagatctttattgttgtaaagcgcctagtttgtggtgtgttgctatggcagccataggaaactactaccacaccacacccatcgtcccctcccactgcattgctctgttctctctgtccagtatgtcttgagtggaaacattgaagaggggatagatcgtggcctcataaccacaggctaccctaaatcccggccccatgtactcaggcacatgctgctactggtttaaagtcagggttcacagtctcaaaggcctgcaggggcctggtaggaacattaaagagaggttcaagccaggcatagacgggagctagaaaacccaccatctgctcaagagggctgctgcccgtctcctccagcctattggtgccctaaggggatatgttgccagtattgccctatcttcccatatgtcacaattagccaggaatgggcttttatatgaaatcatacaattattagattgttattttaattgtgtagaaaaagcaagctcatctgtggctgtgaagttcctctggtctattaatgacaggctcgctgacacgtgcccaattctgtcctgccttgtgatgtacgtgagacctttggttgggggatgcctgtctaaccgccctcattctagggcatcgctgatggcccctggggtcagcagtcttcctttcctggagccaggcctcctgtgacagctctgccatcctcccctctgccatcctcccagtttgcttaagctgagaagtagtcttaccgaaatataagttagtcgctcaccccttgcagagttcaattaactggagtgaggtctggtataaagaaagcgatttattccaaagctagcttggggaaagaaatacagatgtcctgccttaagtataccacttcacttttggaacagaaaacgggtacttttcaaaggtagaggaggaagcaagcaaaacgtgatagctctggtggcttatctacgaggtgttcgagcttgtgactgccggcacctttgtggacaggactaggctgcaaacttaccaggtgggaaggagtttcctatctcttgaggcagtcacctggtaggagggagttttataaaattgaggcagcctcctggtgggggaaagtttctttctggggcgcctaagcacatagttagatgaacttgcccggtagggagtgtctggtgaaggggaggtaaaaggctatatttgcatttctaaagggctatgtaggaagtggggaaccaggggaatgagaagagaaaagagagagaaaaaaataattaaaccatcttagaaaaatggggctacttggtgacagtagcagtaattattttaactatgtttgggattctgtaataaattttagctcttcaggagtttagcctccctcgtaatgtgtaaatctattgtttcactttcaggctttcagctttcaaacacgttttctggaaccaatcatgtataaaagagagtagaagccttttaaggccctttgagttttttttttttttaattgcacataattttaagtgagctattttattcttgatctaacaataataaagatgatttaaaatttaacataacagtttgtcacttttttgtgtattttgtttgtttgttgaaaggaaatgatcactccataatttctttctttgcagaaggagagaagtggttttctaagttgtattctgaagggatttatttctaaggaagtgtttcagtgtgacttaaaggcaagcaaggatacgctgtctccctctacagcagttaggcttcctgctgaactgctcagaaaaatcataggtctccattttgggataatcctcctcttttgggtgatagagtgaagttggcagctttcatcatgtgttactaaagacccccccaaaagaaaagatcagcatttttaaaggtcctgtgtccccagactggttttgatttataggactgacaatgtcaacttttcaatggctgcaactcagagcctcatgtgaagaaagatagattcaatttatctcctgagtccagatttgttcctatcctctgtggatccaaaatctccaaatgacagtgagggaacaactgcttctctatgctctaggtaatttactgtgttgtgaattagatgacctcttttcatgtagggaaaattaagtcttgtgtcatgtctgtatttgtactacttgctgctttatcacctttggcttttctctgttgccaccaataatttaaaaagggccacaggtaggtcaggactaacctgttctaagccaagaacagatttacattttcaattcttttcatcttactccatcactattcataagtattaggaggagctcaaagttcactatcaccctaatagctacaagtcagtcagtagtctaaattgaggaaaccaagatgagatggaccataaaggaaactttgaaatctcatccagaaacaaacatgaaaataaagctattaaagcggcgctgttgtctgaggtaatacccgacgtttgacatctcatgccaagaaaattaaggacacgggcacacacaaggagtgagtttagagccgaagtttaataggcaaaagaaagagaaagaacagctccctctcctgcaagagagaggaacattcaaatgggacttccggcttgtgttggagtacaccagattttatagacaggcttgaggaggcggtatctgatttacatggggcccaaagattggatagaccaggtgtgacgtttacataactcgtggggaagctggctggaccaccctaatattatgcaaatgaggtctttgcctggccagcaccaccctgttgtctgcttcttgctgtacacgtggctggcaaagagaagggacgatggagccactattttaaacatgcctagtcccaggtagtcttttcctattggcacagctgccagcattcacccatgcacgcttccagcttgctttgtctatgtctgcagctcgattttacaagctgctctttgttagaaaagaaaatgatttaggggctgcttttcgttaaaaggaaaacctgggccgggcgcggtggctcacgcctgtagtaccagcactttggcaggccgaggcaggcagatcacgaggtcaggagatcgagaccatcctggctaacacagtgaaaccccgtctctactaaaaatacaaaaaattagccgggcgtggtggcgggcgcctgtagtcccagctactcgggaggctgaggcgggagaatggcgtgaacccaggagttggagcttgcagtgagccgagatcgcagcactgcactccagcctgggcgacagagcgagactccgtctcaaaaaacaaaaaaaggaaaaccttaccgaggactcccgtaccctcactatctgcctaaataatttctccttaactcctgtatcactatccttggactggatttaggtactatattcatgaaaaaaaaaaagaatgtaatattagtggaaaaaccgtttttctaagttggtagaagatccaaatggaaaggaagaaaatatctaagtatttatattgagttgcatttcaaatttttccttgagctagccaaatttgtaccccaaggccgaatgctagctttatagcttatttctggcttataaaaatcccataaaacattggccgagtgtggtggctcactcctggcatctgagcacttcgggaggctgaggccctcggatcacttgaggtcagaagtttcagaccagcctggcctacatggtgaaaccccatctctactaaaaatacaaaatattagctagacgtgggggtacatgcctagctatcagggaggctgaggcgagagaatcgcatgtacccaggagttggaagttgcagtgagccgagatcgtaccactgcactccagcctgggtgacacagcaagactctgtctcaaaaaacaaaaaaatcacataaaacacattaaaagcaacaggtcaaattgtatacttagcctttatatgcagaaaaatatagccaaaattatgtgatacagctgtgtatgaagaaatgtcaggtgcttttttcttcatattcggaactgtgtggttattcttccattatagatagcattcgtcaatcttctaccgaaaagttctatcaaggcagtcatcacggaatcatcttcagaatccattccttccattctacttttactaccaccgtcacctgaacaagttcagcaatttcttggaaagattgcactcttcctgttgtcagggctgaaaactcaatttctaacatcttatattattggcttatataactggggcgtccaaggtgttgacttccaccgtggacagaaatgggctcaaaaatgtcataaggtctctgcttctctttctctctctctttctcttgggctctgtttgtctttggatggcttccttaaggcatgctttctctatatggtaggcaaaataattgccaacaattctagattcccatcttccaaatttagcaatcccagcagaaagagattgttttctcaaagagctcctggttttgatggcatgcttctacacccatcactatagacaagagaatagggtctcctgactggccaggtctgggtccctgcccatctttatacctagatagtttgtcaaacagctttcccattgaaaacagtaatgctcattttactgtgtgcttatagaaatgtgtatgttattgtatggaacacattggcattatttctagatatataatcatcaaaagtaatgatttattatgagcttgagaacaaaaacaataattttcacatcactaaaaaaaatagcacaaagcttgccgggcgcagtggctcacgcctgtaatcccagcactttgggaggcgaggcgggcggatcacgaggtcaggagatcgagaccatcctggcgaacacggtgaaaacctgtctctactaaaaatacaaaaaattagccgggcatggtggcgggtgcctgtagtcccagctactcgggaggctgagacaggagaatggtatgaaccctggaggtggagcttgcagtgagccgagatcgcagcactgcactccagcctgggtgacagagcgagactccatctcaaaaaaaaaaaaaaaaaaaaaaaaaaaaaaaaaaaaaaaaaagcacaaagcctaatatataggaggtatttagtaaagaactatgaataaatgggttcaatatatcatcccccttctgtgtctatttggtgtcacccatatgctttgtgaggcatcataatgtgttgtaggacttcagagtggcagaactactcagcagttgtcttagtcttaacagaatcctttgtaattgcttgaaacagtgggtccaggaaggcacagagcttcacttaatagaacatgtggctaactctggtctattcatgagtgtctcactgacatatgcccaagcacctgtcccgcctggtgtattttacatgtcaggcatcgttctaagcaccgcacatcttaacaacaactctatgagatgtatatagttacttttattatcccatttttacaaacaaggaagctgagttacagagagattaactttcccaaagtcacacaacttctaagtagtagaagcatgatttgagcctagacagtttagttccagagtttatgttcttagttactacactatattgctgtataaaaaagtggttgagtttctccaaagaatagtttatcaaacttcatattacccccacatttggataatagtaagaataagcggtcacagcaatatgttgtgatttaatgaagactactgaaaattaccccttctacaaatgatctccctcactgtctttctctcatctggaattctaacagttagggtcttacctctcttacttacctctttgcaaataacagtgggagagttgagaccctaaaccaatatcaggcactgaaatatttaaaatgaatagtataatagtttataaaaattattttgtaatttcacaaggcccataggaaattggatagggaaactctgaggacaaggggcaaagagagccttctactacgactgtgaaaagctagctggcttttatgcaatgcagataccaaaagcaggaagcaggatggaaatgatggtggggaaaacatttgaagagtgtgaagcactttaagttaacgaaattttcacctatcttatctcattatagaagaagggattttaaaaactgaattagaccagcagttctcaaatggggtgattttgacccccagggtatctttgacaatctctggagacatttttgattgtcatgacgtggggaagggttagagctatgggagtccagtgggtataggccagggatggtgcccattatcccccccaggacaaagaattgttcagtccaaaatgtcgtcagtgccaaggttgggaaactctgtctcagagcttgcataagtaacttggctatgccatatacttgacaagtttcagagtcaaggctagaatccaagtaatctgatgacaagtcctttgcttgtttccgtattcatttccttcagcatgtcagagtttgatacaggcgatggctttaggtttttggaatgatcgtgatactgtttttaatggtataagttattaataggtgtttttgcttttaaagagtcatctcacccctcagaatgtttaatatgctccaagccagtgttacctcatgaaagataagtctgtacataaaacacaaatgtcaccttacatattgaattctcatatgccagtgtttcacaatttctagcaaattattttataaatggaatgtgactaactcctttaaagctatttttgttattattgaggtaattaagatttgttcaccactctgtttttgtcagtgcatctgctccttggcaaatgaggtatcagatggtctttactgagcaactgttatatgcgtagctgtgatgtgaatgaacaaaaggccttcttgtctgtgtcttttttttagccagagcttggatttagcttacgctaaattatttttttaattgtagatttgagatgttttattatgagaagttggtaatcatctgtgtaaactaataagaactgaaaattcatcatacatttacttatttttttaccttgatcttctagtaaatgtttagcttcatagatttaggctgctatgtaagaacattctcctttatctgagtgatgtgatttaacagagtaatttgtttatgagcatctcttattctttctttattggcaggaggacttgcacctctgcttctcattttgtcactttgggttcagacacctctgtaatagccatcactgggggcagatttcagtagactttgaaaaacttgttttccctgaggctccatatgcttcctggtttgcaaaatataatgacccgcaaatccttcaacaacagcaatggttaggcctagcagttaccacctcactggccatggctccagctcggctcccttgcctccaccagaagcatgggtcaccccagcccaaaggccaagacctccaacgccaggcctctaccagaaagcaacataggcaccgccagcaggtacaaactgcccaaccacaggtgcccttgtgccttgtctgcctcttgtaccttgattcgggatgactcagttaatttgcatattgatttcaaattgtcagaagtaacagtcaaaatacaaacagaaggcagaaggctgatgtaattactatattaaaagaaaatatattaaaatgatgttgtccaatttttcctatatatacaaatgaccaaataagagaatactttttttttttttttttttcgagacagggtctcgctctgtctcctaggctggagtgtagtggtgccatctcggctcactgcaacctccacctcctagattcaagccatcctcccacctcagccccccaagtagctgggactataggctcaagccagcacacctggctaatttttgtgttttttgtagagacagggttttgccatgttgcccagactggtctcaaactcctgagctcaagtgatcctcctgcctcagccccctaaagtgctagaattacaggcatgagccgccacacccagcctcgcaaacacaattttaaagatgaaagagaaccactgcctagtaaatatcaggaaacctctaggaaccttactgaccctatcttacctaattcttgctatcaatctataagatggacattgttagttctgtttcatagaagaggaagtaaaaactgagaaagttaagtaagttgtctttagtggtacagctagaacccacagctctggaatgtgaactcccatccctctgattccaaaattctttgtagaattcttccaccttcataccctctcatcagactgagtcatagatctggaccgggtcttcaggaagactgtagcttctccatctgtaagagccttcaaaaaagtatatgcagcatttgcaacccagcgcatttacatcttcacctgtgtttttataatgcttgctcaaaagttctatgaagtgaggctctgcccatcctagacccctgtttcagatatttgaaaggactctgttaagtatagcactagtgccaagtggttcaaccactctgaattcctacaacgtattaccgatttttcccttaggttatttatttattcatgtatttactcggccacttaagaaatatttctagtatccactacacgccatcctgtgtactagacccaggaggttcagtcgtaagacagacaccatcccttccctcagagatgctaccattccatgtgataagacaactaagaagcaaacaaataaaatttcctgattgaatttagtgggaagaaataaagtggctgcaggaaaacagggagacagggagaaccaccgtaaacagtgagttgggagagatctatcaggaaaagctacctctacactgagatcctgaaggtgagaaggtgacagctatgtccagatacagggaaatgtgttcaaagcaagcagaagagcaagtgcaaaggccctgaagtgggaaggatttcaaatactctggaatatgcagaaggccagtgtgactagagttcatcgaagggtagaaagattagaacaaaacagtaagcaagagaggctttttaaaaagctagatccattaggcttcataataaggctccagcaagaaattttttcagaatgcaatggcagagccaaggatatagctttaagccaggagagtgatataatcggatttaaattttaaaagatcatctggccactgactgaagaatggatttgagggacaagggtagaaataggcaggccaattaggaggctgttttgatagactaggtgagaaggagggcgtgaaagggatggaaagatgtgagcagatctgaaataaaagagaaatttaacagacatttaccttgagtgagctatctgtgtacattttttacttctctgacaagcctctaagccaagctgtgtgtcttattcatctttgtattttcctacttctcttctggtagtcatgatgaaaacagagttcttcaaaattcttcctcttccagattttgcatctgtcaacaaaaacattttcttccctgcagaaagtagatgtttgtctctaattgtggggcctgaggtttgccatccacatttgctcttctgccaaagtcacgctgagtcgtggaatattttaattttttttaagttcagtttttacatctcattaaaaatgtgttggctgacatatttcagaaataaatatgcttaataatacctcatttaatttaaggctctcatttagaaaaaaacactttcaatgaaaagacttaaattgattaatcaagggattttttcgtattccttattagcagttataagactaatggtgatctaccgtaagccttccctttgcctaatgtggttagagctaccaaagagaaatcgttacaacctgtctaatatttataatggctattccaactgactgttgagaccattttagcaagaaaagaattaaaaacactaaacaagtcacatgtctcaattatgtttatgtatatgtggacaaataccctaaataaagatgaggctgtcatctttactacaaataatgtagcaatgatttatggtttgaacaatgacagaatgacagaactaatttgcaataggtcatatgagataaatttcaccatttttggttcatttactttgatttcagaattaccatttctgaagatggaaacctcagaatcatcaacgttactaaatcagacgctgggagttatacctgtatagccactaaccattttggaactgctagcagtactggaaacttggtagtgaaaggtaatggctaacccaaagaattcgaatatttatatatgtgtcctcgtgtctaataatgtaatctaccgaagtggcatcattcatattaatatgtacagataccactgtattgctaaattaattcatcacggcaaacatgatatgattaataattcttagaaaactgctggtaatgaatatgattgaaaggctatcttatttcagaatcatccaatacaattttgagaattatagccattgtatctcttatagtattgtaacgaatgttatcttcaatcctttaattaaatttctttcaagtctctatagatttgaaattcatgtctaggaacactattccaacaaattaaaaactcaagactcatgtactatttttagaaaacattgtttaaacaatgacattggtaatttttaagatagctgtcccatttattcagagatatggatatggcttattatactaatagaaggctttgatcacctctatgctttgccttagtcacccagccaaccttgtcagttttaaggaaataaaattcccatataccatagcctgggtgctttataatttttgtagcagaaagtcctttatgctcttagcaaagcacgtgagtgaaactatttcaatattagcttcatggcatgggctggaagtgctaagtaaccattgaaaaggagaaaatcttaatttacatttcatttgcatttctttcactttatatattgccctgtcataggatttttgagttgaagggatcttgacaatgatttgactgaagaagatgaggctcaggttggtggttctctcaaggtcacgagtagcaggagacctgaacccagatcctgattctgagttcttcttggtcctttatgctgcaccaggaaacaggaagcctttcctgtttctgagtaatttatacagatgggtcatatcatattatttccttcttgcccatttgtagttcccttggtgaagacagatgaaggcaaataaaaatatcaaaaaaaacaatttgcctttaatttaaagaagaaagctaaaaattacctaattaaatattttagggtcattagaagttggaaatgtactactcttttgggaagtctttttatcattaacatacttgaccatgcagatagaaaattggaagtccaagagttagaactaaatatatgtttagattgattacaactatttcagtctattaattacttcctcagagcactagcatcagtgtatgactgactgcttgttcactctgtttcataggcaaaggaaaaagaggttagataatatttgtaaagtgcagttctagctagaggtttttgctaatgtatgactgtcttggctaaaggaagtttagtaatcatttaggaccaagagagatctcaatgtttcagagctggttagacacagagctgggatctgttatagattatttgtgaattatggagatataagagaatattaggttgacatcttaaatcatagttaaaagacagggattcaagtcagagtgatctggatttgagtctcatttctaccacttaccagctcttagacaagacacttagcctgtgtggggataatagcagtgccagtctcatggagtcgctttgataactgtgaaaatccatgttaagtgattagtgtggtgcctggcacctaggaaatattaatagttgttttgtttataaacatgttttcataaaatgaggttgttctgatgactgtggtaatccatgctaagcgattaacagggtgtctggcacctaagaaatattagtatttgttttgttgtttatatattttcaaatggatatgcgtgtattctaaatcctgttgaaatgaacatttatgatatttccaccccaatagaataattagcatagagaagtgagcctataataaagaaatgactaagaatatgaaagattcaaaacagctaagcatagaaaccatatatatggtgtctcatattgttaaaagtagggtattttcacaggtaggaacaaggtatgttctgtattttattatcatccttcttataagtattggcttccttggctctcccaagagttggcagaaaggagaggcctctatttcccatcagagtttgcatcccagtgataccacaagccccaggacaaaaccgttcccaaccaactgtgcagatccctgctgctcatcttacactgaatcacgatgcaaagcctacaaatatatcagggattaaatacgttatagttgcctcatttttgtgtggttataaatattgctaagatagtaatttctacctattctaacaaacaaaataatttatttcttgccttctagtaaaatgtgaacaagtattcacccaagtaagtataggatatagttttaggcagtttacagttacaattttttaaaattttattaactatttgtttctttcaaggtatattaggagaacactagttttccactaacggcaataataacaacaatatttcaaaataaatttacgtaaagaagtgagtcggtacaaagaaaagtactaaatatgcattgttataggaggatatgcaaaaaatcatgaagatggtatatgtgaatgtctaaaactaggaaacatgacttgaggacaatttccaggagagttttagtggacttatagatgcagaattagtatgtcctgcctatgctagccacatgattcgctgaaacatgcacaacactttaaaaactgaaatttcctaataggtgagagaacgaggagggactgaggtaggaagagcctggcccagtacaaaaagaggaaggcagggatgtgtaggtatgagccatgaggttaagggatgatgtgcccaggtagcctgattgacaggtagaattcatgtgtttccaagcagagttatttctggcagtggctcctggttctgagctgcagttagtttctccacagaggtcctctgattcttatattcttcttctaggtgaggtgggggaaaaaagttttatttggccaatatgttctcaggagttaacaatcctgttactttagataaggtcagaagagatttgggggatcatttatctcccagtgtggttggttctcactcccattagcattaatgggaagtacgtgtgtctgcagaggggccatccacagtgcgaggtctccaagaaggacattaacataaactgagaaatataatttaaaaatctgccccataaagcacgatataggcagagaaaaccattctgaactccgcatgaactgtgccaagtcctgaatcccacatcaaaatgcttgagccctgcacctttagtgcaagtgtaacagcttagcccgaaatatgactgagcgctgtattttaattcaattttgagatctacaaagggactaatttatcagagaaggtgttctgtaaccttaaaatgtgcttgtattctttccgatttcctcatgtgtctgggattaaaacaccgtgaaggtcgggcgtcagaacatatcttttctaacctttttacaatagttctatcattaaccatgctttcaaaatccaattctctttctccctacccttgcccccatgtttcggagagaggctgaagatagtgtcaaacacagggtcagcaggtaggggaggagagggaggtggcacatctattccaccagatacaggaggtttagaataaacctctgacaagcaatcatcacatgaataaatattcagattctgcatgagcaggctcccaaactgcagaattctgacaggtgcccagggggctcttgattatcatcccatcatctgaattcctaaattttactggttttgtttttcaggctagttataatatacttgggatttggtttgctgtttcattttaagcaagaacagttcttaagtcaaaccctcaaatactcacagaaagcataatgttagacctttaaacaaaaatgtgcttttgtgatcattgacatcattaagaactctacagagggcagggtacatttatatgcaatattgtacttactaaatcatgtttatctctacagcagagttaaaggggtggtggtgggtggggattttgcatgacacagtgcctctgctatacaggtttcatatgacagatatttttaagtagcagtcctagagaagagcaatttagagtatttgtttggatgtagttcaacaagataactatgttaatagcaaccctcactcctattgattatctccaggactcaaaatgtagggcagtatgctgtggatgctgttaacatagtcatcgtgctgaactacatccaaactgaccttgagcaattttgcaactggtggttccagactatactttgggaaacactgtcctacaccaaagaacttcgtacatgcatgccacctagcaagtgacagttcagtagagtgcatattagaagtgcagatctcctgggcctcactcctaccctaacaaatctaactcctagggaggaggcctggaaaaacctacatttaaaataaataccccaattgatccttatacacatcagagtttagaacattgcattttcaggggtttcacactatgctctgtgggccaaatccatacctgttttatataccccaggggctaagcatggttttcacatgttagctggttgagaaaaaaaccaaaagaacaataatatttttgggcatgaaacttttatgaaattcatcttttagtgtccataaataaagttttgttgtcacatagccatgtcatttttttacatattaactaaggttgctcttgccttacaacagcaaagttgagtaattatgacagagactgtgtaatttttttttttttttgagatggagtttccctgttgttgcccaggctagagtgcaatggtgagatctcagctcactgcaacctttgcctcccgggctcaagcgattctcctgcctcagtctccctagtagctgggattacaagcagatgccacgacgcccagctaatttttgtattttttagtagagacagggtttcaccatgttggtcaaggctggtttcgaactcctgacctcagatgatctgcccgcctcggcctcccaaagtgttgggattacaggcatgagccactgcgccccccgagactgtgtaatatataagtacctatataatatcctcaactttgccacttctgcaaaaccttaaatatttactagtaagtccttcacagaaaagaaaaatacttatcctctctttgataactttttctcttcctcagatcttcaaaattctgtccaaggtatagtctggccaagctatacacaacttttcttgtacccctgctgatcttgcatgctggaaatttccacatgtccttgagtctgattattagctggaagtggtagggagttttctttcccaggaccttagcctcaccccagtatccaaacagttgactttagaacttggatacgagttgaaaatccagaggagagataataaatcattgattgagagggaggaggaaaattacttggcagacactggaacaataattcaatttgattctccagcatgtggggaggattcacacagctggaaccagaatagtaagctaagaagaccctaaagtaagaagcacatgacctggtgtttttttaaaacacttctctcttcctaaacctcccaccgtcaccagcctaaatcagcagaactgttccacctttacctcataattctcagactgcatgttcttcctctaatagcaatttttttttattttgaaattgactatataaagttttaccctaattctgtctggattttaaaagagttcttttggcttttctgtttatttaaatgtctaaattcagtgcatagaattacttttataataagaaaaaataaatttatactttaagtagctttaatagaaaagaagtctttagtggaaattgactaagatcacagatacacgtaacaagaaattattttgtattttcattcttcaaccctacaagccgaaaaggttcctgtggtttagctgagcatttaacggattcctttattgccagaaagagtgctcattgttcaccccatagaaagtttatttatgtttaaatcaacagattttttcatatatatatatatatatatgtgtgtatatatatatttgtaccagcaccaaagagtatctacagcattactattgcgcactatataaaattcttctgttttaactgtaggacattgggaaatatcaacctttccatgcatagcataatagacgcaataaagtagagtcttttcagttggaactttattttgcaaatgagtttgaagcagcccaatcttctatgtaaaactgttcaaggctttatacagatttgacaggggatcaatcagaaatcagtaacatacaatgacggttggctgctaacacacaacaaaagcttttaacattggtcccttataactgaatacatttcaacccaattagatatcttccactggaaccaattatttctgggtgataattaagggtatttctaataggattaacacaaattgtgaccctaggcatctagagtaggaaggaaaagtttgtcattagaagtgctaaatgctaattatggtaggtccctcagtagaagaacatctggccagaacatttcaatactagatcctgttagatctgagatctgtcaccctggagttggtaccagctatggtaggagaatcttaaaagaagggtaggtaattgtgcatcttgttcttcctgtgttcacaaagcgtgtgacataacctggaaatctgatgaaacagggtgtgattatttcctctgacattcttatggacatgtgtgagagccacgtagattgagcaaataacatgcctttggcgatatcaatcatgagtagaatgattccccttttgtccaaatctctctgtaaaaaccttctctccttttgtaatgctgattgcataccatgacagtctgccctgactccagcctgcccatcacttctccatccttggtctagagggaagatgtaattccttaactgttacatttctctatgccaactctgtctttcgtagcaaagcctctatgctgaagacaggcctcgtatttttgcttttggcataaaagacactctgtgggtcaagaagcttgtgtggtaacatcacctcattaataatcagggaaaggcaatgtaagcatctgtgtggtgtgatttttttacatatgagactggcaaaagagaaacatctaacagtaccttttgttggtgactatgtgaggaaaatggtactcacacactctcagtagggatagaaattgcaatagatactgtggagagcaagtaaaattgagaaagtgcaatctccatggcccagcaattccattttctgggcatttaacctagtgggattcacacgtgttctgaggcagacttgcaaaggtgttccttgtgttgttgtttgtaatgaaaagaaaatacaaggaaattaaagaataatacatatggtatcattttatttaatatattgtatgattaaatataaaattagtaatataaaataataccttataatgtttgcatacagaatacacatgcggcataagccctaactcagtatttggagggaggatgcctggagtgagattatgtgaaaggactttagctgtattggtaatatctgtttgggtaaatttttaatatatattcatggggggaaaaaggctggaggtacatgaaaatgtgttaaagccttctaattctggaagagggaatatgagcacatattggtaaatttttgttgtagttttatatgtaaaatatttcaaattaaaaagaatacctcaggtcagaatcctacatggtcagatattgcaggcaaagccatccagacaggaggtctgttttttcagttctctctcagatattgtagaagagacaccttttacctggtgatatttaacccatcccatacaaataatttctttcttgtaaggaaaaaactctcctataaaatgaattaatgaattcttttgtaatgaatatttactaatcagaataaacaaaacaaacaaacaaaaaaggcaaacagaatatgactctttggcttcattatatgtgaagcacataattaatttcttttccagcaattcaaagagacttatgttatactgattcagtttaattgaacttattaccacaagaagataataagaaatatattgaagctatccatctggcttgcattgaaaacctcacatgtttcattcttcatgactgtcataggccatactaattgcctcatttcagctgttttataatcagtatgatttagctatgaatgcgataaaattcttactccagaggaagttgatattaaaaagcatagatctctcacctagctctgctaccacttctgaactcatcctcagcattattacagttatatatttttgaaatacataaataaaaatctatctttttctcgtgcatatctttttaaagtacatctgtcatcttccttctgtcatcctgccatagagctattcctttactgaaggaaagaaatggtttatgttaagcttttcagttcattaaatgtttaaatctcaaggtaggttgttttcaaactatggagtctttaaaaataatttccatagctgaaatggagtttaaatggctaattgtgtaataaataaagagaaaagaaaacttaggcacttttaccttctgtctctaaacatctgaacttcctgtggcttgagaatgatgctttgtcatgtagactggttttatgtgcacatgatctctcagaagaagacgagtttgtggtatgtctatgtgtatgttttaaatcatctgtctccttgtatgttagaggtggtcccatggggggagccaacagttggtcccaggtctgaaagggaaagcttggtttcttataaagcttgaatcagaaaggagacgtgtcagaataattcatgagtgactctccccttcctgttttggcatttgttttctgtgccagaggcaggaggagtataactctcaaagaggcagtcctaccaaatcacgactgaatttctttggctgtcgcaggcaatcaaatttaagaaaactgcccaaaagactttaggcctttaggttaaatacagaatctgaccaagatgaaagcaagttaattaacattttcatcatctctctctgatttactgtagaagatccatttctaaaaagttaaaatggttgtctcttttatgtatccatttgaggaggtgaaagtaggttcctggttatgggagaggaaatgtaagcagaacatttagagttaacagtggctttttgcttggccttctagcaggtctataatcagtgtgcaaaagtgcaagacataattaagtgaagattagcaacattgctttgaagatttcccaaactggaaaacataccaactgtcatcttattaactttttccccttttctctctcttcaaaagtagaactgcttataaatgtaagtaaagcttggattctacctagaagaggaggatccaaagggtcaaatcagaactgccttctcctccatgtatactttaataagcctggcccacatctctcctgatagaacatgtatctgcctccattggctttgtccacagcatgggtagaacacctggtcactgtgcaatttgtaccaacacttcaacttcttcatgtgtaagacaaaggaaattaaattataatgaccagtatagttgatgaagggacactctgatgcagtccaaatatgagggaatagtcaaaaggtacaaaagacaaaactgtctcctccctgtaggccattgtgagccgtagaccacaagcatcagaatcacgtaggagtttttaaataaatgcatattcctggaccctacctctgacctgcagaaccagaatctccagggatgagacccaggaattttcattttcaacaagttcttcagggaatgcctacactcaacaaagcctgcaaacttaggagctcaacctttaggagtagatactgataaacaaagacacagagctgtgttcaaagtacagaaggaacacaaagggaggcaaaactaactaagaggtaaaggtgacaattgaacagggaattgaaatatgagtaagagtctaccagattaaaaaaaaaagtcaaggtaatcccaggaaaaagaaatgtatctaatggccccagtacatgaaggctcctagcatattcagggaaaatacagtggaaaagtgaggggaacacacccatagctattgctcatatttcaggaactgtggaaaataggcaaatactttgattccctttttaatggaaataaaacagatttcatgaactgtagctaagtgacatgacgccaacttcagtagaaattttgcttcttctaagagacattagaatgaaaagtagttatcaccagcatatgattttttaaaattatgttgtaattatattatttgtagaaatattagcaaaaagataatctcatcattcagagagatccacataaatattttttatattttcttctagaattacatccaggctgtattcaatccatatctacatctgtatcttaactgtgtatgtatctgttctcagatctgtaaataaatatccttatcacaaaaagatcatactgtatacactgtttgtaacttcttttttcattagtatctttctaccagcatagattattttgaacaataaataaggactagcctggtttctttatgaatatgtttctatctcctgctcctcaaaatagcatcagcaaaacaaaacaaaaagaacaactcttgtaatatctatgtggggaagatagaagaatctgggggatgtttaggaggattgtttcacatgtttcaccctgaaagtgttggtttggggattgtcttagtccacttgtgctgctataataaaataccatagactgggtaacttgtgaacaatagcagcttctttctcatggctctcggggctgggaagtccaagatcaaggtgctggcaggtttggggtctagggaggggccaattgtcagttcctagatggcaccttgaatactgcatcttccagaggggaggaacactgtgtccagaggggaggaacatggctaatttgtcctgacatggcagagaggatggaacagcaaaagaagacaaactccccacacgaaggtcttttataatgacacctaacctcattcatgactcagtcacctcctaaaagccgtacttcttaatagtgttgcattaaggattatgtttcaacatgaattttggaagggacacaaacattcaaaccatagaagggatttatgtcaatgggggaatgaaatccctagccattctctgccctttcctcaaacttttcctattgaaatttcttatcagttgacacatgctgttactgataacatgctgagtacattctctgatcacatgaatcattagggaataaactaaatatcagaagtagtattcaaaattagtttgaaagataatcatgtgaaccaagtgtaacaagatacatcttaatagtgataaaatataaagatttgcatttttcttcaaaactcaggatgagagagccaaattttagtgtcaggttgtgataggtcttagatgactataacatcatttatgagtctacaatatatatactctttaaaaaaaaaattaaatctagaacataatagtgtccaaaacaagagaggggggaaatatagagatctactgataaaaatacaactggaagaggattgcttttaagatagacattaaaatttgaaatcaccttaaagagtgacaactgggatgataggaacagctgtagaaactgaggctgggtaatccaaggaagagaagacttatagagggtgggaggggaggggtggtcagtgttttcaaacatttaaagagatatcaaactctatgtgacatcagagggcagtaccataagagatgagcaggaactgctggagcagaggatattacttacgtttgataaaaggaaaattttcaaacaattaggccattggcctattatgtatgacattcatttccagactagacatctactctagggaaatatggcagaaagaattcatgtatcagatacaagtgtgtggtttgagtagcctgtagggtcattttctattcatcttagcgttctcagggtctgccctaagtaaatgttgactcatatatcccacccaactctgaaatgttatcattctctgattttatagcttggaaaacttacttctgccctaatgtgcttctactccagagcaaaagcatacccctaggttgaattctgtcacactgactttgttttcttactgtagagtctttctttctttcttttttttttttttttgctttcaatgtgaatttatccataatcagcaatgcagtatgggttgaaaaggttattccgctaattttgagtaatatattctcaagtaacctattctcaaaatagagtccaataaaagtatccgttttctatttaatcatatgttgggatttgaaggggttcaataaacagtaccttgttcagtgcctgagttttgaaacacttgagaagtaagttgaggcagttgggcagatgaaaatcaaatgtcagctttgctagtgataaaggggaatgtggctcagggacatagcaataatgggcttcctaacactgaactccaaattaagcagacttttaccgctacacaacctcaagtctctctcactacgaaaagaaaaataaggagtggaggatcaacgcaataggtgtacatccttcactcttccaggagaaagaatggcactgagccaagaattcctcattgttttttcccagatgcatcactggataaggagtgagtaagaggaaaaaagaggacaggcatgttaggaaacatcaggtgtgtttaaatgtcagctatagaccaagggttacaaactggtagctctcatggctaatttgacttgaacccacagacttgtattgtttggctgtcagagtgtttaaaccttttaaattagaatgcctttagacagggggcatgtattctctaaactgaccccagacctaattattccgtattatcttatagctctaaatcacatgcttaggatactgccacatcctctgtaagcatttgacacgcagtattaagtgggtctcattgctctatgaaaaaaagccagctcttgattatttccaatttttaaattattaagtagatgcaaattgaccatgatggggatttgagaagacgactactagagaagagaatgtttcaaatctttctatttataatgctgtacatgattctacactgaatctgcatttcactcccatatctataccagaaggttatcagtggaagagaaattcagttatctgaatggacatgatcttctcaggagcagtcagtggttaattgggacaagaaaacacaagtcattatcattgagaaatctgaagcaaattgaggcaggttgtcacctttcaccaggaaacaaattagccctgtctttaaaaagacttctttctctctctgctgactggggattcctgtcaactgccaatgaaatagggagagtgtagattaatggtactgtaacagtggccatgaaacaaccataaagccgttttctaatttttatgaatatttttaattgattcgaccagtgtgtttgaatgacaaaatttgtgctaagcttcagctccagaaaatcagggtgccatcttccagctgaaatcagtaggtgcaccagtctgtttggggaaagttctgtgtataaagaaaaagccataaaataccgacaaagtagctcttcctcttggctaatttaccttcatgaactccttgccaactagggacgaatataattcaggtttagctcaaaaaagagagaaacagagatagagagagagagaaataataaaatagtaggtaacatcctgagttataagggttgcaagtaggataaaacttgagatatgacctactttttctacaatttgtgaatatgggaatcattgcagtctaatgcaaagaacagtgaactgaggtcctgtacatctgggggctggttcccagattccagttttctcacctgtaaaatgaagagcctttaatcgagaaaatgaagtccccttctaattctaaagttctctgatttgatgaagaagaagttggaataaagcattaaaacattccaatttcaaatttatttgttaacagtaacaacaaatttatccagagatattctaactcaggcacccccaaaaatgagatgaaatttttcatgtgcaagagatttctattttatgaacatttattttacatgcatcaggttatggtcactcaaggaaagagaaaaattaccatttaaatcgtgtgggcagttttaccaaccagctcatccacgaatggtcatgcgatgaggacctgaaaggacattggactcggtttgcctcgatcttcatatacctgtcaaaatgtgatgatcttgccaggctgaatagaactgatgacattgattttacacagtatggccaccaaacacaagcaagccacttcaaatggctcatagagaaagggctagagagaaaactggttcatttgaacagcatattgattccaaggtggtgccttcctgggagacttctaagggcagttttcagtatataaaatgttttgttttagatactgactttaaaactgagccatgtgtagatgtatcagaaggcaaggaaaacttgtatacaaatgtccatagaagcattattcataatagccacagtgaaatcaacccaaatgcccatcagctgatgaatggataaaccaaatgtggtgtatccatacaatggactattattcagtcattaaaagaaatgaagtactgatacatgctattgatatgtggatgaaccttgaaaatatgatgctaagtgaaagaagccagacacaaaaggccacatactatatgattccatttctatgaaattcccagaataggaaaatttatagaaacagaaagtagattcgtagctgccaggggattcaaggaggcaagaattaggactgactcctaataagtacagggcttcttttggggataatggaaatattctggaattagatagtagtcatggttgcaccaaaaaaaaaaaaaaaaaaaaaaaaaaaaaacaaaaaaaccccactgaattgtatacttcttaaatgtttatttatttatttttgagacagagtcttgttctgtcacccaggctggagtgcagtagcatgatcatagctcactgcagccttgacctcctgggcacaagcaatccttccacctcagcccactaggtagctgggattacaggcgcacgccagcacgccaccaagccctactaatttttctgtattttttgtagagacagggtttcgccatattgcccaggctagtctagaactcctgggctcaagtgattctcccgtctcagcctcccaaagctgtaggattacaggtgtgagccaccatgcccggcctgaagcgtatactttaaaaaggtgaattttatgttatatgtattatatcttcaattataaaaggaaaaaataagtaatgatctattttgcacacttaaaaaaaaaaagaatgaatgaagacaaaaaggaagtaatgaagcaaattcatcagctgtgatctccagatgtcctagatgtcctagagcttgacatattcttaggggtcaccagcttttctcctctcagttactttggtgtttttcctgatccagcctctactctgataacagccctccactctattcctagaaaacactgttggagaatagtccccccatcagtcttccacccactgtagctctacaaaatctgggcacccttcctctctatttctgtgacaccgtacctgatatttaaggcagagttactggacagagaaggtctctgacagatccattacagtccatctgttcccttttcttctaatgtattatagagggaagaatataggctttgaagatagacaaatcaggttctaatctcgacattaccacctataagctgttgaaagtgcgtttgtaaaatttatataatagtacctatttcataggatagttgggaagactaaattagatgatgttttaaccttaatcagcacacaccagcactcaaatagttactctcttctcttgctgtactgttcacagcccaccaatgagaaccccagtgtctggccaaatggccgcattctgctaacatcttgtctatgccattgtgtacttggcttcacaataaagcctttcagacccactggggcagtggtcctgtacctgtagctcttcaggggtcagctgggtggctctatccccatgcctttgggtggaggctgcctggtcggtggaagcaagttgaagctccttcttttaaaattcaagaggcagccctgatgatctctgaatcacctttagcgtcattcttcccttgtcttggaaataagcacacattcactgccaaatagctttatagtcttctataaaatcgaaaaattctggtagcccttcttcagttcttcccatcttcttcctcttcagtttaaattggaagttttcctgctggggtggctgattaagtcagtgattcacaccgaggctaatctccttacccaaaaatcacttggccacatcctttgtattctcttcagaaagtgcttttccctttttatttttgtctttgcaatatggataggctgagatttttttcaaatgtttaatttctacttcctttttgcttactaattctgtcttctgatcatttctctcttctcacattttgctataagcagtcaggaggaaccaagctactccaaactttgcttagaaatctcttcagctaaatatccagtgtcatcacttgcaaattctccctgccagaaaacactagaacacaaacacaattcagccaaattatttgccactttttaacaaggatccccgtttccgcagcgtaagcagaaatttatttctcacagttctggaggccgtggtctagagagttcaagaccaaggcactggcagatccagggtctggctagggcctgcctcctggtttggaaatggtcatttaccactgtatccttacgtggcagtaagagaactagccggctttctttcctcttcttataagggcactaattccattcatgagggatctaccctcatgacctaattatttcccaaagaccccacctcctgataccatcacattgggattagagtttcaacattggaatttgggggttggggaaacaaacattagtcaattgcactctatctcagcacactgtgtagaattttttttttttttttgagacggattctcactgtgtcgcccaggctggagtgcagtggcacgatctcggctcactgccagctctgcctcccaggttcacgccattctcgtgcctcagcctcccaagtagctgggactacaggcgcccacccccacgctcggctaatttttttttgcatttttagtagagacggggtttcaggatggtcttgatctcctgaccttgtgatccgcccgcctcggcctcccaaggtgctgggattacaggcatgagccaccgcgcccagcccacgctgtgtagatttttaataatacttttgttatctaaacgtacttttggttttggttatttgaacttcatgtcaccctcatgggaacataaacttcacgatcagaacactcacgtatactcatagtctttgacacgtctggcccatattaggtgctctgtaacaatttattgaatggatggaagaatgaattaatgaaaggaccacatgaccaggtctccttttgcagtgcattggaatcatcctatctcagagttgattcataaattgccccaactagaaggtccctttgcgatttttgaaagagatagtgatcatctcttccagctcattctttttgcaaaggatactagaaagggaaaattttatattcaagctaaggcccaataattaggccttttactataccttattgtctcacagaggaacttagcaaattcttgttattcaagtaactactgagcaaattagtaagcagcagaccaaggaaaaacagaggtcgtcaatggggcatagtgaaagggacatgggctttggtgtctgccaggcccgatttcatatactaactccagacgttcttagcagctctataccatggaacaattaatctctagaagtttccgtttttcctccttaaaatgggaggtccaacctgttataagaattagaattttctctgtcaaacatctaagagctcctggtgttgagtgtgtacctttaactgataatcaatatcattgtgtttgtattccttttgctacctccccgcgccatcaactccactaccatttatccaagagcaatgtctccaagtgcttaactgtgtgtctcactgtgtagttccctgaaaacataccaaatcccagcagtgtttttgtagcagcactgaagtctgagaaattagtcactctcctcctagaaaaagtaaatcattactgtatatctacttcttatatttatgttgtttactattgtgcatgtattatagaacccacaaatcaatgctctcagcagacaaaactgttcaaatctgcagcacgtcttgttgtgtactaggtatttgacaaaacagtatatatctgtcctgaattctgttttctgaaggatggtggtgtgagcactggagtctgtgattgatttctgagtaacttgtactttatcaaggaatagatgtgatttctcatgtatctgattaaccctccctgtaagattaccatcatttctataatgccagtggattattctgtgcttggaaagatgtatatcagatcattttaatcaatagcctacaaaaggtgtcacctggctctgcctgtggttatctataatatctcacccaaagggtgttgtcatttttcaaataacctgtttaacttaaagcacctaggaaatgaagttgcctttattttgaaacagtatgcagaacaatatgttaggtgaataaaatgtatgcttgttttctgcacgttaccctattaaaaagagagaataccagtgtggtaaaatatccacttatccatctccatcacacaagactggcttggtaacccatagattggtatgggagcaagataaaagtagggtatgcaatagattctgtgctggcatagcaaaatgggagcaatgaggaagtgacactgggctatcatataatcttttatcccaattagaataaatggggtgctgcagataggctggaacaacagagataaacccaagaccatcctgggcaagcaaggacacatgtcaacaataaagtcataccctgttttgtaatttaggaaactttctcatgatgttgagtaactgggacatttgggattaatgatgtatctgtgatgtactcctctgttggattccctgagaaaaatcttttgagatataaactaatcattgcttactattcagccatgtagagaatgtgtgtttccatacttaagataatgagtcctactaagagagaagaggtattaattcttgggagggataattttatatcaagtttagacagttttcagtctgcactaagctccttttttatggccagtttaggaaaaatgctaatgcctcgtatccagacctgtttggagatagagcaagtcaagcagaaaaacgccattctcctaaatgagcgttaggccacagaacacgaaatctgtcaggcagcattttacctggcatggatccgccaaagaaaacaaacaaatcagagttggattttttaagactaaataacagcaagccaaagaaagagcatttacactgaaaaaactgtaaaggttgacaacatcctcaactcattaaatatgatggggaagagtaaaatatgtagcacttttgctccttagtgtgggcttttaagcctctccttcaatcgtgatttcactacttcgtctctaagctatagattctgcctttgcaaaaagagaatacccacctccctaagtcgttccgtgtctaagaaaggtaacattatgcagagcattaaacatgtaacctgacacagagacactctacataataataggtcatttcccttctcaaacgacccagatttctagaggcaactagctatagcttgatgcaaaagtgttgcagtttttaccattacttttaatgcaatttaaaacgcaactacttttgcaccaacctaatataataggaatagacaacagcagtagcaggcattcgggtttcccattgtcctcggcattctagggcaaaccaccaagatctaataagctgtgagattccaaaagaagggcgccaaaccttgggctgcacggcttcaaacttcgtcattacagaatcaccagcgtctttcttggtatgatctgcgggctagaggacaagcctggtgttattagcacagtgagcaagtggcaagagcaccacctccggagccacaattagggaagtaccatgccttgccctggcatgactggagagtaggggccaatgttagactataagagttgactaggattgattgccataaacagtgggccatggttactttcctcggagcattgcagagagcctctttctctgggaggccagcctacaggagatcagtcttagacaagttaacctttacctttcaattatcatggcttaaattttcaggaactctcttctagtatctgaatgttccttatttgtagcacccttttcttgtttatgcaaataaacaagaaacacccttttcttgctactgtcaattcaatatctaatatttctctgaaaataataatgacagaatttcttttttttttgagatggagtcttgctctgtcgcccaggctggagtgcagtggcgcgatctcagctcactgcaagctccgccccccgggttcccgccattctcctgcctcagcttcccgagtagctgggactacaggcgcccgccaccacgcccggctaattttttgtatttttagtagagacggggtttcaccgtgttagccaggatggtctcgatctcctgacctcgtgatctgccctcctcggcctcccatagtgctgggattacaggcgtgagccaccgcgcccggccagcatttctttttgcttgccttgaaattgatcttttgtgttagttgtcctcacatgtctattgactcacagttgttggcccatatttaagagtgtggcacgaaaaagcctatgtgaagccgtgaacatgtagatgaagttcattgactaagaactgggccatttccttgtggaactccccatacccacattaatatttcggtgtttccttttcggctgatcgctacctagagaaagaatatctagtacctagtctcatttggaagaacacagaactcaacagcagtgtcctgggagcctccttggggaaggagactgagaatctcagcttcactgtatgaacactcactaaatccctgctatcctcagttcaacctggtgtcctctggcccagagacctacctctgtattacctgctcagaaagtaaaatcccagaatacttctgggatggggagggttagtcacctggatgcatggaataagggagagcaaatagggacctaattgattttaaacagcatcttccagtgctctgttacctgacttcaagtaatacccgaattcccaaatctttgggcatttttctatagagtaagtcagactgtttcttgtctttccccactgccagtttaggattcagggtttcttatctgctaatcatccagttgctttccagtattttaacagtaatacctcccaaccattctctctgtctttataggcttatgccattaaaaaaaaaaaaaaaaaatccttgtactactgtttaaaaaagttttagaaggttcctaggactctaaaaggatcattgtgacgaagaaatggataatttaaggaagccagcacaatgcctgacacataattgtagtgattatttttgttattttgttaatattcaatccttgtaaaatcatccaagtttataaattatgtactatatagccaaacagcatggacgaggagggcgctgtgaaattaagacctacgtcgttcaccttcccagtggtgtcaggtcatctctacaaccatgagcttttagtatggttagttcccattccatttcatttagaataaccttgtaaaagaaacagggattgggtgtgagtgacacctaaccactaacatgataagcattctaaatctatgttcagcatcatgtaagtacaccctcattgaaatgcagatctccactactggtaattccacacactcctattgaagaaagaattgctcctctgaagtttgctaccccatcctctcacgtttatcacttctgcaaagtcatgcagcatgcctcaggtgaccctgtgaggtaagcaatcttgcactgtatgtgggcatttgcgctgatcttcccagaagcaacccttagtccttgcataatttctagcctcaggagaattataagatagaagacaagtgggggaagaaaaggtttaaaaagattctgtgttctttaaagccagatacttctcagctaagcttttctcagacctttcatgtccctcaataaagtatatttttggctatgccccataaactactccaataatccattaagatagctgtagaaatcagcatagcaaactatcagtgagctggtttagttattcaccggttattaatcttctcagctcagggtcatattgtcctgtcttcagcatttttcacagtgtctgatgatgttcagagagttaatggaggtcctgaaatgtggatacaacaagcatgataatcccttgacttgatgtcattctagggatcgttttcaaactttgtgtgttgccctggcaaatgagcaagaaggcacctgtgtcacttatctggatgtttgtacactgttctggcaaataaatgtctatgtacaatgataatttccttatgatactttcactagcaacaacttgttttgagcatttgttaccagttttagtagctgtcatttttgtttcttctttagcttccttgtaaagtcgaggcacattttgtcctgacttagagtcgcgatatttctttggagattcatgtgagcgtcttcctctcactaaattttcctctccccgccccagtctctgcatgtttggagaagttatcttcctctgaagcttcctgcacttaaaacagacccaggcacaagagacttccatgatgatgatggtgatgatgacagtgatgatgaggatgaggatgaggatggtaatgatatctttattcaaacactgaaaccattcatcatgttatatgcaaccacaggaatattacaagttaagaaacaaattaactgacttacaagtcaaataactttcccacaatcagtcaactagtaaggggcagagctaaaatttgcatccagatttttctgacttcaaaactcagtttcttagctacttccagtctgtaagagcagctttctgtctagaatctgtacaccctcaccacaagaatctagatagctggttttcctttggatctgcatggtacaggcatctatctttacacctggaagaggttcttttacttaggatgtctgtattcaacaaaatatcagttgagatcacgtagggcattcttgacctttgcaaggattttggcatttactctgaggtaaacgtggaggcatctttgtttctgtcacattcttagtaatagctagcattttttgagcactttttatgtagcaagctctattcttgtttgtttgatcggtttggttttttgtttttgtttttgtttttgagacacagtctcacactgttgcccgggctggagtgcaatggcgtgatctcggctcactgcaacctctgtctcctgggttcatgcagttctcctgcctcaacctcccaagtagctgggattacagatgcacaccaccacacccagctaattttttgtatttttagtagagacagggtttcactatgttggccagacttctattctcaaaactttgcattggctgggcgccgtggctcacgcctgtaatcccagcactttgggaggcggaggcgggcagatcacctgaggtcaggagtttgagatcagcctggccaatatggtaaaaccccatctctactaaaaatacaaaattagccaggcatggtggtgcatgcctgtaatcccagctactcaggaagctgaggcgagagaattgcttgaaactgggaggcagaagttgctgtgagccgagactgtgccgttgcactccagcccgggcaacaagagcgaaattccatctaaaaaataaaaaaataaaaaaaaccctttgtattaattcaccttagaacatcaccctcttcttactctcgaaataagtgtctctttttcctttcttccccgtgcaaatctttggcatcaatagtaatggtaataatagtatctcatactctgtagctctttatgttttatgaagcatgttaaaatccattaactcattttgaatttcatagtcatcctgggatgccaaataccatctcctccaaattatagataagaaaactacagctcagagacgtcgaatgacttgctggtggtttcatgcctaatcagtgctgtatggccaaacctagaaactaggcttttagacactaaattgagtgttttatatatttcatcatgatgacatgtttagcaaaagctaggttagtatcagagagtcagtaagagaaagtcctttactccctgagaagacatccagcaactatttctgagatgagctctagacctgggctgatttccagtgaacggagtcctgcttattactggtgctccagcattgtttgggagctcctgccatgggaaaatagcagggtatcctattgaccgccagggtgcccaagtgaacattgcatcctgcatgaaaagtgccctccgggattgtaaaaagtgtcaggtcctgttatggtaactaaatgcaagataacctttctgtggaaagcaagcatatgatggataagaaatgattttgtaaactatggaatgatctacaaatgcaaaataccatatgccttgtacatcttgcctgcttgagtaaatgaatgatttttcttatgtatctctctgtgaatattggtttattcgatgctgcagcagtttgcaaactctgttcactcttgcactgcagcccagagacacaccctagggagttggcatgtgtcatacaaataatgtgtacctatttgttataacctaggcttgggtcttgcctcactatctttcctaccaatactgagctattagattctaatggataatctaggaagtgaatacattcctgtaaactttaacaaattttattgaggaacagacatttaaatgtacacacacacacacacacacacacacacacacacacacacccctaggggttttgtttgttttaattcaagaaactaacacgtttgtggaatgaggaagtcattaatgttttttgactaaccaagacctagccaaaaatctatttctctttctgcccttaatctctttctgaagtatcctgccaatttttaatgctgaccgtttctcaatactttcagtctgtagtagtactagagtgcttcacttatcactgtggcaaaacctacttgtcattttagagaacagtaaatgtggatttggaaaatgtgggactttgggtcacgtcagaactctgacttaaatttcaggcaccctttagttggaagtggcaagatacagcttatctgcaaatgactgtaattacaaagatagagcttgcccaacaaagggtttctattttaatatcataaaaaccaaaaggtggaatggtgctccacaaaagactgccttttcactttctaaaaattcttttctggctctgtgtactccacttggtgtgaatgtcatttattagcatgtgatgtctttgtggagtagaggattctgccgctctctgcttgtctgtcttgctctgtttctctgcattttcatctccttttccttgtctcttggctttaacattctttccacctccattaccctttatattagattagatctaacttttaaattatttgatgtatctttaaattttgtgttccctgtacctaatttaaaagacatgaaaagttgtaaacatctctctgaaaataaactaaattaagttgctttatacttgcgtgaccctcgattggttttttttttttttttttctctttgggtcagcaactctcaatagaaaagtttccttatctctagtgtggaagattggactaaatgtccagtgaccttcaaacctgctccagagagtagttcttccttacaagagtgagttttccaatgatttgcctctttctctccaaaatgaaaaacagtaacaaagtcttaattcagggctcttcagattttcattctccctcctttaaatttcactgaatgtgtatataggtctcactatgaagcaagcaatgcagcaggaagaagagtctcttttagttaaactcataatgccttacctagctgcacacaaagggggcatttcaacaattgcaggggacctaatatctattaatagttgcccattctgaagggtttcaggaaaaagttcacttagaattacagacaagtcctcaaacaagctagtcagtggtggaccagactgttgggggtgggggagggaggattgtttaaggttttgttttgcagaaagcttcatcaatcaatcctatctacatcaaataaagagagggtagctaatattgtctaccaagatattaataccttctattttaagcttcatatgctcctcggtgacctcatctcaaatctataagcaaacaaagaagtactgctttagaatatgcgaattattgcttctttcccaagatgcagtccttaaacagaggaatctgaaaacatgtagaaaattgctgacaggagcaggttaaacagaaaaagagggacactctccttctgctgaggtttcagcaccatctactgtccagaatattaatccttccccacattgcactgtgtgtgaatggcacttggtttttcttttgcatgtaatcacaatggaaggcattgtctttggaattcattgtccttgcctcaaggtgtacatttcctttcttttatagtttaagtaaatattcgcttactttttatcagtagatgcagcccgatgcccagcagatgcaatcacacattcctttaatcagcaaagatcttattatgccattcttacacattgactatgatgaaatttactgtatttcactgatactaatgggattttggggggactcttttgctcagtgagtcataagggagagttacttatgtgcagtcactgaaataaacagaaaacattctaattattatttgatgaaaatgtttctccgtgggtaaaagatatctgtggttcccatttatgattcttttttatcttccatcacagtcaaaggcacgccatagagtgattttaattataccttgactcgaagatacaatgtatttaatttgtcattgacagtagtcttttcctagtcctttcagattgtcatttcttttgaatcgtaaagaaagcttcaaaaagaaaatgtgagagggcaaatttaacatataccccccttccctcttctgttattacttgctattttgcttgaggaagtattcttattcatagtgggaagcttaggcacctgcagaaaattctttgcatttagaaagacttcccagatgagaaaccctgctactgaagcatggcacaaatccagaccccggaggtttgctttccctggtcatgggtaaaaataaaaacaaacaagttgacggtgaatgactttaagacagattatatcttgcttattaaaaacaaagaaacaaaaacctccttattaatcgttgtgaccaagttagagacttgggaggcaaccaagagcattcgagcatcattagaaccgtcttcataattaaataggtgctttatgctacacattttgaccaggcagatctaataactttgattaccacctgactgattgtttcccaagtacctatacttggccaccctcaattggcttgtgcatagtagtttccatttgtggcagtcaagcttattaaacagctctgctttgcgattttcccccagtccttgaaaatagatcagtaagcattccactcaggggcgatttgtaaattgctttacacaaggctccagtttgtgctcacgccgactggggtcaaaatttgccttgtgttttcttctgatgtcatttgtcaagttgcacacgttgttccgagaaccaggtcacaatactatgtggctgtgcctctcggtatgaatcgatgaaaaaccttgacttgtgaacgtgccctatgctacttctgtgttttcttctgccacctaaaagggcagacttccttgtcttcagccaaaatacacttattgttctttttccaattggttcctcttcccttcttcttaaagcaaagtcacattttaattatgttaacaaaaagagaggtaagataaataggggtgctattgagagaactagcctatgttttaaaactgtaaaaattctcaattcacagacataattcctcaatggaaaacaaatcttagagaaaagtaaatgtgtctaaaagagatcaaatgtgtaaaggattttccaaagagcaaaattataagcaaagtagacacttaggaacaaactacatatatagatgtctgatattatgtgagtgatgataacctgaacagattttatttcatcaggatatttcggcagttaaagcttacccctaaaatcaggacttggagctgagctcccttccaggaacctggggcagacaaaaaaaattctacccagatttgagacctttaaaggacatttacctgtggccagaatgggcagcaaggccaccccccaaaaagagtcagacctgtacagtattgggtgcaatgtcctttattttgctatgccgtgaagtgcaaactgcacatttttcacataacctgatacaggcctttacagccacacaacagggagaagtgggtgctcacgaggaagaaaaaacttcgcttataagatgaactcccaaaccaaaattacaaagaccttgaggaagtctgccaccataagagacaatcagcaaatagaacaaatggcaccttcaaaagtagcaataacggaaccacctgaaaaggacttttagctaagtatatgtagatttctcaaggataacctcaccaaccccatccatcatttcctacttccctccttaccttcctaacagaatggatttgtttctgaaaagtaactcaggaggaacagaacaaactggaaactgtggtgtttccatttgtttgttttgatagctccttcaaaatgtagatcctaatgacccagcggagaatagtaattataaaattaatgtttctcccatttaaggatgaattattctctaaaaactaaatataattttaagtaatgtcttgctcctgacaataggtattttatgaaagtattaattcaggttttctccctggtgtgaaatgcagaaactcaatgtttaaattttagggaactgatacattttctttattcattcttctttttataagtagcataaaactttaatttttaaatggcatatgctctagaattagtattcgccatcttttttattttattgttctgtggagtattcattttaaatatttacattttaagtactaaagcaatctgagcaaccctccctttcctgtctggcacagaagagtaatcacagtgagtgaggatgcagaatggtgaggtaggttggagagctctatggagacatggctgtgggtgggtatagaggtggtgggcagaggagacagctggcaatgttggcagattggttatactgaacaaaatgtaagttgattaagcaaattaggaaatgttttcaggataagatacagaaatacttatagatgtgtaggtattatacatgtatacacacatagatatttcccagctctgttgctgagaaggcctaggatcaatgaccctcagtaacaatgagcacattgggtctccacctcttagttctcaaagccatcctccactaaaaagaaccagagctccctgacaaaatgactgattctgggactattgcaggaaaaaaagtataatgtgaaccttactggaccagaaagtaaagaaacacttaatgaataatagtaaaatgtaaaacatacgaagagcccaacttaaaaggactcccagtggccaaaatggggacaatttgagcatcagtgtaaataatgatagtaatgtattaccacctgtcaaaagaagccatgaatttatcctaatgtaagtaagtatataaataaatgggggagaggggaacactcttccttagagtagaatgtcagctgatatatgtagaaggaaagatagcaatggagaatcaccgtttgacaaccatcataaaagccactaattcaggaaggagtctttaatggattctaaggctggtgggtacaagtttgatgaccatcaggtactggtgtaatctttgaatacctccccacaaagtactcattatttatttatttattttagtttattattctttttcagacagagtctcactctgttgcccaggctggagtgcattggtgcgacactgcaacctccacctcctgagttcaagcacttctcttgcctcagcctcccgagtagctgggactacaggtgtaccacactcaactagtttttgtattttttttagtaaaggcaggatttgaccatgttggccaggctggtctggaactcctggcctcaagtgatctgcctgcctcagcctcccaaagtgctaggattacaggcatgagccatggtagccagccaaaatactcataagttacaagggtgtaaatggtaagaataagatggagaagccaggcaaacaccaccatatatatatatgtgtatatatgtatatgtgtgtgtctgtgtgtgtgtgtaggtgtatttgtgtgtatatggtagggagaaggggtgtgtgtgtgtgtacacaaatatatatatatatatatatatatatatatatacacatgcatatatatatacatatatatatttacacacatatattgtatatgggggagaagaaaataagcaaatacagtaaaatattagctactgaggagtgtatatgaaggtgaaagagttctttgtacttttctggcaaactttctgtaagtttgaaattatttcaaaataaattactttttaaaatcaagaaaaaagtacaaaatgtggccttataagaaaattcagcaataaacacagatgaagggccagtgcttgcatggtgagtgctgagttagccttcaggcagttcctttttaaaattccatattcgacataagtctggataaataataagaaatacttaatatagcttcctgatttatagtacttcaagattcaaggccttattttcatcagtctcccacagggccactcacagattgtccataagttatctttaaccaactctcatgagtaggaacagaactaggcaccagggacttataaaagtgtaagatctagtccgtgactcccagaaagctgatcagttacagggggagaagcagggcacgtgtaaaaaagacaaatgattttgcacaacaatgcactagcttaatgtcgaagaaagaaaaacagttaattccgatgagcttcatgaaaggataggatcaccagcgaacagggtggccaggaagggcatgtggggaggtggctcggattcataggctcttcaagacagtaggctttttccagcctggctggccactagcagaacttggcatcccctctctgagggcgcccacctccacctgaatacctccagaaatggagattcatgttcttctgtggcagcctatttccctgttggaaaggtcaaattagtagaaagttcttccttctacagagccagaatatgcctgtttgtagttactctttgctttctactttggggcaatgcaaaataaccttagcttatcttctgcctataagcccttcacatatttgaggactgttgtcatgtctctcctaatttacctttctcgtgccaaacactttcagttattttagctgctatggaattattagatctttcactaacccaggtatactaatgtattaatgaatccaaaacacgttcctagtaagctgtagtctgactaatgcaaaatacaaccagattattacctccctaaattggaacatcatgtgttatttatgcaacctaagatttcattccctttctttggcagctgcacagactccatgagcactgaaatgcttaggtattatccatgtgagctgccaatcccccagcatgtacttagtagctgattttttaagtgtagttttttgcctttatccctattaaagtttgcctaggtgaaaaggttggtcccacttgaaatcactatgaattttgattctcatctaatgtttagggtatgccttttagatgtgtgttttatgcagaattgatacagtttatcttgcactgatttttattgaaaaaatggtgccaactatagaatgttgaaattcatccgtagagatgctacctcaggattattgtcatcattaatcaacactctttgctgtggcatttaaatatgattaaaaataattctctgaccagtccccttatgtcatctgaggtttgcttgctgtctgctctttgaccagctccaggcctttgaagaatcccacttttaaattgtccctataaaaactaatttaaggaaaaaagatacaactctactgaaaggcatcatcaaaaccattagagtcaagaaatttgttaacaaaagggatgtgtctccttccacaaatgaagatggctgaaacacacattaaatactatcctgataggcaccaagtgaatatcttggcactgtaaatgaaagataaattatacactaaaatggaaggattggtagggtatcaggaaagcaacattgaaatggaattcgtatcctgtggacccaaaagcacttatttttgcagataataagaactatcagccaggtatggcggctcacgcctgtaatcccagcactttgggaggccaaggcgggaggatctcttgaggccaggagtctgagactgacctgagcagtatagcaagaccctgtgtctataaaacaaagaaataaataaaacattagccaggcaccagtggctcatgcctgtaatcctagcactttgggaggctgaggcaggcagattgcctgaactcaggagctcgagaccagccggagcaacatggcaaaaaccctgcctctaccaagaattcaaaaaaaaaaaaaaaaaaaagaattagttgggcatggtggtgtgcacctttggtctcagctactcaggaggttgaagtgggaggatcgtttgaacctgagatagggaggttgcagtgagccaagattgtgcctctgcactccaacctcagggacagaatgagaccccatctcaaaaataaaataaaaataaaatactagctggacatggtgttgcatgcctctagtcctaccttgatgggaggattgcttgagcgcaagaatttgaagttatggtgagctttgatcatgctgctgcactccagcttgggcaacagaacaagaccctgtcaaaaaatacaaaatataaaacagcgtagtgttttaaaaaatagaatccttatccaatggaccccaaaacacttcattttagagacaataaaagctataaatcagaaagtctttccaccagcagtgaaagtgagaatgtaataaggcttggataagtgttgtatttatacatctaattgtggatctgattattaattgagtagttaatattattaaaaataatggttaataattaactcttcctcatggttataatccttagaacaaagcagttagtttgccttttgtcatttatacgttatagaaaacactgtagaaagtaaaagaattttttttttaactctaggagaattaagcacttggtaaatatatagatttttaagcatcagtcctctggagttcagaatttatcattctacacagtatgaaccaaccacaagtaggaaagtttagggatgttgttggtcctatttattgttgctatttaattacatccaaatccagccgtcagttcacatcttcagttctaattgcctttgagagttctatgcacggaacaatagctgaagtgactcttcagaacagaagtcataaatataggttcttcctgatctcgatgaattaaaaccaaaggagaggagacagtttgttttgcaggaagccatctgtttgtttgtatacagggtttgtattcaaattttaggaaattaatcaagtaaaaaacatcaaaattcacaacacagaaaacaagagtactgaacaaacatacactttgagaaaaccaagtcgctaatgagattttgaacctctttagtttaatcttttcttgtccctaggagacctctctggtatgtgtacagtgcatgacgttgcattgattcttgctgctttaaggctcagaacatgaatcggcgacaagtgctgagttaatgaatcagcagctgtcagcacaacaactgcaccaacataatccttgactcagggaacttctctggtccttgcttaaaagacagctaagtttaccaataataaaaatctgtcccagatccctacatgtgcataaagaggtgaacgtttctttaggaaagaaatgtcattcagaaacgtgagccagaatttcaaatggctctaggctttggggtatgtgccaactccttgctgctagcccaaaagttgtcaggagataggaagacaagacagttttagggactggagcctgggcatttgactccacactcataagtctgatgtgtaggcttagagctagagccaccattttaggcataaaatcatcactgcttgttacctgtctaaggcagtaactacctgacacgtgcagtgaagccctctgcaaccatctgcaccccatggcagaaattctctgaattcctcctgcgtttgaatatcttcagttgactacacataggagtgtaaattgctgtattatgcccttagacttattcctgcatgatttgcatgtggacatcgtgttttcagtgaaaagaaaggcagaatcgcacaacagacaatatcttaatgactcttagacatcagtctgctcatttgttaaatagggatgataatagtacctatttgttaggaataaatgaaataatccatgtaaagtgcttaacagtgctaagggactcagttattatgaatgttcttattccttcagcctctgttatatgtgttatccatgtaaacacaatccatgcttggcggataaatcaagaaataaatgaattaaaatgaaaatctaaattgcagaatcagtgggcagctgtttaaagtagaactaggcaacatctttatcaaataaaacccatagaggtatatcattttagcctgggatctgtttcagtcttcattttttcttgaggaaaatgtaaatttaaaaacgtcaaatgacatgttaagtcaaaatggggctattccttgatgtttgcttagagtaagatttgtacttacctcttttcctcattaaaaaaaaaaaaaaaaaaaaaaaacaacttcatcactatctattcctgatggtaagtgaatcaatatagcggatttttattatgtagtcctcaaaagcctcggtctttcaaatcaggggttttctatcccattacctctttgctggcagtacctgttgttcacttctcatttcatggacatcactcatttaacagtgactaaaagcacattaatctacttatcatgatcttttcctatttttagaaaacaacaaaagtatatcccactactagattataacctatttagaacagagatttcccttttgtaactgagagattttctttctgtagttggataaaaggatagaaaaaatgttttaaatactctctttaaagaggaaattttagcatgggttatcagcaagtaagactcacaaaaattctcctgtcagatataattacaaaattcccagcggatattttaatcccagaggttccctgaataaatatttatgtacctcacagcctgaaatgcaatcccgcgactatgggagaggattagtcagtgttcttttattatttggtttggttttggtttgtcttctttgtaattgtttgattggctcggtttggtttagtatgtagaaatttctggaatatggcctaattcagaattttattctttaggcatgtatgcggcctttacattgaattcaaactgcttctcactagtgtactctctgacaccatttatgaaatcatgttgcagaaaaataaggcactatgggtgtgaatgtagttttggagttcataaactgtctcagctaagcaagcccattctattcccagtttaaactataatgtaaagggtgaattttaaagcgaattgatggtccttatttttaaaaagtaatatacctgtatcattttgtcagtgatgttcattacagcattatttattatttctaattataaatattagaaaaatgtctaataaaatttgctaaaatgccaactagtttcaaaatggttaaaactgtaagcttaaagcagattataaaattatgttgacaaaggaataaacatgcctatacaatattgaggagaaaaaggaaaatcgtatttgtctcatttttataatggtgtaaaacaaaacaactgaaaaactgtgaaccaaaaagactgggggaaattataccaccatgaaaatagatgttttatctgggtaggatttgtttttctattccttcttttaattttcctgaatttcctaaattacctgtgctaaaacatttattacttttacaatagaaaaaaagagcctaacaaacttcaaatcaacatggatttttcctgtttgcactcagctgaaatgtagctttctagtgaaactggagagagacgaaaaccttttcaaagaggcaattcagagcaggctgccagaaagtaagcccttccacgagcatctttagagatctcacctccatgctccctggctgagttctgttgctctgagaaggttcacataatgagtgttttcatcttttcatattaaaaatgacctcctggcctgagtctgagcttcccagatgactgaggtttgctggtcacagcctcagaaaaaataaagcaaaattacttagtatttcatcctgctcttggagtctacattgtatttccacacaagctcacagactttgttgttgttattgtttgttttgttttaactctccagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggaggggtaagtattaatagcaaaaactgactcaaactaacttgtttagaccaacttaacaatatatttaaagttactattttagaattttgttcaagtaatcttatggcaagaaactcttggttaattcctgctcctttttgcacaataaatgtggcatcactcattgaacaactctatatggcaggactgctccctaactggcaccaatcctacaggttaattattcattcctgtgtatggattagaaactaaggctcacaggcattggatgacttgccttggcctcatagctactgaattgtggaactcagcttaaaacttcaaatcccaaactctgtgtcacatatcatatcatatatcctagaatctgaccaagaaaatagcttaaggatagtttccttctgtttttaggctgctaattaaactccctttgaccttgtagaaggcacgtcattgtgaatttagggttttctttcttgaatttgaaagtctgatggggttatttactatctccaggtaatttgaattcaaaatgattggattttcaaaatgccttcctttccataacggtatattatcattgaacacataacaagaagaggttaaatctgggaacaattcctatcaatcacaatcattgtcaaaaaatttttttctgctctaacgcacctctgtgatcccattgacaataaagatggactccggctgccatttttatgatggagtccagccaaaacatagcggaatacaaaaatggggccctgacttgaaaagctctccccacttcctaggctgctataaaaatctgtccaccccctttacgttgagaataagtggcctaaagtcatccatgtgatatagtgagagcatattttccacccaactacagtactagccctgttcatcacagtcttactacctttatcaaacagggtttttgcagttgagtcacagaatgcccaaaacaatttcaatgactgttgtctcagttctatgccaagagtggtatctgattggtacaactttagatggcacaggaaagaagttaattcgttacatcagtggatgcctgggttcactagggattatctcttgggaccctgactgagaaaggctggatgaaattgccagcgtaaaccattctggacctctttcacatggttcagcttaataactttggctaagtgaaagaaatattaactacttcacaaagacattggagatattgaatatcctgaggtctaggaaagtacatagcccaatgtctaccacaaaagaagtacttgataaactttaatggtggtattaattgaaggaagggtaacattgattgtaataacaggaaagtgtaaatcgagaacattcttcataaattaagcagaatgttctcacattaaaaccaatttcttgggcaggagagatattaaaaatgctaaatctcagaatggcgcaagcaccaaccaatgaaaacagatgcccgaccaatcgaagtggacgtcctaccattcagacacatgtagcctttatgccagaatggtgccagggctaaggcagaaacagggacacctaatgaagtcaaacactgatgactaccttttgtaaagacagctgtccgtagagctgctcacattcatctttcatatggaaaatgtctatctcccctgttaaactagtgctaacaccaatcaacttctgctgagaaatacatagaaaattaaggacagcacaaccacatgtgagatctaagtgtactagccactaggatcattaatgtctgtggagtcaggacttgacaatagaagagataagcaagcgcaattttgaagtcaagcctatttcagcttcgacttcctgggtcagcatggtggaaatgatgcttggtatagagttaacctattgaggttttataaaagttattatttcattgtcctctgatacaccccatccccaccgagtattctgtcaggaacacaacagactgcggtggtggaaaataagcagatgctgttgttttctttggtaggaacataaaaaatgtagatcttagttaatagttgggtctgggtgacttcaaagggaaagagaaagttattgtggtctgctttgatgagactcttacctcactcctcactctatttttttctttgtttcagttttactttaaaaacacaaatccagtcaaaatgtgtaaataactacagtacttctgaatcgcaaaatcaaaattttctattaataggttgctgtgctctgaaatatccaggctgcaagtttctttgacatttaagcccttcatgaataaagtgaattagatagatggtataggcatttccctaaggccaatgtggcttcccaccttccctgcacgcatcccctggggcatattttttatttaaacctgtattcgaagtccccatatgtgaaatttcttaggtaaagtatcaataatcttaataatgatgatgataatagtgataattcctgatacttgcaaagtgcctaatcatttatcgggtactttcttatatacacttgacccttgaacaacacaggtttgagctgtatgggtctacttatatgtggattttttttctaccacactcagattgcaaatacaatattcgtgggatgtgaaataacccacatatatggaagactgacttgtcatatactcgggttccagagggctgactgcaggacttgagtatgtgtggattttagtgtactacggtcctgagtcctgagtccaatcccctgtgtctaccaaaggatgactgtaatagctccttaatcctcacagaaatcttgtcaaataggttaacaattattttcccattttattgagcaattataagacttgatccgtaaacagtggcatctggatgagaagccaagtgttacaaacaaaagacgttttgggttaaaataccatagcttttcctgaattagatttaacatcttggacatgtctgtttcacaaaaaaatggatcatggctgtcagtaataccagtttagagttaatctacgcttcaaggtttcagaagattttcacataacacagataatctcatttgattttcacaacctagcatgaaggtcaataaaggtcttttgaaagtcagtaaatcaaggccaagagagattaagagatttagatgaaatcacacagcaggaatcagcccaagacaactaagcaccaaaactgtagctcttccttcactccatgctttggcatctcttctaatcgtatttctaattggcaattctatctcttccattatcctgtgaatgtgacactctgtactgaaacgatggagataaccaaatacatattaattttgaaatagaatgaggatatggtctttccggatgctagtctagtgttactgttaagaacagggactatatgggttcaaatcctggctctgccattttctagctacgtgactttaggcaagactcctaacctctttgtgctggaatttcctcatctgtaaaataaggataacaagaatacctgcctcagaggacatgtgagtatttagtgagtttaatataggtaaagtacttggaagctgcctgtcatatagtaaataccattaaacatcatccattactattgtcattggagaaatagcaacacaagagtctgtgtcaatttcctgttgtatagtttggaatgggaaaatgaaggagggccaatataccctaaattatcttgtcatccattacgggtttagaatgaagtgtactttttcaaatctggcctctagggtggtctcttcatcaagcagctattctccaaactttggattaacagggctatgaaccaaactccaaggtgtagcagtgttcttcaggtaaagtgctgcctttgtgatagcctgtggaatcatctcctcacatttattaaaagtactgtgctggcgaatgctggagaaatatttctggggcgcatagacatccaaaccaggatgtaattagtcccattcttctgctaatcaaacatgcatttggcatttggaaaccaaatgagcactgttccacactaggtgatgcgagatttccttggagaatctggtcttcctaatcctttcattccaacctgggagcaataacaatgctggctctaagaaagggttgagcaataaaatgcagatacttccaaatgtgggcttgcttccgttttccaaatacagagttctaaagtatccgaacgccaaccaaggccataggctgagggcatttctgaagaaactcacaaaactagatcgagagccaccgtagtacgtaggacttatgtagcatgtaacttacgtccttccgacatgggtgccaaactgctccagagactcagagaagccagacacctgaggtcttgtcgaagatgtgttctgaaaacgtcggtgttcccatctctcaggcaggctcacatatttttaacaggccatggtttgcatcactaatgctttcatcagccagtgtaaaataaatccattagtcaccgtgtccttcatgtgataatgatatttagagctcattaaaaagtaattgcagccactttcccctactttatcagcaggattcagctggtgatttgatgatccgaaacatccaactgaagcatgctgggaaatatgtctgcatggtccaaacaagtgtggacaggctatctgctgctgcagacctgattgtaagaggtactggattttgttgttattgttgttcttgaaatattttcatgatatctactgtagcgcagagttccagaaacctcagtggtttagaattatgggaaaaagtcaggcagaagctgaacattgtaaacagtggctaacagtccacagaagtttctggttcatatacagttcctcagtgcggcttgtcagaaaatgcaccgaacacatccagtaactttacactagaaggataattgagtaaatcgagtacccgattacggctgttggagttgatatgaccttctagaacaaatttaggtgaacaaaagcagatagtttaaagagggattaaactgtccctttttatgtttcatctgggccaaactgaattagtatcctaggccactggtataacagcagcttaagtaaagtcatcatcaggtttatccgagtttccttttttccctaaacttcacagtgctgttcggttcctaaaatagggttttgggagaggacacttcctgactgcctgggatgtagtaaatgagctgagagttgatgtaaatactaacatttttgagattctcttgaatattatcagcatgacctaatttggacctaagagctatgacccccccggctgagcaacaccaactgagtacattccaagcctcaccaaaccggttggcaaaggaactgtaaatggacttttaagaaatatttttaaatgaaaattaaaatcttcactaaccagtgtacataccagaatccaacctatgcatgctcaggggttttctatagcattaaaatagaggccaatccagacatcaaaataatatcttagctagaatctccttcatcagaatccctgactgttggtgttcaggcatctttggccggctggcagagcgcatggcaaaacttcgaacgcaagaaaataaaaatttagggtatgagcgttggaggcagggttaatctgcatgcacagagaacaaggtattattggaagccataaagagtgttgctgtatcctctaggcataatgtaaggggggaaatgtgtgggagttaccaacttaaactgattgtgaagagagggttcaagagaaatagcaattccaatgtgtctgctttgttcccctttcaattgcctttaaaaaaactttcagcaacagtgcagacaagggctggaaatgagaaaaaactttcaaccgaggtagatctgcccacagaataacttatagaaatgtgtttatttccatttgaaaatacaccaggctggtctgccctccccttgggaacaaaagaattctgttgctgaaaatttatcctctatttaattaggataatgttcagatcagcagttaaaacaccaataaattagactaataaatatttaaatcagcaatacttgaagttcttaaatgatattgtatacttcatttcacagaaaataacattaaataccaggaggaatttgcaaacgcagtctaaaagaaaatctagtctaatcagttaataaggccaataaattaatgtgccatttaaaaccataatctttcattttatctccttctgctctgcccttgcagcttttcttgcacattacagagggggaggcaggaatgtatttcaccaccctgaaagacattttcatatttgaaacgtatagcagctttgagtcttggctccagattctttgattttctgaggcctgttctatttaacctatagcactgtaatggcagccagaaaggccacccttcctgagggagaagcagaccccagaatcaaactaatcttccctttgccattgcctgaaacaaaatcttctacatgcccctgagtgtgttatcattttgttcagaggacaaacatttgtacatttttcattttgaaagagggagtccacttccctaaaacaaagttggtaaacattctgtaaggtcgtagctatgcatcggtaggagagggtggcaggaagataaaaaaaagaacaaacaaatccaggaaactaccatcttctctccagtgtccaaactcataccagcccttcattttcttcctatagagaggccaacaatggactcagatatttcctatcgatttaattctttgaagagttcagagggaaacacttttctatttgtggtacttagattttaaaggacatcagtgcagcatccattaaaaaaaatggtggggaatgctaggatgagaaaactagtgaaaaaaattatattgtcttctagactttatctggttaaaaggggtcccaagaccaaaggttacatcagctctatctaggtgacattagactgacatgctgaaatgtcaccatggaaaattaatcagttccagcatacagatttccagacatttcattcaggagtgggagggagaagataaatttagtctcacctgtgggtctataaaagtgatttttaaaaaaggaaagggaatttagggcatcacgtaaacggtgaaggagtgaatcctagaacaaaggctaacttcaggaaattgctgttaattttgcactgctctgtgagaggtttcttttttccctgtccctgtgacatggcctgatagtatttgggtagtacatttgattgctagactggggattagcaaatccttcctaggaacatctccttatgcccgtctaatgggcatgaggtttgtcattatgtcccctcaccatcaccttccctcctgaggtggtcaattgtaccttgttaaaaatgcatttaactgcctggtaagagattttcatgttggaaagtgggatagctgcgggtctttgctctggctctgttgatattttgtctttacctgccagctgctttccatccctctatttctttattagtttcaagccttcatttaaatctgatttcctcccctttccatggtttaagtacatggacagaaacaacgaacatcaggaagagaagtagaaaaatacgggtatgagttgcagaaactacagatgagggtctttagtatctagcctaattttgaaattgctttgaagaagggagcgccttgactcttgcgcaccggccattttcacagcagttcccttgcacgcaagtgtgtgctcacgtgggaagcagggttggatgtgaagagagtgctagtaattacagtgcagcagaatgtgcagagcaacactgtaaccttcaaagttttaaagccatttgtgcttaaatctatattctcagtggtagaaataaccatttccagcagactatactctttatgaaatcaggagcaatatctatcttttctcactaccgtatcctcaaataacactgtctgacccatattaggaacctataaataaataatgaattaatgaatgtgggctcttatggtaccccaatactctctattaacattaagtattcagttgtaattatttgtttacctattagtttttcatattaaactgtgggcccctagaaggaaggggctgtgtttcattcacctctgtggtttccaagcccaggaaagttccaagcacgtagtaggagttcaaaaaggatttgacaagtgatgaatctgtgaatgggtagataaatgaatgggtcaatgccccattcaagtatgtggctcctttacttgggtgtttgaatacactgctccaattctgggggtcttgctctttcccaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacaggtaccatattggatgcttggctcagagacattgggaactcagcatactggacacagcactgtggcaaggaacgtctaagttctcattcagacactactacaaatgatatattatggcagtgtttcctaaacctcggccaactgtactatcattaatatttttctttatatcaaatcacagttgggtttttttaaactcatcctaagcaatagtatctgtgaaatggtaatgtccaggccagatttggtggctcacgcctgcaatcccagcactgtgggaggtagagttggatggatcgcgtgagcccaggagttccagaccagcctgggcaacatggcaaaaccccctctctacaaaatatacaaaaattagcctggcatggtggtgcgtgcctgcagtcctagcaactcaggaggctgaggtgggaggattgcttgagcccaggaggtagaggttgcagtgagccaagatcacaccactgaactccagcctgggtgacagtgagactccgtctcaaaaaaaaaaaaaaaaaaagtctgttgtgctggttgtatatgtattttccgtaacacacattaaaaatatattagttataaaaataaaatgcatcaatctgtattacctaaaatcatctgtgtagcactgtggttcactttggaaagcagcggattctgcctgactatagtcacttaatagtcacagacttcataaagtttacacagtgctctcaaaaaccaataacagaggattatagggagcctcttcacttgctgctgtgttttttgagacagggtctcactctgtcacccaggctggagtgcagtggtacaatcacagcacactgcagcctcgacctcctgggctcaagcaatcttcccacctcagcctgttgagtagctgagaccacaggcgcaggcccccacacccagctaattctctaaaattttttgtagagacaggtcttgctatgttgcttaggctggtctcaaactcctgcgctcaagcaattctccatcagcctcccaaattgctgggatttcaggcgtgagccactgtgtccagccccatttttttagatggataaatttggggataaaaagacatgagatttctttttaaccaattttacaaattcttaaaaaaaaaaaaaacattgttagcagcaacacttccatcctgtttccctttattacatgtatacagcacttcctattttttaaaagtttcacagttatttctctttgcatgtaaaagaattcttataccaaccccactctgtcagtacctccaaattgactcattttcttatttagatttcatttaaggataaattggatgaacaagtagttattacaaacaaagatacacactcctctagacagcaaaagtaggctatatggccttgatgttttgaaggagaatatgcccagtgttgagcaattcatataaatcttgttgattttaacccatttgtttttttcactttagtttactaatccttagaaatgggtttctgtgtttccttctgtaatcactgagtcacaggtgtgctttaagaaggaaatatgagaaaaatatagaagttaggagatgaattctagacctgactgctaatcagctgatctctatacatcttcattttcctcttctgttaaatgggcacaataagaattgtttaagaatgaatataggccaggcgcagtggctcacaactgtcatcccagcactttgataggccaaggcgggtggatcgcttgagcccaggagtttgagagcagtctgggaaatgaggcgaaatcccgtctctactaaaaatacaaaaaaaaaatagacaggcatagtggcatgcacctgtagtccctgctactcaggaggctgaggcacaagaattgcatgagtctgggaggtggaggttgcagtgagccgagattgtgccactgcactctaccctgggcatcagagagagagagagagagaccctgtctcaaaaaaagaaaaaaaaaaagaaaagaaaaaaagaatataatacttttacctttctcagaggatagttgaaatagtgtgtctggcactatacaataaatgcggaaacacatgtgaaggggtgatagtaatgattgagtcaggtagtttggggtcttgtggactgtgtgtcttttatgatgtcatctgctggtatctgattagagtgtgttagtttaacatacagagatagttctgagattacctcactgaaacaactgttgatgcagctaatatcagaacacctacactgccctgaatacaataatgatgaggatggatggatgttcctatcttcctaacgtaatctctgcatttgttttctgagaacctatgaaacagcccccaccttttgttgtctttcagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctcgtgagtagcacccgagattcagatcatctgttctgccagctgctgttccttaggaaaagcgtttgaattcttgctgctcttcagcgctcatgcggctctgtgttagctcacccttccctttaaatgtttataatgatagaaatcaggccaggagaagcccagctgaacacgcaacgggtttcaatcaagagttgttttcttcattaggtccacttgtacagcaagagacacacggtgcttagtcctctcaaaagccagccctttcttcattggttcatttgtcaccaagattctaacagaatttcaaaaaaaaatcccacatttcaaataaaattatctcacataagtaactaatggcaaagaataatttgtgactgctctggacacagccaccatggggtaatcctgtttagaatagaaataaaaaataatttcttcagaaatgttcacttagattatctttcttagggtataaaccattcccagaaacgaagattcagaacatcgtgctcattcgaacaagaccagtcagcaattcagtatggccctctgcatatgcagcttgaatgagcacggggagagaagaacaagttcatcagggtcagccgtacttttacttagctggtgtaaagcaagaggcctacatgtgccgtcttttatagagttcccgcctgtagagaggccagtgtgttgaaggaataataaggtccctacacaaataggagttctgaccctactctcagaaaagcaaaaactcatctagatctatttgattggctttaaccaaggagacatacccagtcaccagccacataccccagtgagacctttttaaatgtggcccggagcctttcagttacgtgatgacaatatagctagtcccctgctttcttttccccttccaaaaccataattgaattaattcccctcagcaatcctgaggtggaagctcgcataatttcctctcttttatagagaaaactggtgatcaaagaggttaagctcagtgagccgggggtcaacttctgtctgccacttccttcaacactcagatcaaaactcttcctcccagaagccattcgcccaccccagctctgagcagggcgctactccggaacgccccccgcttctccatgctgactgttccttaccctggttgtcgaccttgctctaactggtgcaggcgctcctccactccaaccagcttgtaagctctgcctgggcagagcttgtactcttccctttgtgtatctccacgtggctcataaacgcataaccaaacattaggaccagacttcagtcctttcctcccttcgggaacccctcggcctctagggatggagctgaacaattggtcagacgtgtcagataacacgtgtgccttgttgaatgggaaacaggtaattaatagcagtctccttggtacatttcacttcctcgagcggtcgccgtgggccccttgacaatgctgttgctgatctccagagacaaaggggcgtgcctcagagtactcactgaaagtgagtcacctctgccaggcaaccttcctggccctcattcgcctttgccgcctgacataacttgttttttgtctccttgtgcagtccccgaagtcacaccagcgaatgtcagtggtggcggaggcagcaaatctgaactggttataacctgggaggtaaatgaatcacagaataaaaggaacgtacacgcatcgaagctattttattattttcctccatgttagacatagctgggaagtttcctcctctgtttttaacagtgaaaattcatttgggttcagacactccctctcacgtagctaatggctagcaggaaggacggcacttgcccatccattgttgaggcaagttttaattcaatccatcacagtaaaaacaattatgaagggaagacaacacacgttacaaaaaaaaataaagaaggctgtttcagagaaaactagtttttcttttcttcctgaattgctgcatggccaattgatttaaaacgtctgccagcaatagattcagtgcaccagcacaatttcctggcaattggctttgcttctagaaggggccctcttttaggaggtattttttaaaacaacctggaggaaagttagtcaccaatttattaaaaattggctttgagagaagaggtgggagctttagaaagggttcttcatgtttttgaaagattctaaacagccccagaaattaaaatctctcatttacccaaagcacagcagtgaaagaaatcactcatccctccagctgaactcttccctctgagagggaggatcttcagccaagatggtttttcttccttcagtgagatcttttgtctatttggcaatggaagaagattagtattagaggatacgtgttggaaatgtggtttttcaggagaccgatgtccagtgtttttttttttacaatcatttccaaccatttcagagctgggtctgccccatcaaagagcaagctctggactgcagatcctcattacgttttcaaccctgtccagtacatcataactgtttaagatagactgactgcaagccctaaatttaaaagactgttaacaaaacgccaaataagatgggtggagaaggatgtagacaagaatgttacaagggaaacaaaaacgatttttgcatttgagtgaaactactgtgatttctgaagaccaccttccttctttcccagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaaggtatcgtttatgctgcctagatcattgactgttaatatttcttcaattctaaaatgtggattgtagcacgtacaatcaatttcgcatggtacatgtatcttgaaggcatacctgatttgagaagaggataatgtaaacaatttggttcgctgtccaccatgaatctcttgaaaagatagcgactgctctgtatatgaaaacacttggctgtccattattgattccattgctaaggaccagaattgcaaataccatataagatcttcatatctatctatatgttatcattactttcaaaagaattttatttttgcctttaagtgaatatcaaaatataatttgcattttcttaccacttgtattttcataaagcatatggtacttgtggctcacacctgtaatcccaacacttttgggaggccaaggcgggtggatcacctgaggttgggagttcgggaccagcctgaccaatatggagaaaacccatctctactaaaaatataaaattagccagttgtagtggcacatccctgtaatcccagctactcaggaggctgagacaggagaatcacttgaacccaggaggcggaggttgcggtgagccgagatcgcaccactgcactccagcctgggcaacaagagcaaaactccatctcaaaaaaaaaaaaaaatctcacttattaaagaaaagagtaagtcatgaagcagtgtgattgcgctcactgtcatccacaccatcattatgtttaacatttctcacacattattatcacctccatgctatccctgctctcgggatgcctctcacacagtcttcgttacctttggagttcgtctatgttgttttaaagatgatgctcagaatgggaccatgttaaaacatctgaaaggtgaatcattgatttagagtcagtgaagatgcaataacttattcccaatcagagagatcatccccttagactcagtagccctccatgatctagctgctgcctctctgtctgcctcagctgctgatgcctttccctgcatatttcatgttccaaccattgccaaaggatttacaattattcaaacaagcttcagcccttttcatagccttcaacttctcttagataatagttcatgtctctggattatgaaaatgagaggaaaaggggaaaaggacagtcagctgacttgactaagattcaagagagctggatgacacttcaggttcacactgcaatctgtatgatcttggataactcaggtatactctgtgggcctcagcatctttggctgcaaaggagaggctagactgactgtttcccaaatttcagttatttttgccagatttctgccatagctgtgtaccatttgtatatgttcacatttttctttcaatagtcttccttaaaaaaaatttagtgggcaagcacagtggctcatgcctgtaatcccagcactttgggagggggatgtgggaggatagcatgagcctaggagtttgagaccaacctgggcaacatagcaagatccaagtctttacaaaaaaacattagccaggcgtgttggcacatgtgtgtgtggtcccagctacttgggaggctgaggcgggaggatggcttgagctcaggaggtcaggctgcagtgagccatgattgtgccactacattccagcctaggtgacagagtgagaccctatttcaaaaaagaaaaagagaagcagtttagccatgtcgtaagcaataacatttgtgagatgctaattaagaaggatctgtgttaagggaattgctggctatgaaaacttggtgcttaaacttaagtggttcttctcttctacccacacctaaattcagaacccaaacactggacaaatattcactaccaccaactccagctattaatcactgcccctctgcaaaatgagggtttggcttacaatcattaaggacgattctataaccatgaattattttaccttataatgctagtatctacaatcctgtcctaatatagctgatagagtaataactatctccatattcatctacagaacccaccaaaccaccagccagtatctttgccagaagtctttctgccacagatattgaagttttctgggcctccccactggagaagaatagaggacgaatacaaggttatgaggtaggcaagacatatgtgccttgggtctgaaagagagtctatgccccttgataagtcctccaagtcacattcttataggaagagacccacattcccactaagaggcattggttttaggcctggcttccagctgaacattaatggaagcattgaatactcagctgtgagactaccctttttctatgttatattctagaggtatttttcgaattatatgcaaatctaagcatttacgggatggttggcaaaatgagctttgacttctgatatgcccaggatcactttgactcaaaacaaacatgggaaaaaagaaaataatgaacgacggttgtgtcaatgtaccgtctcactaggaagctaaggacaaaaaagggacccttcttactttggataatttctcaggatatacagagtcctttgtcctgatagctctgctcatgatgtagtatagaaaactaactccatcataagaatctgcgtacaaaattacctgatgacattgcaaatatccccattgggtatggtttccaaggtctttctgtttatcttcttaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccacgtaagaacagacttgctcagaaatattttggggattcatcacacatatcccaagtttattccttatccccacctcccaatgatcatttgcatactaattagtagcatgtggattcaaatttccctcagcattttaactgaacctttccgtataccacgcaaaattcattgctgtggaggacagaaagataaatgtttttctcctcactgggaagggctacttcttttagctataaatgttaggcgaccaactgaatctttttccatttgcaatgctgtatctcatcagattttagtgaccttgaagacacatattagtgcaatagcccattaaattgcctccactctcgaattctagtaaggagatattcctcagaatccattgagacttaataatctgtgacttcgtatatcttaatttttttatagcaccaagtcaaccccccggaaacatcatatggaattcatcagactccaaaattatcctgaattgggatcaagtgaaggccctggataatgagtcggaagtaaaaggatacaaagtaggtaatttcttttttgcaaaggcacctaatcgtgctgtgagtgggggcagtctcctccatgaattatacagttgtctgcattgtcagtttccctggtgatgctctcctaccctctaggaatcgctgcctccaacacggtttgatctgagttgtataaatagtctatggcaattggtcaggatttagacaatcaccttaactttagtctcaggcagcatcaatcagaaatggataaagaccctgtgtttgggtctccaaaaataccctgaagaaccactttttaaacattcctactgtcagcttcgttttgctcctgtctcggtttatatatattttttagtcaacttagtagcctcctgatattaccaatgattaatcatttttgttcgtatgtttctatagtcaagagttatataaagaaaaagagaaaagagagaaaaagcaggaaaagtggagaaaatgtttgcctgaccccataaatgttggcttgtctttaatgagaaaatgaaaagaacatgtctgtagccttcttgcagcaatcaaaaagggttataaatatcttgcaacgtttccagctacctatttgctacctaacaaaccaacctgaagctaggggctaaaacagcaacagtgtatcattttttatgactttgcaatgtggatagggccagaatggacagattttagggctggaataactaagatgcttcttcacacacttttggcttcttggatgggataggtgggaaagctgaggctggccagtgatcatgctctctatgaggcctttccccacggataacctgggcttcctcacagtatggtgacctcagagtagtcggatttcttacatagttgtcagcttcaagaggaagaaagcagaagctgccagcccttttaaaagctaaggatggacgtgggcagttccaagatggccaaataggaacagctccagtctatagctcccagcgtgagcaacgcagtagactggtgatttctacatttccaactgaggtactgggttcatctcaatggggcttgtcggacagtgggcgcaggacagtgggggaagtgcaccgagcataagctgaagcagggcgaggcatcgcctcacctgggaagggcaaagggtcaaggaattccctttcctagccaagcaaagctgtgacagacagcacctggaagatcagggcactcccaccctaatactaatactgcgcttttccaatggtcttagcaaacggcacaccaggagattatatcccatgcatggctcagagggtcccatgcccggctcagagggtcccatgcccacagagccttgctcgttgctagcacagcagtctgagatcgaactgcaaggcagcagtgaggctgggggagggggcgcctgccattgctgaggcttgagtaggtaaatagcggcctggaagctcaaactgggtggagcccactgcagctcaaggaggcctgcctgcctccttgccctctgggggcagggcatagccaaacaaaaggcagcagaaacctctgcagacttaaatgtccctgtctgacagctttgaagagaatagtgtttcccccagcacggagtttgagatctgagaatggacagactccctcctcaagtggttccctgacccccgagtagcctaactgggaggtaccccccagtaggggcagactgacacctcacacagccaggtacccctctgagacaaaacttccagaggaacgatcaggcagcaacatttgctgttcagcaatatttgctgttttgcagcctccgctgctgaaacccaggcaaacagggtctggagtggacctccagcaaactccagcagacctgcagctgagggtcctgactgttagaaggaacactaacaaacagaaaggacatccacaccaaaaccccatctgtacgtcaccatcatcaaagaccaaaggtagataaaaccacagatatggggaaaaaatagagcagaaaaactgaaaattctaaaaatcagagcacctctcctcctccaaaggaacgcacctcctcaccagcaatggaaaaagctggatggagaatgactttgatgagttgagagaagaaggcttcagatgaccaaacttctccgagctaaaggaggaagttcgaacccatcccaaagaagttgaaaaccttgaaaaaaggttagacaaatggctaactagactaaccaatgtagagaagtccttaaatgacctgatggagctgaaaaccatggcacgagaactacatgacgaaggcacaagcttcagtagccaattcgatcagctggaagaaagggtacctgtgatggaagatcaaatgaatgaaatgaagcaagaagagaagtttagagaaaaaagaatgaaaagaaacgaacaaagcctccaagaaataagggactatgtgaaaagaccaaatctacgtctgattggtgtacctgaaagtgacggggagaatggaaccaagttggaaaacactctgcaggatattatccaggagaacttccccagcctagcaaggcaggccaacattcaaattcaggaaatacagagaatgccacaaagatagtcctcgagaagagcaactccaagacacataattgtcagattcaccaaagtcgaaatgaaggaaaaaatgttaagggcagccagagagaaaggtcaggttacccacaaagggaagcccatcagactaatagcggatctcttggcagaaactctacaagccagaagagagtgggggccaatattcaacattcttaaagaaaagaattttcaatccagaacttcatatccagccaaactaagcttcatcagtgaaggagaaataaaatcctttacagacaagcaaatgctgagagattttgtcaccaccaggcctgccctaaaagtgctcctgaaggaagcactaaacatggaaaggaacagccagtaccagcctctgcaaaaacatgccaaattgtaaagaccattgatgctaggaagaaactgcatcaactaccgagcaaaataaccagctaacatcataatgacaggatcaaattcacacataacaatattaaccttaaatgtaaatgggctaaatgctccaattaaaagacacagatggcaaattggatagagtcaagacccatcagtgtgctgtattcaggaaacctgtctcacgtgcagggacacacataggctcaaaataaagggatggaggaagatctaccaaggaaatggaaaacaaaaaaaaggcaggggttgcaatcctagtctctgataaaacagactttaaaccaacaaagatcaaaagagacaaagaaggccattacataatggtaaagggatcaattcaacaagaagagctaactatcctaaaaatatatgcacccaatacaggagcacccagattcataaagcaagtcctgagtgacctgcaaagagacttagactcccacacaataatgacgggagactttaacaccccactgtcaacatcagacagatcaacgagacagaaagttaacaaggatatccaggaattgaactcagctctgcaccaagcagacctaatagacatctacagaactctccaccccaaatcaacagaatatacattcttctcagcaccacatcgcacttattccataattgacctcataggtggaagtaaagcactcctcagcaaatgtaaaagaatagaaattacaacaaactgtctctcagaccacagtgcgatcaaactagaactcaggattaagaaactcactcaaaaccgctcaactacatggcaactgaacaacccgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggagatagagacacaaaaaaccattcaaaaaatcagtgaatccaggagctggttttttgaaaagatcaacaaaattgatagactgctagcaagactaataaagaagaaaagagagaagaatcaaatagatgcaataaaaaatgatcaaggggatatcaccacccttgagagtgggtaacagggttagaccagatggtaggaaaggacactttctgagttcttcttaatttccagctcagtcactcccccttctttttaggagtggtactggaagagccagacaccctacacctcctcaactacaccccaaggaaggtcactgtaactggctatacattttgaattgctacatatacatgtgaatgtttagagatacataatttaaagctacaggtatccacaggttccatactctcaaatgtggatcaaaaatattcaggaaaaaaaacacacaaaaaaatacaatgaaaatgacacagattttaaaaacaatacagtataacaactatttacataccatttacattatattaggtattatgagtaatctaaagttgatttaaagtatacggaaagatatgcttaggttatacacaaattctataccattgtatatccaggacttgagtatccacagattttggtattttagggaggtcctgaagccagttccctgaattaccaaggtaccaatgaataactctctctctttctctctctctctctgtgtgtgtgtgtgtgtgtgtgtgtgtgtatttgtgtgtgtgtatgtgtggtacctcccgtgatatctcacgtcccatgatagctcaggaaactctccctagtgtcacttttagggtgagattagaggctgaataaaaagcggatctgattgcaacggaagagttgacctttgctagagaatttgacccattaaatatggctattgtttatctcagactgaccctttccaaaattaagttttcctcccaaatactgaacatgttggggtgtgggtttattttcccttcttcactaagttgtctgaattctttagatctcagcttaggtagacagtctcaacaagaagctgactttagaaagtttaaggccccaaatattttgtcaacacaaatccttaagctactttatggcattagagctaaaaggagagcatctggttttagtatcacaaattaaactacctgcagggccaggcagataacataaatgagttctgttcagtccattcagaaactactactaatacgtctactaagcactgttccaattcatcttaactttatattttattttgttgtattttgagacagagtctccctctgtcacgcaaggtggagtgtagtggtacaatcttggctcactgcaacctccgcctccagggttcaagcagttctcctgcctcagcctcccaagtagctgagactacaggcgcccaccaccacgactggctgatttttgtatttttagtagagatggagtttcaccatgttggccaggctggtcttaaactcctgacctcaggtgatccgcctgcctcagcctcccaaagtgctgggattacaggcatgagccaccatgcctggcctcatcttaactgtataataaccatgaagataggtacagttattattgctagttttacggatgaagagctgtggcatagagtttagtcacttgcctttcacacagctggtatgttgaagacctgggatccgaatacagcagtatggatcctgagttctacatttagccacttggtgcttctgcctaccagccataaataaatagaataagtgataacaaagtactgcagagaaaaagaggctagagtgaggggaatagagaaagccatggagtggacaggagagatgtattattttatagaaaggccaaggaaagccacttttaagtggtgagatttcagttgggccttggcacctctctgggaatgtcccaagtactgcaaaaaaggaagtgcaaaggtccagaggtaggcatgtgacaatgtagcaacattggaagtgttgggactatcaccaactgcagagtttgtgattgttcagaatgagacttctcaactccaaccagttgttggcagacaggaatatagatcactggcttagtctattttattctggatcgcacttttgtagagtcttactcaggaacagaatacctgagactgggcaattaatatgaacagaagtttattgacacccagtgctgggagggagagggatagagagctgactcgcccttttacaacagtgctaattccatctgtgagggtgagcctaatcacctcatggcctaattatctcttcaaggttcacctgttaatacagttaaaatggcgaatttcaacatgagttttggagaggacaagcatccaaagcatagcaaccagtgtggccatatcttccagtttttcagtagaacccacaaatttttaatgtctaatttctcggtttttaaatgttcatgtctaactcaaaaaaaataacactatgacagccaaacaaataatatatgcaggctggttatgacccatgggccactagttttttgctgtctaactcccttggtttgtgttcccaaagacagatgccagagagggaaagcaatttgcccagagccctacaggtggtagccaaggtagtcttcgttaaaaatccaggttctgaggccgggcacggtggctcacacctgtaatcccagcactttgggaggccgaggtgggtggatcacctgaggtcaggagtttgagaccagcctgaccaacatggtgaaaccccgtctctgctaaaaatataaaatcagcagggcatggtggcgcatgcctgtaatgttagctacttgggaggctgaggcagaagaattgcttgaacccgggaggcggaggttgtagtgagctgaggtcacaccatcgcactctagcctgggcaataagagtgaaactccgtctcaaaaaaaaaaaaaaaaaaaatccaggctctggagccagactgcctaggtttgaatgcaggatccgccacttaccagtcatgagaccgggcaattgcttcacatctccacatctcaagttctcatctttgaaatcagaataataacattgccttccttaagaggttatccacataagcatttagaacaagcttgtacagcccacagcccacaggctacatgtggcccaagatggctttgaatgtggcccaacacaaattcataaactttcttaaaacatcgtaagatgttttttgcaattttttaaaagttcatcagctatcattagtgttagtgtattttatgtgtggcccaagacaatttttcttcttccagtgtggtccagggaagccaaaagattggacacccctgatttagaacacacagtgttcagacattaaatagtggaagtagtctataatatttgctattatcattattcccacaaatccattctttccccttgtcttccaccctagattatatcaaatgcaagcacagccttcaatcagctcaagcaagtgtttggtgtaaataaaggctttacaggactttatttgggttctgctgcagtccataatactgcaagactgataagcagtgctgataaaagtgctgctttttcctggaagtgtttcttttggatttatatttgaaacaagttgaatcctctgagctcttgcaaggaccagaggtaaatcaaagcagcaatttattcctcaaagccagatgtgaccttgcatcccatcagcccattctcctggagggccgtgatgagaagctttgacactcctgaatgtgcctgaggatttatctgtgcctaatcatcagcaaggggatgctgggtctgatacaactgatgctgcggagaagaaggggacacttatgaatctttctaccttaaggaaattgtgttttccaccttgtgttagagagatataaattaaggtgatgaaatgccagggaacagatgggttctaaaccattctaaaggaattttatgaatttcacttgtgtctggttttgtcttgagacacaagagtgaccttatgtctgtagcctcagcagatcagaatttataagggatcttagggaaggatgagctaatctcgtgcttctcaacgcatgatccctggaccatcagcactggcattagctgggaacttgtcagaaatgcagattttcaggtcccatcccagaactaatcacaaactccaggaatggggcccagcaatttgtgttctaacaagttctccaggtgattctgttcacgcttgaatttgagaactacgcgtctaattcatctaatcatgatgcctatcccatattaacatctcctgatgatcttttagaaaacaactacagcatggatcccacctctgtgcagtcttaggcaggctagagtggaactggagcggggttactgacctcctcacagtcaacactttgagctagagagttctttgttgcggggctgctctgtgcattgtagactgttcagcagcatccctggtctctctatccactacaacaggaggacatgttttgacaaacatgtctgcagacattgccagatacctccctgtgaggcaaaattgctcccctgcccctcccaccctgttgaaaaccactgagctacagcataagtattttacaagcaccccaatggttctaacatgcagccaggaccaaaaaccactgacctcatccaaccctatctttttgtcaggggaaactacagaggatgagctttagtggttctataggtaaaggcacactttcccagacctgtatattttgttcctgattggagtaaatccaatcacagcaggcaatcccaggtaagtgaatgtgtttttaggaggctagttggccacctcatcaaatgaatccacctccaaactcagaacccatggggggcccaagatgaaaacaggactgttgcaagctgcagatatgtccagggtgacaatggttgcctcttggctacctagccccataaagtggggttccagaggaaaggaatgggaggttactactcttgcctttccgatatcttctccctgtgctgaaatgtcctgtctctaagagtcgtgatcataacttattgtgcctggcttgtgctctaacctttgccatgtatgttctctgattatctttaagccttcagagatactatttcttacatgcttcctctaagctaggccatcaccagattcaaaccttgtgcaatcttttgtatttttatatttttgagacagtcttgctctgtcacccaggctggagtgcagtggcttgatctcggctcactgcaacgtctgcctcccgggtgcaagcaattctcctgcctcagcctctggagtagctgggattacaggtgtgtgccatcatgtctggctaatttttgtattttttgtagagacagggtttcgccatgttggtcaggctggtctcaaactcctggcctcaagtgagtcacccaccttggcctcccaaagtgctgacactataggcatgggccactgcacccagcctccttgtgcaatcttgaaaacacactccagaagactgggtattattgtcccccttttacagatgactgaagtgaggctctgaaaggtgaagtggcctgtgatcccacagtggccaagtttattctgatgccaaagcaccgatgtgtaactgagcactgtacatccttaaggagctactcatattttccactttcccaagagtgtcaactgagcctccgagaggctaggcagtaggtagaatcacgttgctgatgcccctgatataatatcctttcagctctttccttggaataaaatggtagctgcagtcatggccctcactgcaaatgagccttccaaatgcaagtgggcagccagacaacctctacatccctgcattttgctcgtgcccagaggtgaaaacaaatgaatgctccatatttgggacctttgtgaagacggcaggtgacacctgttctttctgtattggcaggtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaagtgagaatgcctttttttctcccttttctcctgcctgtcttatcttatcagccttccagatgagtcagggcttgaaagacattcagcctgcaaaagcagacttaaaatagaaatggagaacactaccccccttctccagatgtttgctggccataggcagtttcatgcaaaaatcagtttgcccgtgttgactgatctactcagttgctaatcaaaaatcagattaaagcagacccgaattagtcactaaggtttttccgtgtcaacctgtgtagtttgcattgcatctattgtagccccagaattacagtttagaaagtgaaaagcattgactcagtcagaaggaacaaggacaagcattgttaagtatgccgtagcagtttttctccagtgaaacagtgtatgcagttcagtatcttggaaatatttggaatttactacttattttcaatgggtatatgcaacatgtgcatcaatgtgtatgtctctctatagtcaagattatcttcactttcaaatgttgttgaatagcatgggagaatagcatattctttttgagcaaatacattcaattctgtttttacaaataccatgtttgtaagtatcttaagagcatgatttttttgttgttgtgtgtgatctcatttatttaaagaaaaaaaacaaaatagccaaatccgtggagacagaagtgaggctagtgattggcagtggctggtcagtggggaatgggggtttaggcactgggtcttcatttggggtgacacaaaagttatggagcttgagagtggtgctggttgcacaacactggagtatacttagtaccactgatttgtacattttaaatgagttaaaatgctaattttgttatgtgtattttacagcaataaaaaaaagactgtggttagatatctaagtgtagactttcacaggctttcagatttcagtctggagattaggggagcagtgaaggctggaggtataaattttcaagacattggtaaaaagatgatattttaaattatggacaaaatcctcaccaccatcctgacttttagccatgtgacatccctctgctaaggggtgatatgccagtgtttctggatggagtttatatttactgcatcttttttgcatacaaacacaaaaggcatttttgtcttaaaagggggacaattggattatactttatcaaacaaagcctctaacttctatcgaaagggagctagatttttggtgagatgtggaagtaaaatctccaggccacaaaaatacaagattggggcttatctcgcttcattaaaaatctgactttatacttcatactttcttatcattgcagggattgacatttttagatagactgatgattcctggttttattcattacaaaaacatatattaagcaattatattggtgtaattattagataacaaggaagtgactgtgaaccaaacatgatctgtttcaagagatttttcatcatgttggtcaaagagaccttacaagattgaagaacccccgaatgacagttgatagcttcttactatgaaaagtgtaagacccataagaaaatttaaaaaaggattgaggctattttgtttgcagaaaaggggtagatttagacagacatgggtttgaaccccagtttagccatttactagctgggtgatcttagataagttactttatttctctgggcgcaaattaccgccatctgttaagcgaggtaataataatacctggccttcatccagtttttgcaagatttaagtgtcatattcatctgtgcccagcagaaagatagagttcaaaagggagcagcaattttcattttgttgaatcatcgacatagcatgctgtttatcagtattgttactagtaatattgaagtttcttctcacattagataggaacctccttactttacaaatgctttgacagaggtacagggctgtcctataccctactcccaggtttgtagcttggtagtcatagaactgatatttaaaagccattaagaccttgatcatcatttccagtagaatccatgcagttctgctgtttcaaaaagccccgtggcccctcttccctttgaagccgggatggggctgttttgagtgaatttgttctctcttttcagatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttctttaggaatggcattatacagtacttcctcaaagcaaatctagctttgtctgaagtttctttggaaactctgcaatgcactgaagacatctgtaatatgatgttaccaaagcagtttacatatgtccttatatgcatattttttattatatatttagtgttttatagaattttttaaagttaacatataatgtagatattaattttttcctcggctgtaaaatgctatgggcaacacaatcatgcaattataatttgaaaatatttcctttaaagacagagtttgaaactcatcttggtaaataaattgcaaattactcgtacagttttacaaggatctcatggcagaacagcggaagacttggtccgtaactcaaggctgttgtatgcaaactactcttctagtggttaatgcacttgacatgtacagtatgtttcccatgccgttgtgattttgacatgtacagtatgttttcatgccgttgtgaattttgttgttcaacccaacttgagatggtttcaggaatggctgcaatctcaaaagctcaatgtactgcccaagaggcaccttgtgcaatattcccatccctgaatttagcattgtacaggaagattttcttttcactcaactgagttagcattgtctttgtggtagcattatcttagacattaaatttgaagtaacatatatcctgtagtaacatagacccaaagttactatagtcaaccaagtctttcaaaggataaaagatcattttattatctttaactgtatctattttgaatgtaaatttaaaaaaagtaattctctgtcaatggattcgtaatttctttacaaaatttcttatatataatatgtgtatctctgtaataatagagcccttcttttgaatcaaaattacatatggactttggaagattgctcctatttcaacaaatagttgctgcaagaatttttaatatgactctataaaagctctttagtacaattgtatggtttcttgatgattctgttttgcaataggtagcctagttgctttatatgctttaccttctaggtcttaaaatcacacattggaaaatgacaatatcaacaaaactgtattcttatgaaaagaactatttgttacaatgagaaaggttttgtgagtaaaccctactggacagtgacataaaaggcaatggaattttctataaacattttctcatgtaaacatgctgccaccttttcttctttctcagagaactcaaatttgctatagtttgtcatttttgcttacaaataatataacttttcaaccttctagttatatttatccaataaagtcataatcgggattccatttgtgtaaaaactagggtggtaaccggaaaaaaatattgtcagtatttcaagctgtgttcctttcttagtttgatatggttacttctatgttgaaataaaatttaaaatcacatgcaaaaaaaaaatcagcaaaataataaaatgaacgaaaaaaaatgacacccagggagttcccaaccccagtgtaaatgatatttaccagtgatctagcatatgtaatcttttttaaaggtattgttaataaatattctgtcatttgtaaaga

SEQ ID NO: 2413 - DNA, 165748 bp, Homo sapiens; identical to SEQ ID NO: 2412

SEQ ID NO: 2414 - DNA, 959097 bp, Homo sapiens
ggttcgacgccaggattggctgcaagtagggagctttcgccgccgccccgggcccctcggactgtgccggcgccgcacccgaggctctcgccagcccggcgccccggtgctgaggtaagtgaggcggcagctgtgcgggtccggctcctgcgtgggcgcgcgatgccccggggacgcggtcgcgggtgtgggggggaaagggcagggtccgcgcgggttgcccgaaggacaggggcgcttcccggggctctgactcccgcggggccgggcagcgtctgcggggccgtccagctcagagcccggaagccctgcagggtcggggagcgggagctgaacgcctgagcgcggaggactcagggccccgacgacgccaccgtcaccccacagcgacccttcttctccttctcagccggaaaataagtttgttgcgctgcgaggcagccacaaaacaaggaaccgagagcccggaatgctgcgggaagccttcaagtcagctcctccgactggttcgggctactgccccctctccgtgcgccctggcctctggcgccgggttcccggcggggcttttcttctgacagcccagtcacagcccgcagcagagggacgcgaacctggggagtggagggacctgggactaaaggaacaggagcccgtagccgtggtggaaggagccgcgtggagacggaggctgatgtctgtggcgcccgctgggtgccgggctggctgctgagcgctgaggctgcggcggcgagcgacaggccaggtgcctgctcttagggaaggtacctggcttccccagtctctgccgcgggagcctgttgggtggcattcgtttccagcaacttctggggggtttccagtttctttcgagaggcaagacaaccgccccgtcccctccccgggcccagacggcggcgaactgtgcgccgggcgccccacagaccccaatccactcactctccttctggaacgcggggctcaaaatcttcgtgcattttctctcttgtgcttcgtgtatatgttttactatttatgaagggtgtggaggtgagggtaggaggacgtgggctcctgaatccctctgaaccagccagagagtcggctgcatggaaacatttcgcagcgaagctcctgcgaggaggcggcttcgcgcgtcgggaagatcaggcggttgcttgctggccagggtctgcagattcggtgcgaagaagctggcggaggttgtgtagggcgagtcagtgtgactgagcaccctgggtgtgtggtctgcgtggaggagagtgggccggatcttgaggtgtgttggaggtttatttgtaagaggagttcctgaaaggaatgtcgtggaactttttctagttttcctgctggaatcaacataggggcgggcacatgtttgtcagaataacagtggcatttaactgcatgggaagctctttcaattttctgtagtgggagctggatagttcaaggagtaactccacataactgagtcgtttggatacccacacaagataatttggaacgcgcttgtatttttttgttttttgagatttctggtttatgtcctttagagagtggggtaggagcgtaaagactgtataggttgcctatgagcaggtccatacaatagcgttcccaagtctgcctaatagcaagtttgttctctctttctctctctctacccaagtgggtgaaaaagaacagtgtgtcatgaagacaggcacctggaggtgatttgggtggcattcatgagaaaattcacgttacccgtaagtttattcttgctatttttatcttgatttctttaaagattttgtgggaatatctgcagtgggtcgcaggagtaggtaagattgctaaggatcaaaaacaagtttcatgagaatattatttttgctaccttataaaatagctattgatttgtttgttgaagctggtttcaactgctctgtcttgttgaggagagatgatgctgataaacgtcattatttttccatctgaaccctgggaggtagctggcaaggatggaaaaactgaccttttcaattaaagactaagagtctaagagaagtgacttggataagggtgcatgtcagagccacatgtaagtttcaacagaggtagattttcctatttgcagttttttaaacaacacttttcagtttctttgagttgtaaaacttttcaagtcaattgggagtcaatgcagtacctttttccatggtcatttcatattggcaggtaattaagagtgattagagaacaaacctttcaaatgatgttggattttttatcattcacttattttacctacttctctctcctttttgttcaaaagtaggtcttctgatttcttttccgatctaagcactaaatcttttggctgcagtttttcttctgaaatgtatacagggcatccgttccttcaatttaggtcttaaaaaaataaagctgctcagcagaaaattcccatgcatggtactgacttttctacaagtttgtctgatcatgattttaacttgttgtttcttctttgttatatttgaggacagacataatatgcattagcttcaatctctcttatcttaaaaattaatattttgtaaaaacttgcttttatattattttagttgaataagtctatttcatatgataggcagggggaagtctctacacactgattttttttgttcctttttgttcatttttccctgtaatgctatgttttaagcctagtgaaggaggcaaggaggcaggatttactgcctagatttattgatcttcattattattattatttactatcagaagaaatctgacaacatatcaataaaatttatttataaactgaagacatgctgttatatgatacactacttataaaacacacaaagaaacaaaaaagatgaataaagcaaaaattatgaaatagaaggtctcatgttgctgttatgtatcccggtggatcattttgtacagcccctggggtgtgtagcacactttaaagatcactgctggtttgatatttttaaaatctttctctccttatctctgctctgctgttcatcatctctgatactctagccagttgtaaaactgctacacttctatatcttctgtaacaaatagattaagcacacttgttttcctctcatggactcatatgtggatagaatgaggtgtaaaggatgaatgtgttttggagatgtcatcttagatctcccaaagtagacatacaggtgaattttaaaaaatggagttttagtttaaagactaagtaccaatggtcaggaagtgaagaatccaaggagtaaatgagggaggattggaaggacactttccacattgcagtgttgtgtggaggctggaaagttcataaaccttgaagcagattaacctgaatctaagtctggcaccatcatttattacatttacagtcctgggcaatgtagttccttaatttctgtgagccttagtttctttaggtataaaattgggataacatctatttcacggcatcacgatagggattaaacatgagagcatgagtcaacatgggtcaagagcttggctcttttagattggctctttagcagatataacagatccaaaagggatactgcctcagatgtgaaatatatttatttctcggttgtgtgaagtcccagaatgggtgatcatggcagtactccttcaaagtgtgattcagagacccagccttcatctgttctgtgcccttgccgtcttcagcagggtcactgtgcttacttgcatcaagccattggaaagaggaagacttgggaggatgttaattgcccagaactggaatgagtgcatattacttttccttgcattgtgctggccagaacccagttctttgtggatgtacgttactattaaggaggctgggaaatatagtctagaaatgttatccaggaagtagaagaaattgttgggggaacaactagcattctctgatgttttattactatatgtgatatttcttccatgttcaataactgttacttccttttcttctcctaacccttgcttttttttttttctggtagaaaaactggaatggatacaataaataataatagaagcagttaatacatacataatgcttactattattgagatactttttaaagcacattgccctactttgcccttctaatattatctctattgtacagatgaggaaaactaggcatagagaaattaagttatttgttcatcatagctagtaagtagcagagctgggatctgaaccaggttctctcactccagaattgattttttaacagctttttttttttttgcttttgcctcaatacttttcttatttaagccactggaccgctttttacttttgcctatatataaaaaagttgccaagagaattttttaaaatactaaagtagaaaaaaaggatataatccaaaacatactggaatggaattagatatgatacagctttatcttgaatacctaccaggatcaggagcagatatttaaagtaactccccccacttacacacccttcaccactacaactgctctttcatttgtgataaacacattttcagggtctgtgccttgaattataaccttcctctgaagattctattgtgggagtcttgcgctaccactttcatgcttcagtatgtgaggataaattcctcttcacttctcagcagaaacaaatatcttccctggcaggtttttcagctaaaatagcctctcctaacttttgatcaaaggtattgctctttatcaatatccccatcctccaagaaaggaaaccctcttcttttcctatgagctttgcaaaattattttttatttatctatttatttatctttattttctatatgactaaggggactgtatatatatcccaggtaccgtctaaaagaaaatggtccctcttgttctcatcctgttgtcccatttccattagagaatctgcctcatcttatgtttcctatgtatttgtctttcataaaaatgcctgttagagttttggttcccagtggctgcagtggaaatgtgtagtggtcaatagtaagcgtatactttttgctaagatagttattgtttcaacattaaagagtgatttttttcctcttgttcagtatgtatttgttgcatcttcacaattaggtaatgatatgtatcttcttaccatgtaggtaggcataaatactgtatacctaccagtcatttctttcccagaagcccctgttcatttcctctttactttccctgagcctcacatcctgagaattttgcttttttttctgaactcctctttcttccaattttttccacttctgtgccatttatgtctacgtgtgtgtgtgtgtgtgtgtgtgtgtgcgtttcaagtcccttcttatgatttaatggggttggagggctggagaggttttcatgtgcttactgtcatgttttcagccaaattccacagggccttgtaacaggctaacatgagcagataagctcttaattttcagtgacttattttaactttttacttcttgctcatgtgtggtagttcagtactcatagaatagatcctgactgagtggctgtccatggggtcattcagggaatcaggttccttagagttttatggctttgttcatctttaagtacctagagtcctcatcattcagtcaagatacagagtgtgaggagataaataatccagagaagtcttattggaggttgttgtaggcacagcctggaagtggttgtcatgacttctgcccacattcctctggggtggacctcagtcacttcgacatcctttgctgcaagggaagctgagaagtggtgtctagctgagtgcctgggggagaagggtgaaaggaaaacaggtttggtaaataactagccagtctttgtcacaggtttccaatgaaagcatgtgagaaaatcagctaattctctaggtatggggaaaagagagcatggattttggttatttgccaaataaatgcccattgccttgcttccttttaattttgacctctattactatcccattcttagtgcatatggtctgggtgggattccgtttcccatttaaggattggagcatgggaaccaggtcttgtcgggaagagcattgacttttcctgtccacagtaattgcttctagaacagaacaggcatggacccagtgagaaccactgcagtgagatgctttgctttttctcagtggctctagttgggctccatgtatgcctttgaactaattcctgtagataaggagattagaaccagggagcatgtgggcctgccactgctgcagctgtcttaacaccaaaaagagaacctagacctgctgaggtcaccacatactacttgagaatgaagccaacagaacagtagcaaggggcatgatggagcaaaaccagctcctcttgcatcatgtgagcccgttaatctggctatgcctaaagtgagttaacctggtatattagtctattctcacactgctagaaagaactgcctgagactgggtaatttgtaaaggaaagaggttcaattcactcagttccgcatggcctcaggaaatttacaaccatggcagaaggcacgagagaagcaaaggcaggtcttacatggcggcaggcaagagacagtgaaggaggaagagccccttataaaaccatcagatctcatgagaactcacaatcatgagaccagcatgggggaaactgcttccacaatgcaatcacctcctaccaggtcccacccttgacacatgcaaattatggggattacctttcaattgatgagatttgcgtggagacacagagccaaaccatatcattctgcccctggcccctcccaaatatcatgtcttttcacatttcaacatgccttcccaacagtcgcccagaatcttaacccattttggcattagctcaaaagtccacagtccaaagtctcatctgagacaaggcaagtcccttctacctatgagcctgtaaaataaaaagcaagttagttaattccaagttgcagtgggagtacaggcactgggtcaatgttcctattccaaatgggagaaattggccaaaacaaaggggctacaggccccatgccagtctgaaaccaggcggggcagttattaaatcttaaagctccgaaatcatcttctttaactctatgtctcaagttcaggtcatgctgatgcaggaggtgggctcccactgtctggggcagttctgcccctctggctttgcaggctacagctcccctcccaactgctttcatggctggagttgagtgtctgctttcatggcacacagtgcaagctgtcagtggatctaccattctgaagtctagaggaccatagccctcttctcacagctccattaggcagtgtcccagtggtgactctgtgttgggagctccaacccccatttcccttccgcactgccctaacagaggttcttcatgagggctctgccccttcatcacacctcttgcctggacatccaggcatttccgtacatctactgaaatctaggcagaggttcccaaaccttcatttttgtcttctgcacacccacaggacgaacaccatgtggaagctgccaaggcttggggcttacaccttccgaagcaacagcttgagctataccttggccccttttagctacagctggagtggctgggacgcagggcaccaagtccctaggctgtacacagcagggagcccagtgccttgtccaagaaaccgtttttccctcctagacctctgggcctgtgatgggaggggctgccgccaagatctctgtcatgccctgaagacgttttccccattgtcctggctcctccttacttctgcaaatttctgcagctggcttgaatttctccccagaaaatgggtttttcttttctacagcatcatcaggctgcaaatttttcaaacctttttgctctgcttcccttttaaacataatttctaatttcagatcatcacactcaagtttaaagttccacagatctctagggcaggggcaaaattctgctagtctctttgctaaagcatagcaagagtgacctttgcttcagttctcgataagttcctcatctccatctgacctggacttcattgtccaaatcattattagcattttggccaaaaccattcaacaagtctctaggaagttccagagtttcccacatctttcttctgagtcctccaagtctctagtaagttccaaactttctgacatcttcctgttttcttctgagccctccaaactgttccagctctatctgttacccaattacaaagttgcttccacattttcgggtatctttatagcagtaccccactctctgcagtaccaatttactgcattagtctgttctcacattgttataaagaactacccaagactgggtgatttataaaggagagaggtttaatggactcacagttctgtatggcttgggaggcaacaggaaacttaaaatcatggtggaaggggagagagaagcaaaggtatatcttacatggcagcaagcaagagagagtgaatgagcaaaggaggaaaatccccttataaaacgatcagatctcgtgagaatcattcactatcacgaaaacagcatgagggaactgctcccatgatccagtcacctcccaatcaccacccttaacacttgggaattatggggattacaatttgagataagatttgggtggggacacagaaccaaaccatatcagctggtgattttgcagctcttcagattcataaattaccctttgacgtaagctgatttgggttggatttgtatgacttaaagtgaatactgatttattagaccaagcaaaaaagaggaaagaatactggataaggaagggagtgggggttttatttgtttgtttgttttcctgagctcatcttatgtcactttggttgtgtgcctaacagtttcactcccttgtaatacatcagacttccagtcaagaaccatttggcatacccctacccaggcacatagagctctcactaaattataaacccgaagctgttaattcttctcaaagctgatctctccttacagagttatggaagggaaatggaggtgaaatcacatcctcaggcttaattccctctttcaagattgcctgtggtccctcctggatgatgctttcttttccagcatcacttccctgttcctatcctcccccaggcttgcagaccaactgtaacaatctaatcacccatcctggaacttttcatgtgccttttcttttttttttttttttttcatgactgtttacattgcctctctctttggcctcctcttactgtccttgtctactgtgtttattacagtttgcacaatgctcaactcaagtatcactaagttaagcctctttcaatactattgaggcataaagaatggctccgtcacctgtacatactctcattgtacttgtttccatgccactgatataatatctgtcatgagaatgaccatctctcttgcttttcccaggacaggggggttcccaggatgctggatattcatttttaaaaccaggaaagtcttgatcaagccaggagaaatttgttgccttgccttctacattgtaatagctctcatttaacatgccactcggtgcaatggaatttcattgagacagtggataacagcttgaaatttggaggcaaaattcttaccaatcctagatccattttgtactagttgtgtgattgtgagcaagtgacctaacttttctaggttacagtttcatcatctgtgtagtggaatagtatgtgttttgtagggttgttagctaattaaaagacatcataaattaaatcacttcgtttagtgatggacacatctataacattgtctaaagcacacgagttttgtgaagattatgtagagtactacatgcaaagtacaagcaggacagtgcccaaatcctagtaagcatccagtacacagcttttgttatggattgttgttattcacttttaagtatctcttgcctaaaacatagtagatgccaaaaatacaattacactcagagaatacatgttcatggagcataaacaatgttactcagagtttgtgataagtggggcaagcaagtcagtgagagtgattaggaaatattttcgataattacttggtctttgaaacttgaaaaagctggaattgactgcaggattagttcctttttagaaacagtttgttttttcttgcatatttaaaccagacttcacaaattttcatagttcggaaagagaaaatattttccatgtttaggcaaggtcagtattggtgcataacccctaagtacatattttcattatttttattaatgaaataaaagtggcgcatttgggggaccaaaatgcaaatattttgtctttcttttggttcataagaaagtgaaggttagggcagtagaatcactactccattattaatcattattccataatgatcttgagttaaaaaaatcatatgatttgttgttgttgttgttaaccacagtgacatatcctctctacctttgggctgaacttttgtatataaaaatactttgtaacttgcacacttgtattaatataaatcttgagtgtccatgttgcctatgcctttcagttttgtcatggaaatttccagtgaggacaggtgttgcatgtgtgcttatgctgagatgggtccagtctggacaagaagacaatcaaacaaaacaatgatatgactcaaatcaccaagtatgttttgtaagatttgattctaggcacattgtcatcattttaagttgtgcaaatttgtattgttatccatattatgatgggtcttcaactattaattataaatacgaatttttttgtctttagtcactcatttgattagctattagctagatattgattctagactccttacagattagtgaattaattgggagtccaagcattatttttagtgtatttaattgggtgaatgacagctttatagagaaagtgattacttaagttgcatatctaattcttagtaaaaaattatagtacaaacaaggtcatctagaattcttggatctaagtaatggtaaattaagagttgcttttaatataatagtatcttttaaaaatggatatccctgtaaaatgtcttcattttctgcttaagcaggtgactaaagataatttacttcttgatgacacgggatcaccatgataaacatagtttggtggtttagaatagagtatgggccttggaatcagacagacctggtttgaatccttgttttgtctcttactagctgtgtgatctcaaacacattcttacttttcccaaggcagtttttaaaatctgtaaagtgaagttgatcctgcctgtcttacagataggctgtgaacattaatggtatgcattgaagactttaggacagtgtgcatggcacattgtaagcattaggtaaatgaaccgtatactacaatctttacaacttatacagaacgtagtatacttaaatgttttatatatttgttgttcattgtttcaacattctttgccacattcctgtgacactgggggatgcaacaggatcccatccagtgcagctgaagtgttgagaccgacactggtgacctccatctgctttctgctgcctttcagattgtcatattataatctttcgctttggtgaactagccttttccacttgctgttttccaccatttgtgaactggaaaaataaaatacacaagctgttcaaacattcttagtaagagtaaacagattcggagtgagactgtgaaggggcctgtttctcccctccccgccttttttttggttgttgttgtgagagagtaatggtatgggtgtttcacatccattttcactgttctcagctttacctctctacttcctggctgaggtactgagagtaagatatcactataccatagtggaaatagaaaataacctgctttgataatattgtgacatgtatttgtgatatgcttggcagtagcatcatgttagtgaaaattcctgtgttacagtgtggaatgttggctatcttacctgtagtacaataaacttcattcaaaatcctgtgcttagaatacagcatgatctttatggtataaagaggttttcttttctatttttttccagcacatttcaaggtcttactagttactagagtctaactcaaaagccttagtatttaccctttattttcttttttaaatccagtggtcagaattcccgataccaaaacaattatggatactattaaggtggctgtaatgcttatatacgcactgtgagttcattgagaattcatagttctgttaattctactcaattcttataataattgaaattcaccagcatattgttgtttatagtatgtggtgtaagtgaaattaatacttttcttttaaacattagtattttcagagaagaaccttttcctgttcttctgaattaatgaattgttacaaatttttgtaggtttcttataatgtggctacttaaatcaacatattaaggtaaactcttaagaaaagaaacataatataatgtactccccaaaataatgaatcccatgttttaggttggtatttagtctccacagctggaaaacactattttatgtgatgtataggaaaggctggaggcagacttggtgatttagaatgactcagtgattcatatcctgtctctactacttatgtatttagtatatatacaaatatatattaaagttagtatgtaacatcagaccaagtcatttaaccttttttagcttcatttttctcttgtatataatggaggaattcctgtagggttgtgaagactaaagttacttaattgtatatacacatagccttgtgccaggaatataattagaccatccctaaaaatgctgtttatcatgattttaccctttcaatgcatttattcaatatgatgcttgtgttgtagatgaaatatgtggatgttatgatttacaaacttgaaatttcattattttaaaatactctgtaaagtgatttatgtttgctcatatgcttttatctatgggatagacaatgcaatcctctctgtgtggagacagaggaaggcaacatttccatagtgtgttgttttatggttgactattactgcgagccactgtatcagaactgagatgagattagcactatttgagattttattttggagaaatggttttggctatggtcaagaatcttatttattagaaagaatgaattactgaataggctctcatctgtattctttctacttcagctatagcccatcttgccatcctgtaaaagaaatgctgacagtgacagaggagaaatataaaaatgtttccagttgctttcagtcaaatgtgattgaaattttataaaagatttacacattttttatttgtaatactgacagtactgggaaatgaatttctgtttactccagagaatagcagtcactttataggtgctttgaattttaaaacttagcaagcataacaataatgactggtgtattattaacatgcatgtaaaaggagtttaacatatctgaagagaaactggttaatgttattttacttcctatgtgtttttacagcctttcaagaatgaaacattggtagtaagtttgttttgaatgtttctctatttcatctttgtatgttggtttactacctattgtatgggattcaaagaatgtttatatcaaaaactgttttgtttagagcttatcattaaacctcattacttagatgttttaattacttttatatgtttctttctgtatttctaacacatacaatgagaatttactgttttccattgtgttttacatttttttcttctggtaagttactaagctaactcacatcagtatcttaattcctggagagagacccccatccatttatgtatatcctatagatctgattatggccttgttatggaaattggcctgactacaggcttctagtcattcatgccctagtattctcccctgttaggtaatttccaagatgcaccctctactatagtttctaagtaattcttctgagcaccagaccaagtattcatggaaggcctaaaatatatactttcaatggaaaggatggtagaaattcagccaattctgctttcttgggcttttagatattaaaaagagctatagaaatataattacactgatggatttcactgctctcaattgcctgaattatcagggttgagcaactgaagcgggtggaagggctgtttcccttatatctgaatataacataataaattgtccatcaatagggactatttgagtttgatattgatctttgatgttatgtatgctgcatttcattgattaaaagcatgcattctagttgggtctagatatacagtctaagtacatgatctatagttcagaatagagtatcatttatatagaaatttgcccatggccgtgttgtaattgtagcccattgattggcatctccaaggagcttgtgagaaatgcagaaattttttcctcacgcagatgcactgtatcagaattttcattttatcagttgatttttattaaagattgatagacattgatttgcattgtattcttaactaactgaaacaactggttccctgctacgaagcctaaatgtcaagcatatacacaacctgcttaattgtatagtaaggacccaatactataggatgaaggataggtacagttgagtttggccaaatgatgatcagagtctatatagtttaaggcgcagatacacaaattttcaaaaatatgggtagaatatagtcaatatgaatggaatagacaatgctttgaaaatcactggagggaggctttattgtttgtgaaaacatgttgtcatcactttttgctttaagcccttggtggtgaaataactcaaaccattcttccttatgctgaagatcgagaaccccaagtatcacatctaccatcccactcatcaatgtgattggtcagtctttgctgaggtcctgcatagccagttttaaagttagagttcttgcatatacatatgaaaaggcatgttacttgtgctttcaaagagctttttgcttggtgtaaaaagaaaactcaaattacagtgtgatgtggaatataatggtggtagtttcatcgagatgatgggaaagaattgataagataaagtagaaagatgagcagaattttcagattgggtttggaaagagcacttaagaaagagggtggccaggtggtggctcacacctgtaatcccaggactttgtgaggccgaagtgggcagatcacttgagctcaggagtttgagaccagcctggtcaacatggcaaaaccccatctcaaaaaaaaacaaaaaaatacaaaaactagctggcgtgttggtgcccacctgcagtcctagctactcgggaggctgagttggtaggatcacttgagctagggaagttgaggctacagtgtgctgtgatcctgtcactgcactccagtctggatgacagagcaagaccttgtctcaaaaaataaataaataaaattaagaaagagggtatagtatgtacaatggccatgggcttatgaggaaaaatggcaagtttggagaatgccaaaggtatgagtggacgctaggggtatgggaaggtggcaatagggccttcatttacacagtttcatagactagaatgtgaatgttatccccagagttggaccaccaacaagcagtgactgtgattgttgcatcatggctttgtgcaaagtagcatctctagcgaatgggacaaattggggaatatgagggaattgggagatattctttatgctgtagaaagccactgcaagatttatatgacaaggtatacagtgctgatctgctgaccaatatattttctggcatcattccgtgtttctctcttgtgagtgaggtgcattcctttgctaataacatttgctgtcctcagacattattaaaggaaatttaatgctgtttgacaacatttcaagtagtagccattgatattgtcatggacatttattgttaatcacaggaacaagtttccttttctaacagcaaaatctcttccactgtttgcagtcttgtgtgatgatgaaacctcagcccaccctcctaataggcagtggaccatgaggcctctctgatgagccttcagccaggctcttctccttgctccagtacatcatgcaggcatgtgacctaagttgcaatgatcagaccctctcctcatacgtagaatcttgggcttagtaacataaggatgaagaaatggttagtagatgtatgctttttactgtgtcagtgtcctggccccactgaacatggtgtgtggtccaatattaatggtatctctactgggggttttggagctgctttgtcctctagttcttccttctattccatgcgctctccatatccttttgatagtctccttttcccaaagttggttattctttcttggaaccaaggaactataaagagaaatggaggttcttccaggtaaccctgtttatcctcttagctttctgttagggacatccacagcacgagacacacaagttagcttttcagggtgcctcttgaggcctgtccaggaatttggaaaattcatcctcttaaacagcccatggcattttccacagtttatggtaagtactcttatctcagtattctgcagaatgcagaaaggtaccttgtaaacttggggtataaatctctctattggttttcaagttgtggtgtatagctttattcaaagggaattctaacatttcatacaaccgcagctgccatgttatttcttttaaaagcttgtgccttctctgaataattcatattgtccagtgccttcagattgtttcataagatcaacacctaaaaagtcctttcttgttctagctaatacttaaagactcttttgcaaatgtgtttctagaaattgttatcacagttagggtgggcatttagctttttgtgcctagcctgtaaacttggtcttattaactttgggaaccatgagtcttggtatttatgcagtgagacttaaatctttctcgaaggtgctttatagtaacctgcatgtaaagcctctaacttgggcctggcactcatcattgggttggaccccaatcctgatgatcttcaaatcctctttcatacatagccatcaccactaaagtcttattcagctaatgttagaaacaaagcattgcaggaggcctcatatctagtaaatgcactttcatacccagtttactgttatcctccataattaacgtgaggcataacagaaaataatcatagaccaggcatacatctcaaagcttagacatgttatgaatgtcactccacataccagctccaatccatcattcctgtcctcagcttggaagtggaggaggggagacgtgtttatgggactaaatataaactctgtggggtaattgctacaaaatgtcatcctcagaaacacctgggagctttggaagaaaataaaatttcacagccccacgctaggtaataccgaatcagagtctctgggaatgagttttaggaaactgtagttgaataggctccccatgtgattctgatgttcagccaggtttgagcgctaaagcatgttctgtggaacactaattcttctaggtagatataaataggattccctttaaaagtgttcttaacaaaaacagaggaaattcaggattttaaacaggttttctaacacgagaatttttcagaatctttatgtgcattgtgaaatgcatgtttctgactatggaacaatcttgcttctctatcccccctgccaactccctacccaacacaaagactctttactaaacatctaatgttgcagatttcagccctggctcctccttagaataatccggttaatcgatcgatctggggttgggggtgggttctgtgtgggagaaacaaactcaaagtgtgttttctattctctcactcaaaaacaatcaatagagaagatttttgtgaccaaatttgtgggggaatcacccacacatcaagcaagcaatcagttttccagcagacactaactcagcgtcctctaattcagttcagtactgacactctctacttagagatagtctcagatcacagaggttgagggctcagtcccacaagactgtcccctactcccaatgccacaggcaagcctctggttgcctgttttaatggcatttctaaaacagaccagctataaattggtgttcccgcaacctcctccttgggttcagttaatttgctagagcttctcacagagctcagggaaacacgtttactggtttattataaaggatgttacaaaggatacagatgaagagattcagagggtgaggtattggggaaaggccccacactgggcctttcatgccctttctgggcacactaccctccaggaaccttttgtgttaagctgtctggaagtgcatctgaacgctgtccttctgcatttttctgggagcttcattaggtaggcatgattgatcaaagtattggccattggtgatcaacctcaccctcagtccctctttccttccaggaggttgggggagggggctgaaagtcccaaccctctaattatatcttggtctttatggtgaccagcccccatcctgaagctacccagtagctgccagccattcatccgctaattagcatacaaaagattttcctttggaggtcccaaggattttaggagttttatgtcaggaaatggggtgtaggacaaatacatatattttaccacttcatgggctaatggaatattttaaaatttcccgggtgattttattagacacgcagggtttaggaccacagatgcgatgtaatgttctttggaagacattctggatgatttatttatttaacaatgtgtcccacatcacccagattttttagtttcacatctgtcaggtggttttactcaacttacatatgtatcatcctatgtttagagcttgtttttaaatatctttttttctgattataataaaaactttttcttagaaaaaacaccccagctattacagacactcttagataaaaatgcattggttgtctaagtgaattttaatcataatgagtaatattaattgaacatttataatgtaccaaggaagtcactaaatgtttttattatattatctcatttaaacctataatagtcctgtgagctagatgctgtgatgacccctgggtcctaaatgagaaaactgagaatcagaaagagtaagtaatttgtctcaggtcatgcagctaataaatggcaatactgatatcatatcagatcccaggtatacctgattgtgagctaaagctcttaaccaatttggaatcctggttaagacagaggcttttatgtttagtgatcagtgtatgcttaaaaccccttagtatgtacatgttactttgtgaagcacattttattgcaaggaaggtgaatcttcataaatgacaggggtttaggaaagtattccaaatgttaagaaccattttaaaatgggaagattttcaaccaaatatttgcatatgaatgtaaacagaatttttgtagttatagtagattggtaatttgtgcatgtaagttatatattattcattaatctgaatgtatttgaatattccaaattcactgtttacatatatttttcctaccgataggcttccaaatgttgctaagcttccagaaatattgagtttgatagatttttttggttcctctggccagaaatttaaacaaaaagaaaagaatgatttggactactggcaataaaactcagtgaaggggatttatgtacgggtccgaatgcatgcttattagtcactcagaacatgatgtttcattttaaaagtacatgcctttgcatcttgttatgacatttagaaaaagttttcagttgcatgtctttcattttgccagagaagataaattgactaatatgtaaatgacattacagggtccaagtgtaatggttaattttatatgtcaaccaggctaggtctggatatttggtcaaacatgtctggatgatgctgtgaagatattttaaagatgagattaacatttaaatcagtggactttgaataaagcagatccataatgtggtgggccacattcagtcagcagagggccttcagaaaaaaactgatctcccaggagaaagaattctgctagcagacagcttttggtctctggctgtgacattaactcttcattgcttgtccagtctgttaacctgccctgcagattttgcacttgccaacctccataatcacgtaagccaattccttggtgtgtctctttctttctgtctctctctccgtgtatacatctagtccatcctattggttttgtttctgtggagaaccctgactactacaccaatattccttattctccctgtatgagaaagtttctctagctgtttttagaataattttatttggatgtccttacccgcaaaatcaactgttagacttttgcagaatgattagtgatggatcataccaaatactgccatctccaacactattgatgtttccccaggcattgggcaatttcatagatgccatatagagtaaatgggaacacagaaagttcaaagatggaatttgttactccctggaaatttgtagtggtaaaggtttccaggtgtggcttttgtcttccagtccaagtaggataatttagagaaatgggaaaataatctctttctagaatccacttcatttttccatttaacctacaggtatcaagtgctactaagccgtaggaccaagctagatcctatgggtagaaaagaaaagaagtggatatggaacttgccatcatagagcttagggtgtggtaggggttacccaaaaagagttaaacaattaatactttaaaaaattataaactgtataggggctctgaaggagaaaaggaaagtgctgagatagtgcataatgtgggcaggatctagtgtaggtggcagagtcaagaaaggcttcttggtaaatgtgaattttgagacccccaaacttgagatggagctagccatgcaataaccagggaagaaagttccaggcaacgaagacagcatgtaaggggcagtaggtaagtaagagcttgactcataacctgatttaagttttaatgtacaaacaatcaagttgtcatgggtcaagaaagccttagactaagctgagtgaagggggctctaaatagaatcatataggagaaataacactgggaaaatgaggatagtttagctggattctactttgagagtatgataaaggagaaacattagtttcacactttactagtttttaaatatgtgtaacttccatattatttaaactataacatgaggcatttaggttatatatatatatatatatataaatatatatatatatatatatatatatatatatttttttttttttttttatgcagagtctcactctgtcgccgaggctggaatgcagtggcatggtctccacggactgcgagctcgcttcctgggatcaagcaattctcctgtctcagcctcccgagtagctgggattacaggtgcacaccactatgcccagctaatttttgtatttttagtagagaggagggttctccatgttgatgaggctggtcttgaactcctgaccttaggtgatctgcctgtgtcggcctcccaaagtgctgggattacaggcatgagctactgcgcctggctgataaataattttttaagtatgcatgtgactctcacgagtgtggactgctagctaaggctggctcatcaatatttgtctagagatcttaaaactgagtgaaatactgtctaagtgaattttaatcataatgagtaatattaattgaacatttacagtgtaccaaggaagtcactaaatgtttctattatctcaattaaacctataataatcctatgaactagatactatgatggcctctgggtcctagatgagaaaactgagaatcagagagagttagtatgaggctcctcacactttgggaggctttctctgcatctgaagccacttgaaagtctagactcattgactttgtgaattttaatgacttccttcctccctcccttccttccctcccttcttccttccttctctccctccctctcttctttccttcttttttccccttcctctctttgttccttcctccctcttaccaaatgctagtacagcactggatatggtgaatatatcatttcaggcataagaaattatatgccgtgtaatcccagcactctgggaggccgaggcgggcagatcacgaggtcagaagtttgagaccagcctgaccaacatagtgaaaccccgtctctactaaaaatagaaaaattagcccgatgtggtggcacgtgcctgtaaacccagctactcaggaggccgaggcaggagaatcgcttgaacctgggaggtggaggttgcagtgagccgagatcacaccactgcacccagcctgggtgacagagtgagactccgtctcaaaaaaaaaaaaaaaaaatgaagttgtgtgcacggggacccatatcctccagtcctatagaattgtaagttggttactatagaacttgtgctgtatttggaacctttcactgaagaatataagcaaatgtcaaacctgtaatttgtcagagtttccatttcacaatctgaagaactgaagtgtacaaccttcactctgcattgttgaaatgaagagaaagagttaaaggtaattatccatataatttgaaagaaaaaatgtctccttctgctcaagaagtagggtctgataccttgattaatttgtactggttactaatatttaatttccctggatagtgtctgaactttccatttcagtttgccattgtaccccctttgtattttaaaattatttttctttatcacacctgtaatcccagcactttgggaggccgaggtgggcggatcacgaggtcaggagatcgagaccacggtgaaaccccgtctctactaaaaaaatacaaaaaaattagccgggcgtggtggcggcgcctgtagtcccagctactcgggaggctgaggcaggagaatggcgggaacccgggaggcggagcttgcagtgagctgagattgcgccactgcactccagcctgggcgacagagcgacactccatctcaaaaaaaaaaaaaaattatttttctttaaaggttatttgtctatgattgtgcattttaatagtatgaaagggtacctggtcaaaactgtttgccttttgtcactttctgctaactcttttccctagagacaatgttactattatttgtttatcatttcagagatctttattgttatatgggcacatataactgattttgtcagttaaaaaaatctgaatgcttactataaaaaatgatggcatggaatatttttcttcacttaaagatgaatcttagatgtcagtctacattaatctatatgtagctaactcttccctgcgaagagtatttattcctttgtacaaaggccataatactagaacttgctcataagaatttatgttctttacagactcttgctatgataaacaatatctttgtaaacatgtgtgattatatctgtaggataaattcctgaaagaagaattggaatttttttggtcaaaaatactgtattgtacatttaaaaacttttataattatttccagattgccctgcaaagaaattatcataatttacattctcaaaacaaggttgtcataatgtttgagttgatgcagtagctccttagcaattaatagacgttcattttacaatctgtcaacatttgcaactttcacgaagcctcacaagtgatcgtgtacccaggtaaaacagcttatgttagacattcttgtgcaaggtttatggttggctgttgttcttaatcctttccagttataagagctcattgaatgtctcagttcaaggttgccatgttatattatgagacattgggtactgtcggtgagacttggcatgactggacgagccattctgatctttgaattacacagcaagtagaagccaggacagtatgttcttgacttaaggcatcctcagcaaagtgataacctagctgatcttctgagaaccctcagccagacacagtggagtttatggtaaattatagctcttgttgagcattgactatatgcctagcacccttgcatatgatttctaatctttacaacaaccctccaaaatgggaataactatcctcactttacaattttggaaatttaagttcaaaacggctgagtgcatttctcaaggtcaaggtcacataactaataattggcagagctatctccctctgcctgcttccagaggagtttttccttttattgcatcattgcaattgaccatcagaatcacttggctttactaattttttatgcattaaacaggtttttctggtcagtatccaggcaaatttaggcagttcttgtttggaagggtcctttcctttggttggtccagcttttgcacccctgtacttagagggatgctcagatgctcagatgtctttgctactgctgtgtccagctgtggtgtatcttcccatgctgaccctactctcatgtttctgaactgacatctcgcaagattaattgagatgctgtagttttctagcgctacactggctgtaattagtcgctgacatatgatgatttattataggggattcctttagaaatttactttgtgttttgggactaagaaatgatcgttagagtttcagacttacagctcttgtcctgcaccacttaactgatcaaaactatgtttgggatgaccaggcagcttgacatcatagcactggtcatcctgactctctaagtaaaactgaaatgtgtggcaaattaaaagcagtgaagatggtgcatggctaaattaattcatcttgattaggccctggtgaatttttaaatatataatcagatgtgagaatttaagatgtgggatagtcaaagccaagaatccaggaagacttctagcaattccacaaagacaaaaagcaaagatgccagaagactgtggccaggcttgcttgtggaatgaaaataaggggaaaaaaatcacttacaatagattaacagtataccctgtcaaagagtgtgccagaagtcacgtaaaattcccaacccactgacagagattttggagaggtgatgagagtgaggggaagggattatctgaaaaatatgaacaaggcagtagtgaggaataagatgccagcatcaacttccgctgtcacttgttttctcaacggttagccatgccactaaggtcaactcagtatgttattaaaatgggcggttttaggtaatgattactttcttggcagatagaggattcttttatctttggggtcatgcatttttaaaagcctttgtctgcatagatttatttaaaacacacacacacacacacacacacacacacacacacacacccccttaagcaaggtatgctggctcacacctataatcccacactttgggaggctgaggcgggaggaccacttgagcccaggagttcaagaccagctggagcaacaaagtgagctccttgtctcaacaacaacaatgacaacaacaacaacaacatctgggcatggtggtgcatgactgtgatcccagctacatgggaggctgaggcaggaggttcccttgtgccaggaggttgaggctgcagtaagctatgttcatgctactctactccagcctggaagagagagtgaaaaacaaccaaccaaccaacaaaaaagcagcttgattgaagtgtagttgatgtacaaaaatctacacagatttaatgtatacaatttgcggattttaatatatgcaaagatgcatgagacaatcagtacaattaaggtaataaatatatctattatctccagaagtttcttcctgcccccgctccatgtttttactggtaagatcacttgacatctacttgcttgacagatttttaagtgcataaaacagtgttgttaactataggcactatgtcgtgtagcagatctctagcacttattcatcttgcagaattgaaattttataccctttgtacccttgaacaataactctccatttttccttcctctacaggctctggaagccaccattctactctttgtttctatgagtttgactattttagataccttatataagtagaatcacccagtatttaaccttctgtaactgccttatttcacttagcatactgtcttccaggtacatgtatgttgtcacatatggcaggatttccttctttttcaaggctgagtaacattctattctctgtgtgtgtgtgtgtgtgtgtgtgtgtgtgtgtgtataacatgccacgttttctttattcatttattgatagatatttaggttgtttccatatcttgactaccgtgaattaagtaaactccaatgatcatgggagtgcagatatcacttctagatctaaatctttgacatcttgacttcaattcctttgggcacagatttctatgaagatttcttttttctttttctttttctttttttttttttttgagacgagtctcacactggcacccaggctggagttcagtggcaccatcttggatcactgcaagctctgcctcctgggttcaccctttctactgcctcagcctcctgagtagctgggactacaggcgcctgccaccatgcccggcaaattttctgtatttttagtagagacgggttttaccgtgttaagcaggatggtctcgatctcctgacctcgtgatccgcccgcctcagcctcccaaagtgctgggattacaggcgtgagccacagcaccaggccttctatgaagatttataagttgctcagtttttatttctggtgtgtgtgtgtgtgtgtgtgtgtgtgtgtgtgtatgtgtgtatgtgtgtgtgttttaattttaaaaaccctgtcatatttaggatatacctcgtgatgagtgtgatcagcactaattgtcactctgttatactaaaagctctttccgtagtgtgtcttcattgcaagcatccattgtgtatggaatcctgaatacagttatttgaatgtctgagtattaaacaattaactgtctttacagaatgtcctccggggaacatagtttttccttagggacccttgggatctctaaccgcttaaaatctagaagctcttatgtgataggatgggaaattaaaaaataaatctctactatatgttaggatgtccatactgcatatagctccttaagataatggactatgattctatcttgtctctgcgcccagtacatggcacatttcagggtgtcacagatttcctaggattaaaatgcttagtaaatatatgaatgaattctaattttagtttctttatctggcaccttttcttgtactttctgagcaataagaagtaggtatctgggtttctagtagatttatgccatataattaagaaatattgatttaataatttttgtgtcctgtgaactttatttaatcattagctaataagatttattgagcatcttgcagttctgtagccctgtgcttgatggtgttagctccttagcacgtaattgttttgactagaatggtaatttaaggtaatttgatatacaaaatggagtgctatgtatggcaaagttgagagggggtgaggagaatataacttcaaacctgtttgaaaactcatcaagtaatatttttcttactttaaatgtgctttggcctcctttgtgtgcaagcaatagagacctatttaggctcctttaactactgggggtttatcaaaaggtgaaatatagaaataaagagacgagaaatactgtccacatgggagattctgatgtgaattctgggaaagctgcacaagtgtggcacacctggacctcacctagatggagggtggttcgaaactagaaggtcctttgtgacttttgtctgatgaggagtcctagcagtttgaggatccagttttcatagttacatagttaatttagtttaatgacttattctgtctttttcatctttgtggtttgcgtttttctcctttctcaatgaattgctagctctcttctcaagagaagcctggattgcttaagttaccatcttcccacctttgtgggcagtgcccttgctggagtccacctgataccctgtggatcagctgccctttgtcgggttcccatcacagccccaatgtgctgtgggtgaaggggtggccagggtgttgagagagagccaagtccatcagagaactttcagaagtaccttgctgtgaatcatccttcacagcctagtgggtgccgctcctcccttttattcaattttttaataaactcaatatttgatcaaattaagtggagggagggaggatggaataacatgctcctgatataatggaaaattcaggctcattgaacttgtgtgatgtgccacaatccttttagaacaagaccgtgattgaaactagtctcttttctctattacttttttgattgttttaaaaaaaatcaagaatatttctaaaatataaaaaaaattacaggagagataatttgagtatcttcactttttacactcctgccaagaatgccccacaaccccacccattacagaaggatcagattccatattggaaatatatgccaatttcaatttagctgctcagtaccaagaattcttgcacctatgagatgctaaaggtttgaactaaatggagccacattcatcattgttgtagaaatctgccagtgtttaaaaggtgctacagggaacctttaagtcatgcaccaaattaaaagattgcaagctccactggtgtagtcaaaagcaagctcaaagctgagtggcatcaaaccaagagtagaagataacttgttactgaattttgttcttcctctgaatgccactctttcaagcagagcgaggaaaatatgaattttgtgttgttaaaagatgtttatttccacaccctaatttatgtttcaaactgcaggcttttgcagagagtgtttctctgaaacttttaaagaaagtgacatgttactacatgggaagaaaagatagagcctggttggtaatgattatacagtcagggctttatctgcttgcagataatttgtggcttatttttaaccgtctgccagtttcttttctcattgttacatttacctgctgattgcaaccctgagccaatcagtcactggtgagcatttggtgaattctacttttttaaactggccaaaagaaaacacatatttccagaatggacacagtgatactagctaatatttattgaatacttattatgcagtagattcaatattttaaatttaacatttacagaaacctcaccatagcaagaattatcattactgttttactgatgaatagggtgaggcttagaaaggtaagtaacttgtcaaggtcttaaaggtagtcaatgtcagaggcagggcttggatccaggggaaacctggtcaattttaatcctgcactgagaggtgatcacaatctgaagactgtgatcgacactaagacagattttgtcaaacaagctggtatcatgaggaagtcagtttggatgatgatggtatcccataacatgtctcaagaagaacttaggatgtttagcttatggtggtgtaaattcagtgcaaggggatgtaataggtgtcttcatttacatgaaacaatttcaagcgaaagatgacttagatctgctttgcatttgcacaggggtgagatgtaagacatattaaagaaaaccataaagagccaactgaatgaaatgattcatcaataaatgtgtttcctcaacgtatagtgagtgtcctatcaatggaaactttaacaaaggagctagattttggttttacaggactcttagatctatggattaagatgtgtctgtaatattagatgtatcttagagaataattatccaaaatatacttcatggaacatggaggaactacagactaacattttctatggtaaaatatttgggaaatgcttcattttttctttcataatatattaacacgttaaaggccaaatcaactatttaggaaaagaaaataaaacaaaatttcaccaactttatgaagctaacatttcctgagctttaacatttttcatttgttattattttttgatactaggaaagccttcttgtgatactattaagatcccatagaacattgcaaatgcttgtccaaacctgcaaaaaaaaaaaaaaaaaaaagcgcacatcatgtgcagagacttcccatgggcattgggtgcagctatttgtaatgagaaacaaaataactgttggcttccgtagtggacttgtgagaaccagtagttttgcatggtgcagggatagataagaaagttgttttcgatatgctattttggattctctcactctaggaaataatcaagtgttgatggtattaaatttcctttagcatacatgcaaagagggcatgtttatagactttgacttgaacttcttctaacaggccttattttccctgagtatgtttctacttacttaaaaacagatgctctctgaaaaattcatgaaaaccaaaaatatgctggagactttggagagaagctcttcaccctgttattaaagttagattgtttctaacaatttttttttgcatcttctgcttggcagttaacttcatgaccttgaacaacctttctggctttcctgtaactcagtttccttcatttacctacctacttaaccagattgtacataaaaatacatagtatatatataaatggttatattaacagatagatcctttcaaacacacttatattggtggctttgttaatgaatattgcatttgtggcagatagacatgtttccttaaatgaaggttttcaaaactggcattgtaagtaaattttacatattatcagttgcttgcacccaaaactatttctactgtgaactggaatacatcttaagaaattattttaaaagatgtaaataactagtggtaaagtgatagagcacatcataactttcttcattatcataagtaatgtggctttgtccatatgttattctcatttgaattataattcttatttttattgtatgggggtttgcacacttttgtcctcaacttttcttgtttattttaaaaagggagtctcaggatttttcttctgaagttaaaatttaaccctaaagaaagatgccacagtagtttagtctgcttttctggagctctgaaccattgagggccagaactgacactataagcaggagcagcagtcccaagatgggattctaatatcaacctttgttttatctgattcactatgagtaagaggatacaatatgagtgaacagcaaacctgtgagaaacctacaagtataaaaccaatggtatttaattcaggtaataaaatagaattcttaaacaccctctaaattaaaaagccagaagatgcagttctaattacatgccttaactagaagtaggatatttgcagcttatcaagttttatgtaaatttgttcctttggcacaatttgcctatataagcagtattagttcagtataaaatgtttattagttattgaaactggctctagtgtaatttctgtgttttaatacatagtcccaagttttgtgggatccctagagagaactgtgtggtgtctatgttttgaataaacaggttttttgaataatagtaacttacatatctatagtctcttatctgaagcccttggggtcaaaagtagtttagaattttagattttagaacggtagtatgctactagtgctgtgtgctatgtgacattccaatagaatcttgggcaatggccaagcatgttgacatttcttagtgcttgaatgggataaagatcataaagagcatctttttcagctgaggtcaggttgggctgacagtgtgtttggttttccagagcgttttgcatattggaactgcagataagggattatggacctgtaatattaaatataatagctgacatgtattgtgtttattccaagccagacatggtactttacttgtattatctcatttaatctttgcaactctttgaagaaggtgatagtattaattttgttttacagatgaggaagagtttcagagaagttaagaaacttgcctaaggatacatacacctagtaagaaagtggtagagttacatctcaactaagtcgaattagacaccaaatctggtgtgcacaataactagttatcctcctcgtattcagtgtctctgatttgcagcccatagactcagtcttacatcaacataaagggaattaatacgaagggtatcaggtgatggagtatcaggcccaggggataattgggggaaagaatgagtctcagtagcaacacttctttgatagtctttcttggccatttccattagaataaatatacttctagtagcagtaagattcagatgagagagaatacttgagcttgtgttgctgttagctagggtaaagtggggtgtcacaaatccagcatgatggagcagtgttcctaaaggaaaattgattgctgtcagcaaaagatgtgattcacgtgagacagcacactcatgtaaaatgtccactgtatggatgattaattaattgcagatgaaactaacatttggatgaaaaccccagttagttttttaagtataatccattttaagtttaccacctgcttgataccagcaaaacagttaacttatcatcttgaatactcagattcctgtggcagttcagacactttctaggtcttggatctcagatctagaatcagtgagcttttttcttatttgtaatctgagagcaacagtacatctcccaatttacctagtgggcattgtgttagctaagatagcccaaagagcttctggaagttcataccctatgtgttcatatttctcatgctgattctgtgttgttcttgtataaccagcagatgcagtaggggagatcctgcataacttctgtggccaagtcataaggagccttgcagtgtccaccttattttcttggcatcttcactctaggggaagctactgccatgtaagaagtctgatcattatgctgtgaggaagtccaagctaaccacgtggagaaagatcaattcctggccagccagctgctattctagctctcccagctagtgtgccagacatgtaaattaccttggacatccccacccaaccgaaccattagttcatttcagtctaaagtgccatctgactgaaatggcatgaacgataccaagggacaactgcccagctgagcccagaccactcacagaaacacgaggggcaataatccacggtaataagtcactaggtttccccgtagtttgttatccaatagcagatatccagaaacaggtttgctgtgaagaagagagataatgtgttatattcctcaaatgaaggtgagcagctgttttattataattgctttgacaatccagaaagcaaggtctttctaatatcctcagaggtttcattacaatttgccattgtgatgaggatagtgatcatgctgtactctctggacagggatggagagtgttagtgattggccagcatccaagattgtcatcatttttccttagtgcaggagtttaaaacattctgccattttctcactcgtatttatattttcacaatgaatggggttttctctaataagattactgtcataaagtctcttatttaaaacttctgatggatcctcattgtggatgacagggcccatttctctgtttttgtagactgtccctctgtccagaaactacaggggaaataagatgtagattttgaaaaagtgacagcgagtcaaagaacagttggtcaaacagcttcccagcagttgggacaggctgccagagtgaatgtcaaagagaagttggttcttggatggttttacagaaaaacaagacaatgaaacaaagaaataagaaataagtaggaggcatgcagagggacaaaaatgaaggacttgatattaggacaccagagcaatcagtagtaggttggataggaggagttgagaagagggaggaggaagcaactaagggttggttggaacttcaacacttaatgggttcactccctcctgtctgtaattaattctagctttagttacttcattttctccttagaggaagataaagtgacctggactatcttctttatgttatagttgtttagaatcaaagggcattttcttaaagtctcttttcccaagtaattcttaagatttcttaagtgtcattgtctcttcaggtggagtcataaaatgcatctctatgaggggcaataaaatgcatggaggtgccttttatggctgttgctagcagaggactagaataagataatgatggtattttgcaaatagtgataaggagcaaattgcacattccaatgtcaatctgttctcaaaagagtatagttcaaagtttctacaaagctttttgaaagcttttcttttttgaaatgagtctctgatttctgtttttcctagctatacatagattttattttggggaaaattttaggtagtaacattatccttaatatttactgatttgctgtagaattttaaactggacaaatgaaagcccttgaggaagagaaatttatattctaacatagcgaaataaatatatgtcttgcaacttgaattgttgttaggaaattacttgtatgcctgagttcatgaattatttaatttaagattattttcctttttctaatttatcactggctaggtcctttaacaatcttttgatttattaagagtcattttccagaattagatttaaagctctattgttttcttatgattttcctatgaaaattgagtatgtctcctataaaagctatatttctcttgtttgacttatttcatttctctattatgaaaggcaatcattttaaaactgatgaaattttaaaaaattgacctaatctgaaaaaaccagcccatttcatgatccttcttcacttattggaaaagactatggagtcaggagttggggaatgtaccgacctccattaagaggtaaatgacttgcttgtgtctagaagcgtttgtgtcatttgcctctcagtgcttgctgcagttttaaggaaattgtcctcctattaaggttatgtatcagaatcacccttgaaactttttattaataaagattctctgtccccacaatgaggtttattaaatcagaatctccagggcactggtgtgctgaacgagtctcctaggtgatttgaattcgtaccccagtctgcatctgaaaactgccgcttttcaaagagaggcagacaggttgatggatgataggatccagtctgacacatggaaaagctacaaggagggagcatggaggaatccttcatttagggagacatgagtattgtgaatgatggtgtaatcactgctaaaaatttctcgggtttctaagaaagttttatgtcctcagttttcttgatggtgtctccagccaagctgtaatgcagtggttcccaactaggggcatcttggtctccaggggctatttgacaatggctggtcctatttttggttgtgataactaaggggatgccgctggcatctagtgattagaggccagggatgctgctgaacaccctcagtgcaaggggagccctgtgttagtcagaattctccagagaaacagaacatatatgatggcccagcttatgcggcagtcatgtgggagttttctcttactcagctttttgtcctcttttgatctccaattgattgggtgaggacctcccacattatggagggcaatctgctttacttagtctggagattcaaatgttaacctcatccaaaatatcctcacagacacacccagaagtacatttgaccaaatgtctacacaacctgtggcccagtcaagttgatatataaaattgaccatcacagccccttacaacaaagagttatcaggcccaaaatgtcagtagtatcaaggctgggaaaccctgatctagtgaagtgcagtgaaattctcaaaataaaaatattctaggggccagcattgaaaaggatgtggcagggccaggtaggagagcattagagatggcctgtgtggaccttgaggaagccagatgagataaagaggaggagagggcatgaacataggataaaagctcgagacaggaagagatggggttaaaatgaacatcaggtacttgaaaagagggatgttcatcaggtgttatttttcctagcagtgttatgtaaaatacgagtactatctgaaagtctgaaaaaggtagggccaatttaacatcagctttaagatagtaaatctctattctgtaagatgtaatggtagtttttaagccttgaaaattggaaatgttagacaatggtagcatatgtgagccagagagaatttgatggtaaatttgtagtacagaactttagacttgtttttaccaggaagaagcatcagagaaacagtgagagtaatcagcgcatatttgttgtatttccgaggctggtaatggagctaaagtgtgggggcagagctttttgtttgggaaagtgtggaaatggggctggtcaatgcagatgaaggggtgctatgggaaccttatgatgtaaaatacactctctcattgtcttcacaagtgtagctctaattgcctgacctatgtgcagatttgttgttcagaacaaatggggttaccataagtatggaaaatggttcctggtctacagcgaattggagagactagagaggcaagccagtgctcttaaatagcagtgacccatctaagttcatttttcatcacccttctggtaaatacttcctaattttctctaggggatgtgctttccccatgtttgatctgtttttttctgagaggtgtttggttcatcctggttgtagggttgggtttgtgatataggcatagcctctcagaggcatttggccataagtcttatctgggtatgggctcatgaccccaggtcaatctagtcagatctgctgatgttaattctgaggctcttttctttccttacttttgtatttggaggtgtaaggatgtaatcccacgttcttggtcataatcttgtcatactatagaaagggactttttcaaaatgtagttaattcaaggaagaccagagttgagagaccttatatcatttgtgctcctggatgaagctgtacctgaagctaggttgtcccagaattctgttagtaaactattaaatttcttttttggttatactagtttgtgttgtttctttcactaatgactgaacaaattactaaaagatacactgaattattaggagaaactgtccaattagtaagtgatatagccaactaataactaattaattaatgtttcatactccagtatttgggctctgtgtatatattggtgatattcttccattcttgtttgtttgtgttttggagagtttgacaaaaatgcataggctatctctggtaatgcttggtttaaagcatatttcatattcagaaagatgttgtatttgagaagcgacgtggtaattggttttgagagtatacatcttagacaattaaatggttacattgcttccttccttggtttaaaaaaaaaaaaagaaatccaagggtattccagttgtataaatagggacaacacagtttatgctatttgtaattacagataccactcaaaagaattgattccgtttacttttgtattagtgtactgtggaaagtcgttaattataatgtctgttcttatccaacaacatgcaataagtaaagatgaaaatatagagattattagtttgaataactggttgcatgccatccggttttatatgattgctgaaatgcaaaacaaacaacccctccccccgaagaaaacaacccaccgttcttaaataagacatttgtgacataacaaattagaatctaggagaaggaaaatattttcccagtatctaaagccattgaatcaaaataatcgtgtagatcacactttagttcagatataacctaaataaattctctagccagggcacccatctgtcaaaaaataaaactctggccctcatttaaaatggctcctttagactgaggtcatctagctgtatctaaattggacatgaaatgtcaatttcataccttatagtggcacatttcatattgctctacttaaggttatgtcagctttacccataaaatgcaagtgatttaggtcttattctaaatgaactaaccagatacatcagcaatgggcactgccttgccactgcagaaaaagggaatgtgtgaagggaagacagaaaccacttattctgtttcttaactctggaagtataggtattccaggttgggatgtcttgtctatattttcattccttgtgaatgataatttgggggtggggggattagaaagatgctttattcaaaatgaattgtattgcctgcaggcgattcacttgcttaagttatatttgtgagttattgtatgtaactttatcacattggaaagtttatgaaccttgtgtagaaaaaagattgcattttgggagctatgcacatcatggctttttcacaagtgacagaaaagtgctgcagatgatttaagcaggaagaaatgaatttttcgaaagattttgagtccagaagggagatagggcagtcagtcttggaagatgaaaaggacaaagccaaagcgggccaggcaggcaagggagtagtgttgtgaacgccctaccccacccctactgcatctgagtgttgcaactgcctgtgttgccactatgtaaacactgctccttaatatctgcttccttggatccgaattcagagccctggggacagtgcatctcattggctgagcatgtatcagccattggtaaccaagctgcaaagaggctgggaaagtaagtagtcggctctttcagcttctagctggaatgtgatcacctcccaatattcttcttcttctttttttttttttttttcgagacggagtctcgctctgttgctcaggctgaagtgcagtggcacgatctcagctcactgcaacctccacttcccgggttcaagtgattctcctgcctcagctccctagttactgggactacaggcgcccgccatcacgcctggctaatttttgtgtttttttactagggacggggtttcaccatgttggccaggctggtcttgaactcctgacctcaagtgatccacctgccttggcctcccaaagtgccgggattacaggtgtgagctaccgtgcccagccccagtatgtcttcttatagtggggggtatctaaaaacaggaagaagtttcagatgcttggcagctgacatggctaattttaggtcaacttgactgtatcatggggtgcctggataaaacattgtttctgggtgtttctgtgaaggtgtgttaggttgagatcaccactagaataaatggacttagtaaagcagattgtgagtggtcatcatccaattcactgagggcatgaatagaacaaaaataccgaaggggaaaaattaagaatttgtccctttctcttcctgcctgctggttgagctgggacattggtcctctcctgccctggaactggtatttataccatttcctggttatcaggccttcagacttgaactggaattacaccattagctcttctctggatctccagcttatagatggcagattttggaacttctcagtctccataatcatatgagccaattctttgtaataaattttcttctctctctctctctctgcctatctatccatctagttatctggatatatcgcctatgggttttctttctctggagagctctgactaatagagtagccaaagcaaagacagtttgtatgtgtatggttttatggggagtggattttcaggaaagcaggaaaaagattttttccagggcacttgggtagtgcatcttttttcctctaacaaatgggggagcatgtggccttctgagtactgggtttgcttaatgaatcaggagagccagtgtttataaatattcctttaaatggcagagcgtagatcctggtttgtagtccccttagtatatttgtaatgttttcatcatacccctaggccaaagaaaatactcaacattaagtagttttattcattaggtaggtaggttgaaacaaatgaataagaatttatgtactaacgtaatttgaaaaacatatatatcatttgaaaaaacacacaaattgaaataaaatatttttttcttaaataaccactattgcttactaatgggatatatcctcctgttgggcacagaatgacttcacatacattggaattagattggacactgctacctgattcccatccacattgattttcatgacgcacattttattacagcaatggctatgaacccagctttgcaaagatataacataatgaaaaggaatgtaatgcaatcaaatattgaaactgccaactacctcgagctatcctgacagttgagcatagcttgggagtggtagacatagattatcactgaaattctaatgtgagcctgatggcaacttgagttgaagggcattcttgcaagactgcttggttggggagtgtcacaccagctggatgtttccagaaccaagggcctgggaaaaactatgccagtgtgcacagtgcacactcttcctcagtgtagccactctgcttctgatgtgttttgttgtctaaatcagtcagcaacctatcacagatgtgtgcatcttttcctaccaatccacaaaacccacctgatacggtttgtctgtgtacccacccaaatttaatcttgaattgtaatccctataattcccacctgtcatggggggcacccagtgggaggtgattgaatcatggacacaggtctttactgtgccgttcttgtcatagcaaatgcgtctcacaggatctgatggctttataaagaggagttcccctgcacaagccctcttgcctgccgccatgtaagatgtgcctttgcttctcctttgccttccaccatgcttgtgaggactccccagccatgtggaactgagagtccattaaacctctttttctttataaattacccagcctcaggtatgtctttattagcagtgtgagaacagactaatacaccacctgaaataatgtaccccttaaaatccttatttatggattgatgagaaaacagagctttcattttatatgattaacagaagataagtgcctctgttgcccagatcagactgtcttagttcattcaggctgctataacaagttaccattttctgggtagctcctaaacaacagaaatttatttcttacaattctagggtcttggaagtccaagatcacggcaacctcagacacttttggtgagggcccacttcctggttcatagatgggccttcttgctatgttctcacatgggtataggaggtaacagagctctctgcagcctcttttataagggcgctaaccccattcatgtcctaattacctcccccaaagccccaactcctaatagcatcaccttgggtattaggatttcaagatatgaattttgggggaacataaacattcagaccatagcataggccaattaagaactaggtatatgtaaaagcatggctccttttttggtacaaagctggtgtatgcctcaaaatttatattttgcactcagaaaaattcttccttttattccctgaactgcttgttcatgtgatctctacttctgtatgtccaggtctttgatatgtgtatgagttgactgtttcattgtgtcggaacatcttttgattgtgtcaagagttccagcttcttttctttaaagatcctgttttataatctgccagcctgaccacactcagcatacagtcttcaaagttacaggttatgtgaaactttcaaatgagatattacttactcctgttcttcagctggaatatcagttgctgggggagctggagaaacaattcccaaaatgaagagcaccttagcatttctacaatgttgtcattgcagggtattgtgataggcagaatgctggccctgccccaaagatgccagtgtcctaatctctagaacctctgaatatgctacctcacatggcaaaagggactctgccaatatgatgaaggtaaggatcttaaaatgaggaaaaaattctggattatcctagtggacctaatattttataagtgtacttgtaaatgaaagagaggggcaggagttgtgattatgtgattgctggctttgaagatgaaagaggaccataagccaaggatcaaggtcagtccctagaaactggaaaagccaagaaaacagactctctgatagaccctccaaaaggaacaggaaggaagccctgcccagtcttaattgtagcccagtgagacccattttagacttctgatttccagaactgtaagatagtaaatgtatattgctttaaattactacatttgtggcaatttgtcacatcagtagtaggaaatgaatacagctataaagtggaagaaaccatagaaagttcactgagccttttgagattaatctttaactcatattctaaaatcatatagctccctgagtgtcaaactgataactacataatcacactttcactgttctcaggtttactacaagcagaattaccccatactggtgttcaggcagatgaattctcactatgaaatactttttaattggcgttcttatgattgcctccaaaatgtttaaaccttttgacagttgcatccattttatgaatccatcttcagtaataaagattgaaatgctctaaaccaccaaaaattagtggcttaatcagaaactgagggtggttctataaatccaaagctgctggtcattagacctcactaccatcattatgtatttcttcatcctgatgcatctcacattcattttttgacacgttaatgatttctgtcgtaggcatattaactgtccacatgtaaatgtgatggacactgctttggtttagcatggggctatttcgattggtcatacagccaaagaaggaagtaaaggatgtaaacagtgtgggtgcttatatttttttccaatatttgtggaagcatctgtttctacatatgactggcacaaatgatatctttttgtaaaatatttcataatttctccaaaatataccagctttctggttttgtttttagagctagagactttgtctgctctcctgactttttgatattctttctttcctttttttttctttcttttttttttaaagatggcatctcattctgtcgcccaggctggagtgcaatggcatgatctcagctcactgcaacctcacctcccaggttcaagagattctcctgcctcagcctccccaatagctgggattacaggtgcccgccatcatgcctggctaattttgtatttttagtagagatgggctggtctcgacgtcctgactgcaagtgatctgcccgcctcggcctcccaaactgctgggattagaggcgcaagccactgtgcctggctgatatgctttcatttttcactccctttttaatcttcccctccattaccagttaacaaactactacagctgcctctgcaaatgatagaagaacaaaaattaggaggagagggggctggaggaggagaagaaagaagcagagaaggagaaggacttcatagaaactacggctgctttcaggcatataatgtgagatcttgagagagaattaaggagtgaatttccacgtaactttcaaagattgtaaataggctgcctctattttttgcaattgccaggcaatgacagtgtactttacttctactctcctctgaaggagcaaaatgagtgctctatggccttaacctctatttctctcttaactggattcaaacgtatgtcatgctttgagccttcattacgtaagcgatttttctcaaggtcactgggagcaccacgttcactgcctctggatggttcactgtactgccgtgcagccttgctgaccatttcatgatttggggttcatgttcattttatagactggatttttttctgttttacgtttcccattttctttgttacttagaattaaccatgaccagatcaattaataaaatagttcaggttgtcttattctatttgtgcatttggtttgcagttaccttcacaaatattctggtggctaatgaagttaaaccaaagtttgtcaatctgattttacataagctgtgtgccaaaactgtgttaggttcaataatgctcattttcttgtttaattttcacaacaactaagaatattatcagattcatattctccttagataattaataattaatcacattattattctcctgagaaggaggtgatactattctcgatttagacataaagaatcttaggctcagagaatcaccagcagattgtaattttgagcctagatcatcaatgtctaaattcttgctcctcttattataccattctactaatttatcaatgataaatatttgttaaatgcatgttgtgtgctaggcattgcaccctgttctttatttacaaacatatgagttattattatctctgatttgtagatgaagaaattgagtttagagttaaatgattgcccaggattatgttgttacaagtgcagaatcagtaatcaaattgctgtgctgtgtcctccagggcctgagttcctacattgccatgagccattaaaggtaagatgctaattaaaggtatccatgactaattttaatggctaacacaagtttggtgaaattgatttaccataatattttggttactttttagggctactcagatacacatacttgaactgtaacagcaaatagtgagaggggaagtaaagattctgagcctcctttctgggtttacagcaatattttgaactaagaagatgaagtagaattagacatgagcaaagctccatccctttcttctgcaggtgagaaagaaatagagggtgtaggaggtaagcatacctacctagtaagccttcatgatttaggtatctggagcaggtgggactggagcaattgccatgaagttcacaattttagtgtggcctgtgatctgtttctttggctacagcttacatatcaggcctggggatttttctggattctgaaggttctagcttccagccttgaaattattctcctacttgtaggtcagtaaaacaagcgtttctttacttgaaagttttaagtcgacagttgccatgataaatcactcccactgatagtgttttagactttgttggttctaccttacgggattttcatagagtttctaaaagagaaagacaagcactagagtgaagaattgttcttattgtggaagaatcatcaaccttggctggacacacagatcaaggggttcagggatgggtggcaaaggatcattgagagggttacatgtgacccttgcctaactatagtagttaattcaactctgcctacacaatgacacggattaccgaggatatgacttgtattatactcatccctctgaccccacatcctaatgttaataatgattcttaaacctggaattgagaactcaaatataaaccagtgcccagcacatagcaagtcatcaattaagtttattgaattaaattaaatattggaattgtatctgtcaaagccatatcagctctaagcttcttaagagaaaaatctgcccagaatttctcaggagggatttctcaacatcgaagctgtcctgttcatattggatttattgtacttacataaacaggaatacacgagcagggaagatcagatcagttaccacaataagggttttgtaccatgatatacatcattttcgctcccctaggaaagcactgctgatgaaaacaattttggagggaggtggtctcaacagagtagatgttcaggtggaggttatctctggtgctctgggcttcttattcataattttctcttatgaaagagagtggttttcaacttcacaattcctttgctcatttggaaatatagtagcagaaagatgaagagagtttgtgacccacaactaaagtctgtgttctcttgtcacttcatcaaattagttctggtggcatttggttcccccccagaaataaatcactgttaaatgattctttataaagcagtccacacatttatcataccacagtgatctgaacccatttagggaattataagctacagttggtcatgttgcaggcctagcaactctggccttgtcacattgcatctctctccactccctgtgctaccactaatccttcaggactgagattcaaggctttgctagtaagaggcttggaaataatcatataaaacataatagtgtggcaaggtgagatcgagcttttaatttttttaagttcacagagagcaagaagacagataggaaaggaccggcagattgggaaaaatcaggaataagatgaaatatcctcagaactttagcttttatgattccacctcacattcagtttaattatgaaatttactggcagtgacaattggcttttggcataaattaatcatgccaagcattatacatgaaatgaaatttcaatcctatttgttgaacattttctaagagcttggcaatcttgcccagcactttacgtagggtttctccttatctaccttatgaaatatgttattattattcccacttttaatatgagaatatttggggattagaaggcttaagtaatttgacaaaggtcatatgggctagcataatagactagaaaacaaactcaggatgctgtaattactacactggaatcattcttagttttttttttttaaatgaagttggcattagttttgttttttaatctttaatacttttatctgagaattgataattaaccattttaagaaaatagttacataaatttagaaatcatttggaaaacaggtaaaattgctacattatttcaatttattttatttttaaaataaatgatattttttatctatatttgagggctatatgagaacctaagacttctattgatgttaattattgacttttatttactgtagttttagtgaataatttaattgacttctattaattcagtcatcatatgctaaacctagagtaactgctgttaatatttttttttttagctactacaaattgaagtatttttgattagagtaaaatttatttctaaaggtaacctgagtaatatctctatgttgtagatagatattactatctatagtaatatctatgcatatagtatctatgtagtagctttccaatttattttgctattatctaaaataagaaatacattttatattgttccagtaaatgcacacatataaacacatatatatgaaattgatacttcataaaatattagttacccttattataatcagtgctcacttgatattttacattttatcccattgtaaaatagatactggtcatgactcacagtattgatttcataactccctaatggttgtagcctgcagtttatcatttgttcaaatgtagtgtggtgggaaagaaagatgatatgactcttcagacagagaggtctggtccctaccctgatatgtgtcagttatatgtcaccttacctataaaatggtgattatcagtacttctcaggggagttgtaaagcctggtacctagtagataattagtaaatatcagtttcttttgtctttagagctcacacttcattccatagttttttgttgttgttttgttttgtttttttgagacggaggctcactctgtcgcccaggctggagtgcagtcgtgatcttggctcattgcaacctctgcctcctgggttcaagcgattctcctgcctcagcctcccgagtagctggaactataggcactcaccaccatgcccagctaatttttgtatttttagtagagatggggtttcatcatattggccaggatggtcttgatctcttgacctcgtgatccacccaccttggcctcccaaagtgctgggattataggagtgagccactgtgcctggcctcattccatagtattatagaaaatgtcgaactgtttaagcattccagcactttattttttaattgttattatttttctaccctcagcatgcatcagaggagcattccagccctttagtttggattttcttgctatttctgattttaactatgtgtgttcttcatatcttggactaaaaaataaaaacaaattaaaaatagcaaaaaaaaaaatttgcagtaattttaacagaccaacattaagtactctggaagccagaccagaagctaggggctcgttaatttttatgtatcatcaatggaaatgacttttatttgttaattattttttatgaccacctattgtaacatcttccaacacatatttccccctctttcccgtcctccactctttaaccttccttgcccattttttgtagagatgccagtgaggtctttctcagtcagtgcttcaatcccattatttcccatctcaacaggcttcactggctcaccattatctttcatattagtcacaggctcctcagcctgaattgaggcctttatgacacaattctagtctacctttggagatgtgcttcctttcagtgtcctctctgtatttcatacttactgctttgatcagacaagatggcctgtctttttccaaatggatctcacaatttccaggctctgtgtatttgcttatgttgtatcctctacctagaagtcttttctcctggtccatctgtcctcattaaaaactccactcctgttttcaaattccttgtctgtttcatcgtgactcttctaattgattctctttcactcccacactacttctattgatgttgatttctctgaagctggctcctagtgccttttttcttcttaaggcatgatagtgtgtctcaagttggaatgatttcatggctcccatatggttgattggttgtgggactttatcgctaatgataattcagaaaatagtagtaggactaattgcaattctgcagatttcaccttaaacatatgctgcttcttgggctgtggaagttggacacattgagataagattattcagaaaaacagcaaggccgggcgcagtggctccctcccataatctcagcactttgggaggcctaggtgagagggtcgcttgagcccaggagtttgagagtagcctgggcattataggggtaccctgtctctacagaaaataaaaaaaaaaaattagccttggtggtgtgtgcctgtagtcccagctactcagatggccggggtagaaatcacttgagctcagaagacacaggttgcagtgagctgagattgcaccactgcacttcagcctgggtgacagagcgagcccctgtctcaaaaaaaaaaagaaaagaaaagaaaaaaatattagtaggtctaactgtaattttctaacttctggttttaaatatacactgtttcttgggcagtgacagtagggtaaaattacccagtttgtgtaaatcttatgaggcttgataaatggacttaataattatcagatgacgaaattaaatgagtcggtgaatgttaatgcgtccctccttccatgtaactagatgccttgggacagttccaatatgtggcatttatattgtattatgatgtgttaataatgtggatcagagacaagcaaaagtcaaggataaatgtaatttcctgtgaaatgtatatttaatactttttaacatttagcggaattacctttggatgtcaattgaacattacatccccttactaccgtgactgtgtgtgtgtgtgtgtgtgtgtgtgtgttgggggggtggtgtctaaggagtaaatctattctcttactgcaatttcaaacactgaagtattataaactttctttaattgtatcgagttttatatattttgttgattctaagagtttttgtgtatgtgtgtgatatcagtgaatcaggcaaatttcccagtgtgtgaagcttttgggtcagctattaggttattacatcatttcagaaatgctccgtctgccttctggtggccttcagatttggccaagtagtggagtagtgcaaagactgctaatattgtagaaatcccgtgaccatacgcagtggtttttattttgttctaaggggtacacacttccatttgtctgttttcatgcggagcacatttatatgagggtaagttcaatggcaacttttagtctgtagagggatacgttgagaaatatgttactgaccataaattaccaatttgagatgaatgcatacttcagaggccccactagctcacatttttactgctgtcccctaaaagcaccttcaggtttatatgctgaagatggagaccttcatagttagaaaattgcattccctcaggccacaggaaatattgcttgacattctgtaacactatttgatgttcttaaaacagcatgctatgtagatactactctaggtcatgtctaattttttaatctgtatttataaatactatgaagcttgtggtttttaagaatagtaatgtttacatttatataatttgatgcaatgacttttccctgtaatataaaattaatttaatgtttagtataaaggaaataaccaggttgtatagttgtaggttgtgcaactacaggttgtgtagttgcaggttgtgtagttgacttgtgtattttcacttcctcatactgacaacataaccagaggcctgaccaatgctggtgaaataaccaaaaaggttgtcaggcagacctttgcgttttaatgcaaattcaacagggaatggggtgggcatagcttttttttttttttctgtattatatcaagtaagctgaatatatgcaaggttagagtttaaatgtaatgattagttttattcatatacatttaaaatctaatattctacaagatgcttagcaccatacttgacacattgtgagcattcagtaaactgatgttatcctttaagaagcatttaccacagaggttaagagcatatgctctagagcaaagttgcctaaactatttctgcctctgtttcatcatttctaatatagggatagatcatttagttcatagaacactgttaaatccatataaagcatctataacagtgtttttaataagtaaaaaaaagtcagctaaatattagttgtttattaattgtaatatatcctaaagcaacttatttcttaacgtagacttctgcacattcttggaaaattaatatctctttttttccttgcaatttttttggatatttgaaactataagtatcttcacccagttgtaggacatatgtttttctattttcttcccccttgttggagaaatctatttctacgggacaagctggttatttgtctacagatcctcccctggggattctgtagcagctacttcaaagctatctcagcttgcacttaatcatttgaaacatcagataacttgcttgttcattttatgcatgttttcttattgaggaaattagtcaacctaaaatgagcaccagaagattatttttcttggttttactcttaaagtcattctcaagcatgttatcttggaagagcagggcactctcctgcagcttttaaggatgactgaactggagaacattctgtttaaccacaaaactcatgttccctctgtttaatttcttaaagcttgccctcccttcaatgcaattaccatttttcttacacattaagaggacaaaatttgttggcttcctctttgggggaggatgtttatttatttagaagatactttttgagttcctactggtccaccgggaactatcgtaagtaagttgaggatacagggatgagcaaaatggacaaattctttgttctcatggaccccacaggagaagaaagacaatagctagtaagcaagtaatacatttttttagacagctaatttttgtatttttagtagagatggggttttgccatgttggccgggctggtctggaactcctgacctcaagtgatccgcccacctcagcctcccaaagtgccgggattacaggcatgagccacttcgcctggccaacaagtaaatatttttgactatgtggaaatatgatgaagaaaatgatgaataggaaaatgggactaagaggcaagaagggcgaagcatctatgaggaagtggtatgtggacagagatttgaatgctgacagggaggcagctaagagactctctgaacaaagaagtatccaggcagaaggaacagcatgggccagggctctggggccaaaacaagctcagtctggctgagaaagggaataaatgactgaacacatttctgtagccttctatgttccaggtgctatccaaggtgcttgggatacgtcagccaacatatttgcaatgttttgcatagttgtcctctccaaaactcatgtcgaaatttaatccccagtgtagcagaattgagaattggggcctttaagaggtgattagaccctgagggatctgccctcaagaatggattcatccactcatggattaatggattaatgactaatggactaatgagttgtcatgaaagtgggactggtggctttataagaagaggaaaacagacctgagctaggacactcagtcatgtgacagcctgtgccaccttgggaccctgctgagagtccccaccagcaagaaggccctcaccagatgtggcttctttattttggacttctcagccttcataactgtaagaaataaatttcttttctttatgaattacccagtttcagtttattttgttaacagcaacaggctaagacaataatgcatgattttttctaagtaaattatgtacaatattaactgatcagtgttttaaaaaaatgtttgtatgcagggaggtaagagtgcaggaataggtgggctacagtgtaaaacactgaggtcaaggtaggtctcatagagcaggtggcatttaaacaaagtattgaaggagacggggcaagtttgtcagatgggtatgtgggagaaggaattaccaggcacaggtaatagctagtacaaaagccgtaaggtagcagtaggcccagcttgttccaagtgcctcaagaaagcctctgtaactggaacagagtgagtgagatgagtgaggcggagaagaggttagagaagtgataagaggtggcatcaggccagtctttgtaaaccactgtcaggacttccgtttgattgaaacgaggtgccgtctggtaggtagctttggggtctagactggggaggggtggagcaaagttaggagcagggtgacttgttagcagaataatggaataagccatgagccacactctggttgctcttacagggccgtggtagagatgatgggactttgtcagattctgaatatatttagaaggcttcagaagtgaagtatgagagaaagaagaatccaggatgtgactccaagtgttttgtcctgaaaaaatagaagattgagatgggaaagactagtgctggaacaggattggatgaggtgaggagtggctgtgtaaagcaggagacacccaccgttcccagggcgtagttctgtatctgccttcctgagttaggcttggcagtacgactggctctggccggtgggtcatgtcgatgtgagacaaaagcagggtacggaaatgtactcccagatcgggctcagcctcttgtgatgcagtcattttcatgagaagagctttcctggggcagacgttgccctcttagcctggaccccaagtgaatgcaagtgacacagagccaccccagctaagcccagctcatcccacatttggaaggagggctgcccatggagcctgctttagattaccagaccctacagaatcaagagaattaatagctactgttgtaagccaatgagtttggaggtggtctgttatgcagaagttttgtggcaatagctcagtaatagagaatccagggagtgaagtgaaatagggagttggatataggagtctggagttgagaagaagtcttggttggagacaaaaatgtaagcgtcattggcataccaatggtatttaaaacctcaaggcaaatgagatcaccatgggagtgaatgtagtagagagggtgaccgaagattgcatgactacatcattacaatgtctggaagaagaggagcaacccatgaggaggaaggaaaatgccctacaaatgaaatggatgaaaacaatatctaggaggaggaagtgacaaatgatgtcaaaggcaactgccaagaattggtcattggatgtggtaacctggggagaattgttgactttgataaatacagttttatgggagtgttggaggtgcaagcctgattagagtgattttaaacacgaatataggcggagagcaactggagatagagagcaaagtaactttttgaggagtttgtgggaaggagacagaaatgaaatgaaacaatggcctcctcacaaaaggagcgcgaaaccatggtaagggtgtactttattctgagcggggaggtagttgaagcgtttaaataatgacctatttgtcttttagatattgctctgactgctgtatagagaatggcgtggggtgaaagggagcagaacagttataaggctatttctgtttcctaggtgagagagtgtgttggcttcagctgtagccctggaaatgtggaaagtcatgtgtaaatttcacatggggtaatggtattaggtagacagcagtgtgggatctttagcttaaggaacttaaaaaagtgtttgtgatcaaatgaaaaatcacaaatgtatatgagaattatgttttgtaacttctctttagctctaccttatcttatataaatcatactggtttgaagcaatatatattggttactttattaaaatttacattctgttatttttttaaataattcctgttgtctatgataaaatggatatgactggccaggcatggtgtctgacgcctgtaatcccagcaatttaggaggccaaggcaggaggatcacttgaggtcaagagttcgagaccagcatggccaacatggtgaaaccccgtctctacaaaaaatacaaacattaaccggatgtggtggtgggcgcctgtaatccccagctactcatgaagctgaggcaggagaattgcttgaacccaggaggtggagattgcagtgagccagtcgtgcctgcactccagcctgggtgacaaagtgacactgtctcaaaaaaaaaaaaaataaaagtggatatggtaatttttctcctttccaaattatattttgttccatcctggatcattcagtctacactggcgtatttcgctcaagtgacattagagatggtttctggcataatatccttgtctgagtctgtgtgcaaaataacttttttaaaaagtggaataagttctatgatctgtagttgggatagggattaaacaacaacagcaaaacagacttttacttccttagatctcagatttatatgtatagagaattggttttacacaaatagtgaataaagtattttgccaagtgtgctttcagtagagacttgaatgattgtgatctgttttgctcttattccacgttcagaggttcccatgggaaccactcccaattcgtgggaagagtggaatttaacaaacaatacagaaaagccatttaatcatcctctgtgtgatccacaaaagtgccagaaatacggaggaaatgaaatcactagaatctctatctgtatgggcctgcccagagaaaaaagtgctgctcatggtaaatagatttgatagatggcagaaaaacaccagtgtcctaaatctgacagtaacaaaaaacctctcccatcatccatctccttcagataccttttcaaaatttgttaagtgttttgtgtcctagagtttggcatcttgccattttaatttaactatttttcccctgaaagatttgtttccagaaaaagcttgggatcataatacagtaaaccttacacataatcttctcattatgttcagaaagctaattttaaacctaattttcccatctctgtctctctctattccagtgcttacctgcctgcattaattaattcctgtgcagcaatgaaaatttgactcagttacctgacctcttaccttctgattgcagaggctctgtctcttacaggggtgtgggacgcctggtgccacaggacatgtgaacacagattatccgtacctgggaggtgactttggtgagatcggagacattggagtcccccaggagcagctcctcagcagattggggataagaacagagggcacctacaacaatctatgtattacagaacacagctctttttcttttgcgaacacagctgtttttcttttgcctgacttgactgaaaactgtttttaagtgaattaagtgttttaagtgaattaggtgtttcagctatgtcgccagtgggcactgaatcctaaaacagtgatctggaagggtcttggtgaccatgctatccaagcaccatgagatttggacctccaagttgggttcatcttctcactctccccgtgctctctactgtgaaaccacattggtcttcgcttcctccaacacagctagctcttgtctgcaccagagtctttgaactgtggtgcgttttacgtgaaatacctccaaatgattcttgttcatccttaagatctcagaatagatgtcatttcctcagaaagcaccaccttcttgaccctccagcctacaggaggattccctggactgtgttgtcatagcacctttgcttttccatcaaaatatttaacatagttcataaattgtttcatagatgagggggtggttagctcgggttgctttttctcttctccagtaagagatttcagaatcactccccttagaatcatttatatgaggttttcccctgagggcaggccagtggcctcactgcttcagaagggggtgtaatcagggtgaagagcaaaaatgcttggtatctttgagggaaaagaaatgaagttttggagagctggtaggtgccagagccgttcctgcctcagtgcttccataaccagctggggacttaggaggtggctgtttgtgggattcaaaaaacggaaccatgggaaccttggaagcccaagtgctgggcgtcttcgatgagcttagcattcagaagagaaattgcgcttcataggccatgtggggtctgtgcataaacctgtatacagcagagttcattgcagcaatggtcccgcgccttcctcagcagcgtcctcaagcagcgccaccgtgtggcagcagtaagcaatggcagtgatcggattcctgtccactccctggtgtggatgtcctcggcggacttcctgtccattacgcatgtgggacatcaagagataaatcggaaaaataagaaatacaactgtatatgaagcccggtttggagaggcatttgtttgcataagtctgtaagatccgttgtagaccctcggtaaatgtttgttttggagatgaggaaatggaggcagagagaaggcaagtcatttatcacagacagcgttaactctgggcagagttaggataagaatatgtgaatcttctggccccagttttggtagttctgcagttgaaagataccatgaagaaggatgatgtgtattaagagaccatgatccgatcactctttatgagattactaagagctatggattgctagggctattcctggctatttggggagagggaagtctgaccctcttggatgcttattttatctctggcaaccattttggggtcattaatatttctcatctgcatgtctgtacctcttccttccagttttcctaatgaccttcttcctttttgcctgcctccttgcatttccgtttcgttggtttaccaaatagatttcattgtgagatatgtgtgtcattgagtcaaatgtatcttcactaaaagagaagttctggttcctgttctgaaatttctgtcttacacatttaaaaatggaagaagatatttaaaagtaaaataaattaaataagcacacattaatataatgagattacataagacctggtggataatatgtgagactgggttgagattgatgagtgatggcttcttagaggagaaagattttaaagatatgcgatatgaaagtagagggaggaggtgtgcactccgacgagaaatgagacaggtggggaagtccagtgtacatgtgtttacggggttagtgagaagagagttggcaaaagtgtatgggattattcagaacaatctgaggaaaagatatctggcttagggaaggagttcctggagtcaatggagacttaagctgttaaaggaaaataaaagtgaaaaaaatgaaaaaaactttggagtagtttttgggctcaaaatctcactttactgttactatctgggtgactttggacaaggtatttaagatatgaatgtgttttctcatctacaaaaatgtgcttttgtgaaaatcaagtaaaatgtcctatgagatgccctaaaacaatactggcctagaggaggtgttcaataaatgtaacttttacactttataccaatttcaaattctcatcactaagttatagtttcaaatgaatgttttcagtttatcttgatgttgctcctgacttcaaaattttctgtttggattttcttagaaattaataatctttcacacatagctatcaaataaatcattgttttcatttaagaaacatggataaattggcacacacacaaaatcattctcagaaatctatcaaaaccaattaaaggaaccccaaattaggaaggacaattgcatttgtcatgaaattagagtggagcctcagcctcaaaccctaaattacaaagactagtttttgaattcaatttaatagaagcttccaggatttcatacatatgttctttaattttgcatatactgcatatatgggaaatgagaatgcttgaaggggcttttaaaccctggtaattaggacagggtggcaaagtgacacatcaaagtttatgttccagaaataaaaaagaaacttgtgacaaatgacttacaaagggcgaattttttccccaaaagtattaatgtaagaagtttagatatgtttctaaaagtctaccatccctcattatttgtccatcattatttcagtacaaacatacccaatgtttcataaaatatatttcattaataattaagacagacaagctttgatttaacaatttcttaccatatgaatgtggttgtggtctcaaccactggtaaaagaattatgggggacacattcagctgctgcaataaagacaaccattgtaaatgcttacctcttagatgaaaatggttgggccggatgtcctcctattgtttgctcttccacatctgaaaagaacgtagactaaatggagtgaatcctcactgatacatggaagtgaatatgtccacattggcagcattcataaacagcagcaggtttccttaatatgagaatcagagtagttacagcatagatgagtttttgagcctgcatagaaaaagtccagaaaacatgcagcacgcactgctggtgagcattaactcactcttgtcatttgggaaagagaacccattgtttctagatcttcaatttctgcagaaaagcatggagtctgttactcttcatttttttgttttgtttgttttgtttttggaagagtgaaatctccagctttaaaaatgttggcaacaaatacaacattctttttaaagcatagtcagtgtaagcatcgttggtgggctagacaggacatacctgtgagccagatttgactcacaggctttcagtttgcagtctctgaggtctagtgtatgaagttggaatcccgagaggcagcgagtgggagaaaatgaaggctcagaacaagtcagacctcttgtagcaggcctataacttcttcctggagcaccttgactctcttagcaccatacaggatctgatctgagagagagttgtgtaagattgatgctccagaattatactgtatacttttgaccagaatattttcattttcagtatgaacacattgctctcttaagtattttttgcatttgtaaaagaaaataataagccccaacatatccctgaagcttacaatatctgtgccccaaactcttccttatgaactttcttaatattttaacaatatcaaaacagaaaaaaaattgttaggcataaattatctacttactctgacctatatcgggttctttttcaagcttttcaaaaggtgacacaaaagccagttcaacctgaatattggaaaagaattgcaggggtctctgagcattgggaaaggatacaaaaggcatcagaagtttggctttgagacagttgccatgaaaggtatctcattttcctgccctggagattttatattaaatggattatctgtctgtcaagcattttgagcattccccttcactgctttccctgaggactattgcagcatcttaccgtgtgaggtgggccatatttttttttgcagatgatttatagaatatgagatatataagcagccgttaacacatctagttttatttttaaagttatgtttgaatggattatgtttgtcccacaatcattttttaatctgaataataaggtcaatttgacacagctctttttttttttttaacatttagtttaatcctttaacaaaccttgccctcatttctgtttaaccttggaccacctgctttggctggttatgtaatttgcaaattagaaaatgactatttcttttttcttgttattggactccaaaactcacccaaattctttttctttgctttgtgtttcctctctgtcttcctaatttcttatgcctgtattaataaaatggcttgagagataatagtctagttaaatgcatagtttcctaatttgcttatggaaaagctaaagtagactggaaagaacatgttactaaattataattttaaattttttatcattgaatgtcagtctcactgtgatccttttatgactctataaatatgctttcttttgaatgctggaggtggaaggcaggttggcggtcacctggactaaaaccatcgttttactgaaaaagcaattgtgaactaaataggagaggtctcttggccaaggtcaaacataagctggtggcaaaatcaggagagagtcttgtatcctggttaagaggtataaggatccagagtcagacaaaactccatgtcctggatggccttatattagttatcttgctatgacttctggcaagtcaaataacttttctgagcctcagtttcaaaaattttaaaatgaagattatcatattgctcactgttatttataatgtggaataagtgatagattccacatcaactgcgtgacatctaacacctagtaagctctcagtaagttgttactgttattgctgcatctctcataatcatcactctgatcacctgtctatgtttgtgtcatcacacagctctagcaatgtttccaaaccaaagaaagggtcccttaaacttcctcagcaagggcttggcatctgttgtcatttgttgactgtttctcagatggttcaggaatgtatacggtgcgtattattaagtttgcagctccccttgatttccattcgtcacatttggtccataaattcaatcaatatgtattgaacaccttccttctgtacacaaagctctactagatccctaggatacagggtgaacaagaaggtataatccctcttgcctggggcttatgtttggagttgggagaatagaagctaaataactaatcatactgttgtttacttatggttgtgttcagtggttaaagttgagtaccaagtgctatgagtgagtaaaagaggggagtcaaagatggaggcttctcggacaagtaggtcttagctaggcatgacctaaggtataattatttttattttgaagggatggtatctgaggaggtacaggaagcagaagtcattgaaattttagggatgaatagaaagtcattgtggctgaagcaaggggatgctggaggataagggtggaaaggaaggaggggctgaaacattaatttttaggccatgttaagttttctgggctgcattataagaaaataaatggaatgttattgaaaggttatacacagaaaaatatcatcaccagatcttttataaagataattttagtgcttcatgaagaacaagtagaggaagcagagagaactgcttggggtcggggtggcttgtaatagagtgggggcagtggaggtggagagagatctgagaaatacaaagaggtacaaggaaccagcctggtgtgtgactggtgtgtcagtggaggcagagagagatgtcaagaatgactccacttttgacatgaactccagtcatcatgaatgttggagtaagactggtccatgatcatatttttttcctggtgaaataaagcacggaggagttctgagttctggaaaaagaccgattgaaatgagaggtgaaaagagaacgctaagtacgatgaggacagaagacatactttaaatatgttaagtagtaagaacatcaaatactaggagccagtatagttaagttacgaattgtgaggtttgtgtatgttagagttgaggaattcctgtttcttgctgttttgatgggcacagtgttcttccacgacagtaatcagataaactacttaggtcaactcaattaatctcttttaaaagaagcctggaataatctgctccgttctttgacataaattgattgattagaatgtttgcatccccaaattaaggtaaaaccactgccattttacagaaggtattgatcttatgtctgttaaaattgtatctttaaattttttaatttagttttattctttttcaatgagaatacagatttcaaactaaatgtagtgtaggtgtgaatgataataaaataccacataatttagtgtagttttcctatacgcattatattcatttcagcgcattatgatttcaactgtgtttgtacttgaattactcatttttgtttatcaacatgaggtttccatctgatccagaatcaaatagtttttattcagagttctattcatttactaaaaataatttcttatgaatgttctcatatatgcacatgcatgcatgttttaaaaagataacagaatcctgttattgccaagaaatttgggggtaagaccatggtggcaatttaagcaggttttgttttgttttagttttgtttttgagatctttatttctcccagctacctatcaaataatataggagggaaaactgtgtcccacaactggaaaacccataaggctccccagtcatctacctcaaatcttgaggagtctccagagctatcattgtgcaaagagatgtgggggagctgttctgacctgtttattgactcaatagtatgtgtcattcaaatttagggaatggagaaagatgctgttgccattctgctggccatgttacttgtcaaagcccataaccacgaatgtttggagaaaatttaaagttgaatataggagagaacaataatgatatggaagtttcctgtactactcaggaggatatcacatttatcaaataaaagaaacaataagaaaacagggctgggtgtggtggctcaggcctgtagtcccagcactttgggaggcagaggcgggtgggtggcttgagtccaggagtttgtgaccagcctgggcaacatagggagaccccatctctacaaaatatataaaaattagctgggtgtggtagtgcacacgtgtagtcacagctactctggaggctgaggtggaaggctagcttgaagccaggaggctgaagttgcagtgagcgaaggtcatgccactgcaccccagcctgagcagcaaaacaagaccctgtctcaaattatactacaaggctatagttaccaaatcagcatggtactggtataaaaatagccaagtaaaccagtggaacagaatagggaacccagaaataaagccaaatactcatagccaactgatcttcaacaaagcatacaaaagcataaagtgaggaaaagacaccttattcaataaatggtgcagggaaaactggcaagccacatgtagaagaatgaagctgtgtcctcatctctcaccttatacaaaaatcaactcaagattcatcaaagacttaaatctaagacatgaaaccatagaaattctagaagatacatcagaaaaactcttgtagatattggcttagggaaagaattcatgactaaggacccaaaagcaaatgtaagaaaaaccaaaataaataaatgagacctaattaaactaaaaagcttctgcacagcaaaagaaatagtcagcaagtaaatagacaacccgcagaatgggagaaaatatttgcaaactatgcatctgacaaaggactaaaatatcgagaatctgcaaggaactcaagaaaaaaaaaactaataatcccatcaaaaagtgggcaaaggacatgaatagacaattcacaaatggagatacacaaacagccaataaacatatgaaaaaatgcttcacatcactagttatcagggaaatgcaaaataaaaccataacgagatataatctcacacaagtcaaaatgactgttattaaaaagtcaaaaaataatagatattggcctgaaagtggtgaaaaggtaacacttttacactgctggtgagaatgtaaactagtacaaccactgtggaaaacagtatggagattccttaaggaactaaaagagagagctaagctgtgaggctgcaaaggtataacaatgataaaatggactttggggattcaggggaaagggtaggaggtggatgggggataaaagactacatgttgggtacaatgtacactgcttgggtgatgagtgcaccaaaatcccagaaatcaccactaaagaactatctgtgtaacaagaaaccacctgtacccccacaactattgaaataaaaaagaaaaaaaggaaagcaaaattaaaacaaagaagaaagagagattgcttgaggaaaaaaaaaacaacaacaaagtataccctttagtagagatagtaaatatcagaatggatgctactgaccaaattaattaactggaaggctgagaaaattcgcataactgtaagtaaaaaagaggttttataagagagaggatgacgcacataggataggtcttggggctcatctcataactaataataggaattttagaaatagagaacagatgagaggaaggaggagaactaacagattaccatttcctctaagccaaacctaattcttcaagccttcacattgaatgacctcactacaagctggtgaagattaatgaaaataaaaacttttagacataccatgatggaattttgaattccaaggtaaagagaaaatgtatacaaaagttgacacagaaaaacaattagttaccttcaaggaaaagagaatttgactattatccagtttctcatctgccacagaaaatgctagtggacaatgcaacattcctttcagaactgtgagtaaaaagggttgcaatcatagtattctctcaccagacacagtttgctcatgtttgacggaaaaatgtgcgttttgatacatgaaaggactcaaagtattctgcaaatgtactgtttaaaaaaaacaaaacaaaacaaaaggaggtagtaggaggagacttaaggatgtactatagccaaaatgaaaatgagtcaaaatatatcacaaataggtcacaatatgagaaggggtgcaagatatatgggtcacaaatgctgctacaagactggccctgggcagattgcattaatatcacctaaggtggccaggcctggtggctcccgcctgtaatcgcagcactttgggaggctgaagcaggtggatcatctgaggtcaggaggtcgagaccagcctggccaacatggtgaaaccccatctctactaaaaatacaaaaattagctgggtgtgatggcgggctcctgtaatcccagctactccagaggctgaggcaggagaattgcttgaacccaggaggcagaggttgcagtgagctgagatcgcgccattgcactccagcctgggtgacaagagcaagactgcatcttaaaaaaaaaaaaagacaaaacaaaaaccacctaatgagattttctttccccagctttattgaagaataattgaaaaataaaaattgtttacattcaaggtatacaacttgattattttgacatgtgtgtacattgtgacaagattaccacaatcaagttagttaacatcttcatcacctcacatagttacctttttttgttgtggtgagaatacttaagacgtactctctttgtaaatttcaagtatacaatacattattactaactatattcaccatgctgtacattaggtatccagaaatcattcattcattaggtatccagaaattattcaaagtttgtgccctttgaccaaaacctccctgttacccccacacctgccccctggtaaccaccattctattttctgtttctatgggttcaactcttttggattccacatataagtgagatcacgcagtatttttctttctgtgcctggcttacttcactttgcataataatgtcctctaggctcattgatgttgcaactggcagaattttttttaagactgaaaaatgttcagctgtgtggaatattatattactattaatattatatgctatattttatatataccacaattgtgatgggtgtaccacaatttcttcaatatcagggctattttgaataatgctgtaatgaacgtggaagttcatctgtctcttcgagagagctattttatttcttttggatatatacccagaagtggaattgctgggtcatatgactgttctatttttaactttttgaggaatctttactgttttgcataatggtatattcattataatgcataatgtcaatttatatccccatcaacagtgtttaagggcttcgttttcaccacatccttgctcaacattagtattcatcagggaaacgcaaatcaaaaccacaatgaaatctcatctcacacctgttaggattttttttggttattatctattatttttgataataattattatcaaaaagtgaaaagataacaagcaagggaattctgccaaggagactttaaatgctgattcctggagtccaaagtgagagattatgagagtgtaaacctgagataggtcccagtagtctgtatttttaataagttctccaagtcacctgacagccaaatttggtaacctgagagtaatgagttcagtaaaatatattacaattaaattattattgataatgtaagttatgaaatattaatgaaatggttaagaaaggatcctcaactgcaaggacaaaaatgcaatcatttttgtctgaaagtaaattctagcttatttcaagagaatctaggtgctgtgtgtatgttgtgaatgctgtgtagtgtaagggaatcactgaagacttagaagcttgtaaatgcctagccttgttcctgaagggggagctcttagagaccgtttagtcattgagattgatggagaaacattacttacatatgcttatatatttaaagattaccaacagtgaaatacaaataagatgaatagctccttaatggctagagaatgcaaaataacacataagaaaaagaaagcttcgatagtagagtaaaaatttggaagaaagaaacgagaaaatataaacaaacaactatgagtgatagaatgtagtttgatagtagtaatcatttcactatgtatatgtatatcaaaatattatgttgtgtacatcagacatagatgtaataaaaataaatttaaaaatatatatgcaagttacaattaaagtaggtaaattaaatcttaaattacaaaacatttttgcattagcttaagaaggataaaccaattccatgctgtttaaaagaagactttttttttaaatggcacaaagtaattggaaagtttttcactattatatctgcagctcttggcatgattggacatatggttcaaaaatgattgccacctcatggaatgaatggatgtggaaaagtataacagcctcctatcacaaccacaaccaaaaataaaaaggtaacgtgtaacaataccattattacaatacacttcaaataataaataattagatggcacatagggctatttttaccaaaaaatccaccattaaacaaggtataatagcatcaaacttttgtgcactgaaggacacacattatgatgaattggaaacataaacattcaagaagaaattaacaaaactattaccagactgggaaattttaatacatctctcagaattggactagtcaaaaaaatccaagacaaatgatgtaatattttccacaatattaagctcataccaatgctttgataaccataagctttttaccttgtcatttaataacattttaattgtaaaataaagtaaatatgatgactaaaagtaaatgaaaacattcgaacaaaatacttctttgttttcaccctggcccattttaatatgtccacttggcttctaatagtatatgatgtttccctttcctcgtttgagaacccctggtttgaatattacagttcagttaagatttatttcaagaccaggcatggtggcttatgcctgtaatccctgaagcagaaggatcacttgaggctaggcgttcaacagaccaagcaacataggaagactccatctctacaaaaaattttaaaacattagctgggcatggtgttgtgtgcctatggttctagctaggctgagccaggaggatcgcttgagtccaggagttaaaggttatagtaagctatgatgaggccattgcaccccactctgacctgggtgacagagtaagaccttgcctccatggttggaaagttatactctacaaatgtagactgtatattgtttcaaaaatgtttttggaatgtttatgaaatttgatcatatatgtaaagaaaatttcaaatattaaatattaaaaatcttataggttatattgtctaattaaagagcaataaaattataaattagcaaggaccaaaaatatgagctacttggaaattaaaattaaacttgtgaatggcttttgggtttaagtggaaatcaattatactatgaactatctttaaaacaagtcacagaaaataattattcaggattctaatatgtggtcagatgtttactgagagagatttttaaaaatgtaaatgcatcattcttaaatatgaaagattgaaattaagtaatctaaacatttaactcgagaggctagaaaatgacattataaaacaaaataaattaataaaaagtgaatagttatttaaaagtagaaattaatgacttgtttacatataaaatatatagaattaaaaataccccatatttgaaaagacttgtaaaatcaacaaagctttgttgtttctgattcaaaaaaatgagttcataaatgtatgatattaaatttaaaggagataggaccatttgtatgtaatacattttcaaaatcagtagtgcttgttatggatgtaatacttgcaagcagatttggtgatttgcttggaaaaagaaagaaccactttgttttttcgaaaagaaaaatttcctgcttaaatgaattgccaagataaagcaaattaaagattgtcttagatttaccctcagttctgcaaaatacacagattcagatggcttcctagttaagtgctgaagctcaagagacaaatcattaccaagtgatttaaaatgtttcagaattttaaaactaaaagtaatagggaacactttctatcttatttaaagttcatgttttgagagtctaatatatattgtgaaattttagaaaggctgtacgaagtaacattaaaaattgtagaccagcttccttattattactcttgtaaatatgattgaatcgcaggcatcatcaagttaaaagaatgatatacacttaccaagtatatttgttctaaaaatgcaagaagagttcagtattcagaggtatattaatataattatttataatacattgaaaagataaattccacatctctattttgaaagatgtttaacgccttttgatgaaatcaaatcgacattccccagtaacatttttagaacattaggaatgataaaataaactttttttttttgagacggagtctggctctgtcactcaggctggagtgcggtggcgcgatctcggctcactgcaagctccgcctcccgggttcccgccattctcctgcctcagcctcccgagtagctgggactacaggcgccgccaccacgcccggctgatttttttgtagagacggggtttcaccctgctagccaggatggtctcgatctcctgacctcgtgatccacccgcctccgcctcccaaagtgctgggattacaggcgtgagccaccgcgcccggcctagaaactttaaagctattatgaaagatatgaaaaacagtagtgaatataacaattcactgtaaacagtaaaactgtttctgttttaagttaaagaacaaatactctttatcaatgctcttagtcaacaatgctctgaagattatagttggtaaaatgaaaacagaattaagaataaataatgggaaaggacaaatattactattttcagattgtatatgggttcttcaataaatttttacaattaaaagcttttagaactaatgagttcactacatgatgagagataagataaatgaaactagttattagctaatacttgcaagaatcaaaaaagtaagggaggccgggcgcggtggctcacgcctgtaatcccagcactttgggaggccgaggcgggaggatcacaaggtcaggagatcgagaccatcctggctaacacggtgaaaccccgtctctactaaaaatacaaaaaattagccgggcgtggtggcggcgcctgtagtcccagctactcgggaggctgaggcgggagaatggcgggaacccgggaggcggagcttgcagtgagccgagatcgcgccaccgcactccagcctgggcgacacaccaagactccgtctcaaaacaaaaaaacaacaacaacaaaaagaggaataatattatattcacagaagaaagaaatacaaaaaaattagaagtaaacttaggaaacttaggaaatcatcaagacctacatgaaaaaatagtaccattcactatatgatataaacaagtgcttgattgaaaagtaaacacactctcctcctaaatgggaagtcctgtcattctaaggatgtcacatgtgcccacattaatctgtaagtttactgaagttcaagtaaaaatctttacagtttttctgtttttgttttttgcttagaataaaggcagaacttaatgaacctaaatttgatttggagaaaaaagtgggtagagaaatgtagggagtgaacagagccttttggaagagggaatgggagactttactagatataaatatgaatgtaaaagccaaaatattttaaaatgtactgtcagtaaaaacttatgcagatgtagatggatcaatagaaatagaacaaaccgtagttataaatttaagtggatattaaatgtcatataaaatgaattgtaatatggattgataactcagcaaatactgaaaaaatggtctattttaatacttagatcaataccacttcaaacaaaagcacattactctgaaacttaaatatagaaataatcacatactactatacgaaaatacagaatgtttctaacttttaagcaaggacttcctcagcctgattttagtcgaataactataatagaggaagatgtttctttaaaaaactaaattctgtaaaacacgaattctttataaacacaaagtcatatataaacaaatgtttattgcagtattttttattacatccaaaaaccatgcacctaaatgtccaccaggaaatggacagataaataaaaatgatttgctcttaccaaaaatgttaaaataactttaaataatgataaggtgggtctacatgtatggacctggaaaaatgccattacattttcagaggacaaaaacactcataaaataggatgtaatatgtgatctcatttttataattccacgtctttgcatttttgtctgtcttttgtgtgtagaaaaagaaaataatgtgaaactaataccaacttcaagaattaaggggatgaaattacacagtggagatttttaactttatttttatatattctgaaatatttgaatggtgaacagtcattgctttaataattggaaaaagtagagctatttccaatttgggttaaaaaagtcagtgggacattatcgtctatattctacctgtatgattgagatcctaagccaaaccaattcttagagatattctgaatgacatatcccaaagcgcaggtaagtacactcactgttagactctgctcatagttatgagggaaacatagtctccagtcacatcaaaaaccatgaaagacaagaaaagatcattagtatactgtatttacttgagttacttactgaatagtatgtactgggctcttggtgtgtttggtattaatattgactgttgggttctagtctagactcttggttctgtggtgctgtcatctataccattggtccttggaacaggagcacctaggaacttgttagaaacagaaagtctcagacttcattcctgacctcgtgaatcagaaatttctggagcccacgctcaatcagcaagcactccaggtgattctgatggatccgaatgtttgagaaccactgctctgctgcatccaggggaaagctatttactaagtcaagttttattgtaagttgatctttctcttttgagtatatcagaatttattaagaatgattagaaaattgattgcaaaccaaagagtggataaagaaaatggggcatatatacaccatggaatactactcagccataaaaaaaaacgaaataatgtctttttcagcaacttagatggagctggaggccattattctaaatgaagtaactcagaaatggaaaaccaaacattgtatgttctcacttataagtgggagccaagctatgaggatgcaaaggcataagaatgatttaatggactttggggacttgaggggaagggtgaaatgggggtgaggcataaaagactacatattgggtacagtgttcattgcttgggtgatggctgcaacaaaatcccggaaatcaccactgaaggacttatccacgtaaccaaaaaccacctgtaccctaaaaacgattgaaataaaaaacaaaaaaaagaaaactggtggcaagtaggccagcccatgaaagccgtttaatacttggttaagtagactgacattcttttcgtagatggtagggagctttaaagatttctgaatgtgagaaggacatgagtggttgatgtccatcaggacaactgctctagctgcagtgtatagcagattgcaggagactgacagtggagatggagagccaagttagaaggcaattaaataggtcaagcaagaggtagtaaaaacctggattggagtagaggaaatggaattggaaaagagacaaatgagaaagagagattgtgaaagtgagaacagtgcttggtccctgatggcatgtaggggccaaaagagaagaaaggcaaagatgattgacgttttaagcctatgtgacaggtattattggcactacagatcagaacaactatcagtgatctgcaacgtggtagattgtgctgatatcagtcatcacacagaagattggtttgtttggatttctaaattggggcttttcagttcattggaaggatggttaaaaatctcaatgattagcattagaacaaaagagaacagaaatacagttgagtactttgccagactcatcaaatatgattttgatgggctaagaactcctaacgaggacacagtgatcaactgagcaaacagaccatttggcttgaacagaaatgtcaacataggcataatctactaagttgctaattagggatggtactagccggttgatggacttcagccaagacatacagaatggtgagaagccagtgcacagagcctctgggaatctgaatgatcaattatttttcatcccataatgtaatttacctgtattagaatttatatgcagaattaaacactccttcttcagagtttccacagtattctagatttttattgaagtatttattttaatggtttatttatcttgggcagagctttttgtggggatatcaaactgttaatggatagaaagggatagattgaatattcctgagagttggatcagtgtgaagtaaagttgaagttggttatactatggcaagtatgatgtagagaaaatctttcggatgttcgaaggtcaactcagctacttacttccttttataatttggttcgacttgaacactatgattcctcatttgttaaatagaaataataataatagtttacctcatagggttattataagaattaaatctaaaatccagttgacttgaactctaaaagataaaataaaatttgaaaaagaactaaaggaaaaaataattaaataaaattatgcatatgcaatgttaaaaaacagaatcggaaaaataatttctcaaagagggtagctgttgttgctattatcgttgttttattttattgtcaaacaggctgtgagagtcaactagaagggtgacgatcttgaggtaagaagtttttgcatccctctagcatattttacaagcagcatcaggtacaagctaaatgagtgtcgctgagcctgaacttgtttggtgagtagttgaataagggaatgataaggcccacattcatttatttttacttttaaggtagaagggtgcagcaacttggtttctgcagaatgtatcacttgctgtcttttccgtggaaaagaggctatagttgttcattcagattgaacaactgattgtaaaattgtaatacccctagatggaggtgtataagaaaactaagccatttcttttcttataaatatgcatacatgtcttagttcattcatgcttctctaacagcataacatagactgggtggcttataagcaacagacatttatttctcaaaattctggagactgggatttccaaatcaaggagctggcaaattggatgtctggtgagggcccacttctggttcatagccagccttcttctctctgagttctcacagggtgtaaaggaccaaggaactctcctgagtctctttgatgagggcactaatctcattcaaaagggttccaccctcatgatctaatcatctaccaaaggccttacctcctaatagtatctctgataggccagtcttgtgttgccagaaatgaacattctcaagttcatttcatgccagaaaggaatatctgagactgggtaatttattttaaaaagaggtttaattgactcacagttctgcaagtggtataagcatggcattggcatctgctcagcttctggagaggcctcagggagctttcagtcatggcagaaggcaaagcaggagcgggcacatcacatggcaaaagcaggagcaagagagtggggaagtgccacatattttcaaacaactgtatatggacactcattattgtaaggacagcacgaagccatgagggatcctcccccatgatccagtcacttcccaccaggccccatctccaaaactggagtttacaattcaacatgagatttgggtggggtcaaatgttccaactatatcactatcacattggtgattaggatttcagcatttgaatttgcaggggacataaatatttgatctatggaaatatgtataagacatttatttaatctataaaataagatctctaatgaatgtgttataaaaggtagcttctaggttcactgtcctattttaggaaacttgcaaatgttcattagtctcctaaacctctgccgatagcttgccttttctttgtgaccttggattttttttttgtaggattccctgtctagaatatcctagcttgtttttcctaaacatggaaatcactaatccttcatggccgagtttaccatccttctccttagtaatttcgctttatttcaacaaggaaaaaaagtctgagaaattctgtagcactttggtccattgttatgacatgcatttcaaatgacctaacactgtttatatttgtgtagaaattttatttatcttattagattgtaaactccatacaagaaagctgaaaaaataaaattaagaatacggggaaaggtttgaagcagaaggtcagagacagaggcttcttcaatgccatacagaggattgggcttgagtagtaactactgcttgataccagatgacttaatctctctaaccatgatgtaatgaaccagaggtgggtccctgtccccaaaggactgtgatccttaataagtgacttggtaagagctctggctaactggtgtgttgaaaatgtcacaacaccctaacctgatctgatcatacagacagaatgagcagagtgattggactaaagctaaaaggcagagagagggcaatgatattacaggcaagcagctagcacagcaaaaaattcaatgtaaataaaatagtagagttaggagaagattatctgccctctttaccaaccccttcatctttaagttaaatctcatgaactcaagttacctgaaaatatggtttattccatgtatgtgaaaaaaggcctgactagtacagcatcattttgtaatctctttggcagaaatgattctttttatatgttgagtctaaatgcactgccttgtagcttccatgcacaggtacttgtcatgcttcctgaaatcacacagaacatgcattaactatgtagccaatgacaggccttctaggatgagcagattcttcaacagtagggagatgtctttcacaggaaacgaatgagtatttgtcagggcttcacttgatatactttctaccactgtcccggtaaggaatagcagaatataaataaagggtctaatatgtacttattaatgagtttgctaaatagaatatatataccacttagtgagtggtactatgattgttttgggtacatacctaagattagcttttgttttaatagtagaaatatgtatatattattatgtatattaggaaaatataaccagcatggaaaacccatggcttccttgagtctattcattaagacaaatggaaaatacatatttaaatttaaaataagaatttaacaatgctaagtaaacagttctagtggtatgcacatatggccaacataatggaggatgtttgctaatgatggtaattagtataacactgctttaagaaaaagtgtcaacagattagcatgatatgccacaagcaaactggaccaagattatcacttttatttttgctttctaatttcagcggttaaattttaagatatttgatatagcttaggagattgattgctttgaaaaccaacttaaatatgaaataaagaaactatactagcacaagtaatgcaagaaataaacatcacttcaaggtcaatatcaagaaattggaaccctttctgaatttataagaatattttgagaaacaactttcctgtcaaatggaagtcaggagaaaatcaacaaagagtcacctttgtacccaagaaaacctatagacacatgtaacagcatgcagaaatataaaggtaaaaaaatcactcaagagtcagtgagaattttttttagtaaaggtcatttgatgtccacttccttgtatatcaaatagttaaatgcggatgaaagcaggagatatgaataatactagaccgtgtatccattaaggaatcatgaaaacaaaagtttaaagcaagaattgctaaaaccaagtgttttctcaaaagagctcttaagtcaaatgtagaggtaagaatatatgactttatcactgtatcattttattacaggatggaattcaacattttcaatgtgattttcatgtattttattgatttgggaaggttagcgattaaatattgttaataacattctacctggtttctcaacatctcatatcttttttcctctgacccatcagaaatactactggcacacttgtctccccagtgcacttcttggattgtttttgctcctctgctcaccacacttcttgaggctgcttcctgaattcctccatacatatgaattctttagcaggctattcagcatgcctgtgctgtctgtgccaaatctaacttccagtcattttcctttgcacttgtgtttggctacttaggtttatcttaatatgctctatatgccagggctcttcagagaagcagaaccaatgggattgtgtgtgtgtttgtgtgtgtgtgtgtgtgtgtgtgtgtgtgtgtgtgtatctccaggaaacttcagtttttacatttaaggctttcagctgattggatgaagatcacccacattaaggagaataatctcctttacttaagctgaattgattatagatgttaatcctatcaacaaaatactttcaaagcaatatcaagactagtgtttgaccaaacaactgggccccagagcctagccaaggtgacgcataaaatttaaccatcacaattgccttgcttttctttctctatcgtctggattttaaaattttttatactttaccttatatgtccttattccatattcctaaatttgaatacccttcaagccccagctcatttctctcttattttcaaagtcattaccattcacttcatcctggaatggtagctaggacctgtgaaattctgtagcaggatgcactgctttcatagcatgcatttcatgctgcctggtgttgaaggtatttgtgtaaggcttttatactctgtgagagctttgagcttctcaagggccagagctgtaacacatatgtctttgaattaatatataattcattgctctacacaaaggtacatacttttttttttgttttctgaagtgcagagtgctattctaagccatcttaaactcaaagaattatagaaacgttctggcatacagtcagaatatggaataggaagagtgtttcacaaagtgtgataggcatcctaccacacaaagtagtgtttgctttaatagattcatgttcatgttactgtgatttagaaaaaaaaaattgtaacatcaaaccaatgaattctcagatattaatgtttaggatggtgttaaaacagagacttatgttaggcttgaatcaatgattaaatatttatttgagggtcaatgttcaagtatgacaatgtagtaaaatagtatgtgaagaaactaggtttgttccatgttaacttaatgcagttctagactggaaatgaggagaattgaaattctataggcccatcactcattgtgtgtgtgatcttaagacatttttacctcttggcatctgtatcttttttggggggtaggtattctgttatcatctaactctaaaagtgtaatttgctactaagatgcctataaatacagccagactacaacacagatggtgcacacaggaagaaaatctctgattggtagactaacccaaaataggctgtgtatatattgaatgaaatacgaccaaaaaatctgcaaatagcagacacagagcatcctttaggttggaactgagtaaagtagatttatgatctaatcttacttattctatgacatttctgtttaatgaatgtccctgatcctcctgccatcttactcacatttctaatgtgctcatactccgaggtaataatgatcatttgcaattataaatgtcctgttatcaattaatttgcagttcaccagtaaccatctgattatctctaacaaagctgcgctggtgtggtaattatgttgagagtaatcatcatgtaattgcacataattatttgtaccttattaagtgctcatatgattaaaatatttctggtcaaataaaaattatccgtgagagtattttttggaggggggaaataagaaatgttgcttcctggtcttctgttctttgaataaggtaaagctgtctagctgacagtccataatgccccagataggatgaattagtaaggagagaagagacttagatttcattaatacaataccttgtacctccaatgaagttgagataataaacttcaacttccagcatggatgaacgctttccctgtagtagctataacaaaaaatattaccctattaagagtgtacactatgaatgtcattgaggacaatgtgtttttcatgtccaacaccgccattagcaattttatactgaacttttatttttctcatagtactctctcttcaaaacttttaatattcacttatttacactcagtgttttttttaatttccagggactgtgtttagtgagatgatctacaggtataattccaaaagcacctaccaaatttgtttattcagacattcattaaagagcaactctatatactagcactctcctttagaaatattatgtgagctacgtagccaaatttactttttccaggacccacaaacaacagcaagaaataggtaaaattaatattagtaatatattttatgtaaaataatcattacttcataggtactcagttgtaaaaaagattagtgaaatattttacattttttgtactaagccttataaatctagtgtagattttacttatagcacatctcaattcagatgagcaacatttcaagggctccatagccataggtagcttatggctgctgaattagatggtgcatatatgttgattgtatctacatggtagataaaggagagtcctaattaatagttagctctctgattttatagatgtttttatgagtttcaatttcctaatctggtaaataatacatctagcctaaaacatttctttttaaattaaaatgttttctagaaggatagggatggaactaacattaagggactgctttactaggtcatgtaggatactaggtatatttacatttattatcaaattcattcttcacaatagtctagaagggtatgttactttacaggttagaaaagtgagatgtaaagtttaaccttatcaatagtagaatagtagaactgggattcaaacttggctatcatctttgaccacagattttgtctcatgcttttcaaataagaaacacatattttgggtccacttgctcattgataggtctagtaagaggattttacttccctgaatactgtgtaaaaggcttgactgcaagaaagttactgattagtttgatttttagggtttctcctgaccttccttatccatgtttcccagtccagtttcttgaattagtctctcctgaaagcttgttctttccagcaaacttatctcaagtatagcataaatcatcttccactggcattttaactgaaagtctgttgactatcacgcacacttacagaaagcctacctttggggataactgagtgactgacagcgatgccttagcaaccatctgattgtagttacagaggaaatttaccttggattgaagaatcacatgccattgtgattgacagagtctgtaagacaatcaaggtcaaacccagagtaaattgagtatgtggctatgagcattgacagataagtcatgtgtcaaatattgcctagccatctggttgctactcatgattagactggattcattgtgtttaatttcttattgaggacaactacatgggaaacttgtttgtttttagtttatcagtgaaatgtgctttatctgctgacataaaatgtttctgcctaaagtgaacttgcaaaatcattagttttatgactccagcatgacctacaaaaaattattatttaaaagtgattgatgcattattgaaaaaaatatattaggtgctgaaagttacactcatgaataaaagcacaattccttaaagaggaataagaaaacaaatgtgatcaccccgagggtttttagaagcccccaaatgtttaaagactattagccaaactgggtaccagatatgtgggtagtgagaggtgatgagatgtcagtgataagtgatgtataaggggacaggtgccttgtgtgaaattctgaaaattcacatttagtagaacgtatcaaacgccagtagaacgtatcaaacgccagcaaatacttagtttatttttgaggacaaaagtggaaaacacagggaagtgaaatcaattgtcctatgtcacattgtacttggaatggggctctgagtcccctgactactaatccagtgcaatttcctcctgtaactttgctgcctttgtaaatgattacattttaaatacaagggctgtttggcttattaattagttagtgttaaaaaaagccaaagttgcttttcatcactgatggattagtacctttcattctgttttcaactaccatattgtccttttaactgaactattaaaaacatttttccttgttgatcacagcttgggtgaacaaagtaggggctaatgaaaataaattcccggtcagagaaaatggcagttgcacgagttttggtggtatgatagtcacatttgcatatgtaaagtataacactacataagcaaataatatgacccaattttaggtggtgatctatatgtcattgctggttcctctgcaagaataaatactgaatgcttctaggcatttccagtaagcacagtaaatccatttcaataatgaagaattcctgagaaaacaatataatagaatcaacaggttctagcaaagtggaattttatcataaattacaagttccaccatgttaacacgtacattgcaacatgttttggacagtacttctgaggttggaattctcagcaagtggttcctattttgacatccagacagtgatagccatttgtaggtggaaaattagttatcagctgtgccttgctttttctttacttgggtttctctatttctctgtctttttacacacacacacatacacacaccccacacacatatacacatatatatctatccttggatatccaaaaaaagattctcaataaattcacaacactaattgaattgagatgatataaagttgttgattatttttaataaagtctagagatctaacattagttgtagcttatttcttcactactaaataagaaattccaagttaagtcttttcatcttttcattaataaatagccaatatgtaatatctgcccatccatatatattatgaactatctgaactactccttataattatggggtaaccagtcaaataaaagtgttgaataaacagcttattgtatatgttatgaattacctgacttaaaattaggagtcaattagtcaaaatgccatgggctatatgactcattgtaacattaataaagtaaaatatgtcttcctataatccagttattggtattaaataatattgaagctattttccaagcaaaacttccgcataagtttgtttttgtcttggttgagaactggttcttttgagataaagccaccaactcagcacaggtttttttttttttctcctgaatggttttgttcaacttaaaatgactgttcctaacagcaggtgctctcttctttgtttcagattatattgaacatgcttttggtcttcacaaatactgaaaatcaactataaaaatgctggatgaaaagaactatatccatatggtaggaagataaaattttagctctaactcatatcttctctgaagaagattcttcagtaagttcaataactaacattatacattcagtcttttaggaaatccttggatctattttcaaaatatatccagaaacagaaagcagctataacatttgactggatctctcattatgagtaaaataaaatctttaacagctattaatcttatacatgatatgacagccgtgattttacctttcttttttaaaattaattttaacagctttggagatccttcactgagatatccagtgggttcaactgacaaagcaaggcacaatttatcatgtaggaatgtacttcacgggaaattttcttctacatatgttttctcttggttcccagagatgaatccgtaataacaataggattctgctaactttgtttttctgattccagttttcctctttactaattccatggctctttttttggggctcattttttgcccaataaattattcccgcttattgacaggactgatttgggaatttaaggtctgaccatttggtgatatctataagtagattcattgtttatagagacctgttctctgttaggcgagagacaatagagaatctagttgttagtctttatctgtttgtttgcttgccaacactgacctcaaataaattaagaattttgtggccactgggcaagagaacagctctttgatatctggactgtatataactggaataatggttatgcacccaaagccatacatggaatgtcatatttgagaatgatagtcacataaccaccccaagctactaagatgccataagtctttaccccaaatgtgtcagaaatggaagacacttctctcctattagaagaaacaaatacgtttggaaaaaaatatttttggataggataacagagaatatcctctccagagaacagggtagtgaaatatattttgttcacataaactgaattttttttttctttttttgagacgtggtctcgctctgtcacccaggctagagtgcagcggcgtgatcatggcttactgcagcctcagtctcctgggctcaagagatcctcctgcctcagcttcctgagtagctgggaccactatcacacaccatcacacgtggctaatttttatgttatttttattattattttggtagaaacgaggtttcaccatattgcccaggctggtttcaaatgcctaggctcaagtaatccaccagctttggcctcccaagggttggaattttacaggagtgagccaccacaccagcctgaaattttcattaaaaggaacttcccttccaggaagggatgaaggaggacttttagaacactagaaatgacagcccaaagagacagagcccagagcatgggtgagggtgagctgtggtgtcttgaaacctagacacttgttggtggaaccagcttgggaacacaggctaattgggaagtatggaaggaggatgcttcagacacaattgaatttttcagtgttactaggacatctattcctgtgtatgaaccacccgcctgctgtggtttgaatgtttgtgtcccctccaaaactcatgttgacatttattctcaggtgaaacaatattatgagggagggcccttaggaggtgataaagtgccttataaaagggcttgatggggcgagttacccctccatcccttcatgtaaggacacaacctcatcccctctggaggatgcagcaacagggcaccatcttggacacagagagctgccttcactagacactgaacctgctggcaccttggtcttggacttcccagcctccagaagtgtgagaaaaaaatttccatgtttacaaattactcagtctgtgttatttggttataacagcacaaatggacaaagatactggcccttctgcaaaaattcaggtcctcaaaatctttgtgaaggatgtggcttttgttactttgctttgcttaagaagggagagtggtctacaatcacagggttgtttacctgcaagctcctcctgggcctggattcctcattgtgcaactgttgtgttatcttcagtgtccacaccactcaaagacaactttggtttgaatggagcctggcctgggctttttacagaggctgacattgatttggcattctgcagggcaccttgctgacttttgttttctctcttgggatgtatccactgagacaaatgactcatccattctctgaatttagttttctgaggagtctgtcttctttggggcagaaatggggacacattgctcaccacggtctctctcttcctctgacctttgcaggaaagtgctttccctctagtgtgtaaagtccccaaccctatgtccaaattctggattctttactaattggaaactgctattataggattcccatttttttcacttggctctaaattagtatcccagatctttcaggagggtctgaaacttaggggattcgagctcttgctaccccagggcactttccatatgctctaagtggatctataaaacatgggaaggtgccatatccccacagtgtatgctatggggatgaggctgtgagccattagcaaattttctgggtcagtgggcacttcagttgtacaatcatgagcccggctctcagtctgtgcctctgtttagagttttaactaagaagaaagatggtcttcggggtgtgatttccagagatcttggactgccaataatggtacaaagtatttcttggttattacagcccttagactactcaaattgtcattgaatatttgggagattctaagctaattagttctctgtgtgcttaatttattttctggttttgttttatgaggcatgtgggactccatagccttaattataacatatccttggaaccattggtcttttcttttttaactgtttttttctttttttaattttttattattatactttaagttctagggtacatgtgcacaacgtgcaggtttattacatatgtatacatgagccatgttgctgtgctgcacccattaactcgtcatttacgttaggtatgtcttctaatgctatccctcccccttccccccaccccacaacaggccccagtgtgtgacgttccccttcctgtgtccaagtgttctcattgttcaattcccacctatgagtgagaacatgcagtgtttggttttttgtccttgcgatggtttgctgagaatgatggtttccagcttcatccatctccctacaaaggacatgaactcatccttttttatggctgcatagtatttcatggtgtatatgtgccacattttcttaatccagtctatcattgatggacatttgggttggttccaagtctttgctattgtgaatagtgccgcaataaacatacgtgtgcatgtgtgtttatagcagcatgatttatattcctttgagtatatacccattaatgggatggctgggtcaaatggtatttctagttctagatccttgaggaattgccacactgtcttccacaatggttgaactagtttacagtcccaccagcagtgtaaaagtgttcctatttctccacatcctctccagcacctgttgtttcctgactttttaatgatggccattctaactggtgtgagatggtatctcattgtggttttgatttgcatttctctgatggtcagtgatgatgagcattttttcatgtgtctgttggctgcataaatgtcttcttctgagaagtgtctgttcatatcctttgcccactttttgatggggttgtttttttcttataagtttgtttaagttctttgtagattctggatattagcctttgtcagatgagtagattgcaaaatttttctcccattctgtaggttgcctgttcactctgatggtgatttcttttgctttgcagaagctctttagtttaattagatctcatttgtcaattttggcttttgttgcaattgcttttggtgttttagacatgaagtccttgcccatgcctatgtcctgaatggtattgcctaggttttcttctaaggttttttatggttttaggtctaacatttaagtctttaatccatcttgaataaatttttgtataaggtgtaaggaagggatccactttcagctttctacatatggctagcctgttttcccagcaccatttattaaatagggaatcctttccgcatttcttgttttagtcatgtttgtcaaagatcagatggttgtagatgtgtggtattatttctgagggctctgttcggttccattgatctatatctctgttttagtaccagtaccatgctgttttggttactatatccttgtagtattgtttgaagtcaggtagcatgatgcctccagctttgttcttttggcttaggattgtcttggcaatgcgggctcttttttgggaatcattggtccttgaaggcagctctaatttcacctcatagctctgctctctgaagcacgcctctgctatggctggagtcccttgggggcgtgattcccattcttattcctaggttcacgatcagctgttgtgtaacttatagttagctctgggttgcccttttggcccccattttagtcacattctgccgggttccgtcttagttgtagtgtgtgtgaggacacaatatcgactacatgcagagatgtatttaccgtctgccctaacctgatgagtctatgcagggcccttgcaaatatcaaagcaggaccaccttatgccgctagccttgcttactcacaggagaggactagatgccacatttttctcccatgattatctgttttctctcagctcagattttgagtctgcctctgaaacatgggtttctgagtagggaaaggtggcatggtaaaaaggccaggattgagatgttctcttttgacaccatagttttatggattcaaggaccatgagaagtgcatcctacttctgccacttgtgaaagcaaatcaagtgggttttaagatgacagcaagaatgaaaagggagaaaaaaaaagtgggtttgctatacttgtcaagtgcctggatcaaggaaggatcaaggaggctttctgagccccttgattggttaccttttgagcccttccccaatcattccctaggcagaattttctgcatcttctaagtagaattttcctgggtgcttcagtacaatccacttgagatccttgttcctctggcccttcaacatggaagtccatgagagtccatatttgcctttccattgagaggtccctaataatttatctttaggctgcatcagcaagagtccctaggattctgtaggcctggcccctctcttgttctgtgagtccatgttgaaggccgtgtccaagttgcttcctcatctccttgctgaaaacaaatgcttcaggaaagatagagactaggacttaggatgaaaaggtcaagttctcctgaggaagattgggagctggagggatggaggcttccaaagatctctgggcctcagtgggtaaataaagtccagaaaccttttagctatttctgctgcagtgccatttcaggcatagaatttcaggtagggtgagaaactgtacccatttctgggttctagggagggatactctataggcattaatctgagggagagagggttgaaatctggcctctcaggtacctgtgaaccagacagaaaggcagtaattagggcaaagttgcaggaagatgctggtgctgggccttggggtgggaaacaggttgcagctgaggaagcagtaggaattctttagcctgcattagtatttggatggcaatgggctttacattgaataaacaaagggagactctgttggggaacagctaccacagactaagactatcagctacaaagactccctgtgccctcccaggagagttaactttacttacactgcaaatcatgccccaagttcttgagagttgggagatgctatgtacactgcagctgctctggttgcccttcagtgctctagagggactgaggattttgccctgttcatcattaagtaattctgtggaattcagaaaattcagcccataacctgacctgagatgttttggaaatgacctttccttctttttttattttctgaaatctgaaaatccagtttctttatgactcatatcttcaaatgcttattgacatccaggctaaaaaagaaaaagttgccagcttccacatgcagggtgtgcccaggcaggggtctgtgatgtgtgaagagaaaaatgctcttgatgtaaaacacaatgtgaggaggtagggaggaacaagtccttcaccgatgcctgccgctagaaggctgacctggaagttggggtccatgcctgagtaccttcaaacagaagaggctaaccagctgaagaactcagcagatctctctgggatggtactcagtgcaataacaggcacaacagattgagttaacgtggtatatggtagtgctggaatagagagggtcagtgttgtaggatgtcagataaatgaatcagtttgatccatggaatgggctgaaggttgagagagattgataccctgagagaggagtcagccaaggccatattcttctcgcctccatgttgtccctgaaaaacaaaaaaagaatgaggggctggagccccattctgactttcctctctctaagcaagatggcgctcttcattattcatgaaaaatacgatttccatagaactctgtgtccattcctatgttattcattttttttaaagtgactaaaatattttctaatgctctttgtgaaactctaataacgaactttcagtgagtgattctcaggttactctctcgtcagtagccttcagccaaggacggatgccaaattttagacctgtgattaccggaggttatcatctgatctgatgactttagagactcatcattgctcctcaaatcagttgtgacacaaaggcttggaccagtgtctcctcatacaggaaggtgatgatgaacaagtgctgtgagactctgctctcctgcagataccctgtgctttcttaatagtccatttcaaggtcactgaatcagtgtttgggattctaccccagagtcctctgtgagtttatgtgtgagcgttggcaagaagctttctgcccaactctaacctttgccctgctcagtctgttccactagaatgataatgggcaaatatttcctgagacatttcttctcattgatttagtaaaattcaaagaataacagaaatgacaaaagtcaatctaagcagttgggtggatctagggttcccacatctgacttgtgtgtgtgtgtgtgtgtgtctttgtgttttttttttctgaaataatgataaaaaaagaatttttctagaggaagcacaaaaacagaaggaggtgtcctacactatacagggaaaataaaatagataaaatgcttcacaaagttgagctggagctcatccatgggcataaagggtctttaggagctggaaagatttctccttttttttttctttttttgcatcacattacttcctttagaactgggtaccaaacatgaatactctagtctacagttccaggccagcatctcagagctacgggacagtctgcatgggtggtaggtgggagggcagtaaaagatgaagttacaggacccccattctccattcatcctagcagatctcaccatccatcctgagcctattacatttctacagctttctttgggcttgctgttttctaaattcaaccttgcagcatagtgcatacattggtatacagcttaaggtgaggactttatgcacacacacacacacacacacacacacatacacacacacacataaatatatatctcgtacacacacacacaccactaccttagtacaattttctatacagttcacatatattcagatattagctgggctggtctttacgtctgaagttcttgactttcacctcaccagttcaagacccttgaaagtcttgagttttcaaggaatttttctgatttcccagggcttgactctctcagaatctcctctatcctcatctcaagcttactggcataatgtatttttgtttttgtttttatttggttttgaagagatggggtctgtcttgctatgttgcccaggctggcctcgaactcctgggctcaagcgatcctcctgcctcagccttcctagtagctgtgactacaggcacgtggaaccatgcccaacttataatgtgtttttaatgtggcttttttttttttggcattaacccagacatagaactcaactaccagattattctcaagtttacccaaaataatctattttcacaaggaaaccattactgatcagtatagcccctacattaaaggttttataagtgatacaagctggagaaaggtgggagcacaccccgtagtagacaatttaaaagccattcttagtaattgtcctctatgtcccttttgggctgctttgaccagagacctctcaaacctcccttctgtactcatgtggtgccgccactaggttgatccctctcttccatgacacctctagcccgtaaatatttaacttttttttattagctagtcatactgggcaattcaggtcttccaagttcaggccccaactgcctacaactgaactggaaagtgagtgaggttatctatttaacaaaattctatgtatatatatatatatacacacacacacacatacacacacatatatatttattatactttaagttctagggtacatgtgcacaacatgaggtttgttacatatgtatgcatgtgccatgttggtgtgctgcacccattaacttgtcatttacattaggtatatctcctaatgctatgcctcccccctccccccactccacaacaggccccagtgtctgatgttccccttcctgtgtccaagtgttctcattgttcagttcccacctatgagtgagaacatgcggtgtttggttttttgtccttgtgatggtttgctgagaatgatggtttccagcttcatccatctccctacaaaggacatgaactcatccttttttatggctgcatagtattccatggtgtatatgtcccacattttcttaatccagtctatcattgatggacatttgggttggttccaagtctttgctattgtgaatagtgccacagtaaacatacgtgtgcatgtgtctttatagcagcatgatttatattcctttgggtgtatacccattaatgggatggctgggtcaaatggtatttctagttctcgatccttgaggaatcgccacactgtcttccacaatggttgaactagtttacagtcccaccaacagtgtaaaagtgttcctatttctccacatcctctccagcacctgttgtttcctgactttttaatgatctccattgtaactggtggaatgggatctaattaaactaaagagcttctgcacagcaaaagaaactaccatcagagtgaataggcaacctgcagaatgggagaaaatttttgcaatctactcatctgacaaagggctaatattcagaatctacaaagaactcaaacaaatttacaagaaaaaaacaaacaaccccatcaaaaagtgggcaaaggatatgaacagacacttcgcaaaagaagacatttatgcaaaattctacttcttgtgagagcagttggagttatacagagcaatattttgatttgttttgagctacactcatgtttacttgctctgtgaatggcttactgatttttctcttctactttctaactttacaccaaaaccactattagctccccactatttaaaaaaaataaataatgaggtcaaacatttgttgttgtcatgggcgacatggtgtgtactggtgtgggtgtgagagtgtgtatgtgtgttttgctgtgtgatccaggcatataatagacttctaatacagcttcactattaagatgacaactgctgaaattcagtactgccttttgccctctctctgatttccttatttctctcttagtgtatcagccatgggaagacccaatctttcccttacttatgatgcatctttactggagttgacagctcctttctttgcccatattctcctgcaacacaagtttgtccatagttccatcccctgagaaaacttagacttcaagctgtacccccttatctattatctcttcagtacagaatttcattctttttggaaaattccctccacatatcctagcatctatggcattgtcatttgtggactgatctggccctgacttgtcctaaagcctcattactcttctattaaaaaaataccttctaactttgaaggagaaggaaaaaaaaaagccactcctgatagagaacatcagggtgatagaagggactataaaaatggctcatcaactttattcttcaaaagtatcactataatggaagaaaaaaatgctggaaacttttactggttaaaggatactgtagtaaagagatgtgataactaagtgcagtatgtggccatagactggatcttgaagtggaagatgtacagtgttgtaaggcatattactgggtgaattaacaacactgaaacacagccagcagattagataacatttctgtacaaatataatcatgcaccacataatgatgtttctgtcagtaatgcatcacatatgcatgactatggccccataagattataatgcatcacatatgcatgactatggccccataagattataatactgtatttttactgtatcttttctacgtttaaatttgtttagatacacaaataacattgtgttacagttgcccacagtatttgggacagtcacatgctatacaggtttgcagcctaggagcaatatgctatcccatctagcctaggtgtgtagtaggctatatcatttaggtttgtgtaaatacactctataatattcccacaatgataaaattgcttaatgatacatttctcaaaacacatccttgtgaagtgatgtgtgactcttttcagttcaatgaagttagtaactgtactatgggtacataaaaaaatgtccctgtttagaggaaatactgaaatatctagatataaggttcatcatcatgttgtctgtctcaaatgttcagggaaaataattatatgtataattatagaaagtgaatggggccaggcatggtggttcatgcctgtaatcccaggactttgggaggctgaggcaggaggatcacttgagcccaggagtttgagactagcctgggcaacacaaagagatcccatctcttaaaaaaaacaaattagccaggtgtggtggtgtgctcctgtagtcccagctcctcaggaaactgaggcccaaagatcacttgagcctgagaggttgaggctggaggaaaccatgatcgcgccactgcactccagcctgggtgacagagtgagaccccatgtcaacagaaaagaaaggaaagaaatcaaatgggatacagtgttatattaataataaattgttattggttgaattgtgtccttccaaaaaagatattttgaaatcctcaccacccgtccctcagaatatgactttatttgtaaataggattgttgcatgcgtaattaatttacataatgtcatactggagtagggtgggcccccaacccaatatgattggcatcattataaggagagggccacgcaaagattgacaggcaggcaaaatgccatgtgaaaacagaggcagatattggagttatggagctgcaagccaaggaatgccaaagtttgttagcaaaccaccagaagctatgaagaagttttcgtgacaaattttagagggagcatggccctgctcacaccttgatttcagacttctagcctctggaactgtgagacaataaactctgttgttttaagccacccaatttgtagtacttggttgctgcagtcctggaaactatatatatatatttagattgtagtcaccttgctgtgcggtagatctcaaaacctattcttcctccagtctatctgagactttatatcctttgatccccattccctccttccctacacttgcagtctctgggagctatcctactatccttatactctctgcttctgtgagttcaacttttttagattccacgtgtaagtgagatcatacagtatttgttattctatgccgggatcatttcacttagcatgacatcctccagatttatccatgttgtcagaaatgacaggatttcattctttttcatgtctgaatagtattccattgtctacatattccacattttctttatctgttcacccattgatggatacttagcttgattacatattgtagccattgtgaaaaatgcttcaatgaacacgggagtgaagatgttcctttgatgtattgtttcagttcctttggatatataaccagcggtggtatatattcctggataatatggcagttctatttttagtttttcaaggaacctccatattgttttccttaatatttggaaataactgctattctgatgcaatatagaattttgtagcctaagataagacatatgggagggaaattagcatgtgtttctaagtttggttacctacacaggaagagaaatattcaacacctttacatgtttggcacttgttctgattccagaatatcggtaagcccaccactgacaagtgtcactctgggaatcacatggctattctattcctggaggtttgccatcaaaaacaaaggagcttggcttcctaatattttaagagaaaatattccgtgacacttagttacctagtttggcttgaagcagcctaaagcatcttctaaatgaacttatttctggagatggaattacattcttggcaggaaataaaagaagtcaactttctctgtgaattttcagtaaggattgtggcattaccttatatattgttaagcttttgataaatactcacatgtttgtctgatccatttttgagtataaacttctggaaaaaatctagagatgatatagaaataaataaacttctgcaggtcctataacccatggtatctatgcttaatgaaaattcagaagaccctaatttatacaaagctgttatgtcatctcctaattatattctgtaaagggaacaggctggaattgatgtctctttgctgtttttcagatactctgacttttttgtgttatttggaaaggactgatatgaggtatgtgtgtgaagtgctgattgtggagagaattttcaaaagtggtgtgagagtgtttgttgacatggccaactttatatttttacttttctgtgaaccctactgtgaatcctggcttctatcatggactttaaaatcttttacttaaagtataatctgagaacatatttgttcttttattcattggttggttggttcaatagactctttgtgcatttgttcaatccttcattttatcatttcttcatcacttaattatacggccaatacagaaagtatttattgagcatctactatagtgctagtcatgtaacctctgatttattttccacaatttttgttggtaccattcattcatcattcaacagttactagtacgtaccctataccaagcataaagaaatatagacaagggatcttgctggaaggccgttggctttgttgactggggtgtgttatgtgtgaatcactcctatcttgtttatgctctaagcagtgatccatttctatcctatgaaaaagaaatgcctgggccgggcacggtggctcgctcctgtaatcccagcactttggaaggccgaggtgggcagatcttatgaggtcggaagttcgagaccagcctgaccaacatggagaaacctcgtctctactaaaaatacaaaattagccaggcatggtggtgcatgcctgtaatcccagctactcaggaaggctaaggcaggagaatcgcttgaacccaggaggcagaggttacggtgagccgagatcatgccactgcagtccagcttgggcaacaagagcgaaactcggtctcaccagaaaaaaaaaaaaaaaaaaaagaagaagaagaaatgcctggactcagaactatttcattagcaaatcaaggaagaaactttcttgaagttatagcgactattaaggaacctttacaatttggcatcacttccctagttctctcttctccatactggccctgggcctctactgctctttctagctttctgcggatgctctgtttacctggattcatcctgtgtatgtagtggagggtgatggcacacttttaaactgcaaaagctgtcattttcttttcattctttcttgatttgctagccggaattaattgatatacatttatgaaagaagaagcaggaaagaatccgtatgaattattctgcatttacaatttattgagtacatatcatgtgccaggatcatagttcagtgccttaatgcactacatttctggtaatctgcaatataatcctgtggggataggagttgcttttttcattttataaatgggaagatggagactcataggctttgtcagtcttccatgttaaaatatctcatcaatggtcagatctggatttgaatttcatgttttctggcataaattttctgctttcagctgtatcctaaataaaaaataccagtcttgtgaaaaaatgagagatgatggatatagatacatactttttaaactagagaattctgtccaggcacggtggctcatgcctgtaataacagcactttaggaggctgaggcagttggatcacttgaggtcaggagttcaagaccaatctggccaacaggtgaaaccccgtctctattaaaaatacaaaaattagccaggagtggtgttgcatgcctgtaatctcagctacttgtgaggctgaggcaggagaatcgcttgaacccaggaggcagaggttgcagtgggctgagatcacaccactgcactcccacctgggcaacagaggaacagaggcaacagacactctctctggaaaaaaaaaaaaaaggagagaattttggcaatgtagaattctcttgacgggaacagtatagcagatatttcagtttcagcacatggggttcctgattagtgacaaattcatattgaaccataaatctgtaatactgtcatacaaggagtaaaatgtagttgtcttcttgctaatgctccttggaaagtttcagtcttttcctattaacttggttgctctcagttttattaccatttgaaatatatatcttctcatatcacagcaaaaaataatgactttggatgatgagtcgttttaatgtttgaacagaattacacatagaattcaaactgttgtcagctttcaagtttgtattatgctgtttcctagcaggtacatgcagactgaaagtatttgtatcatgatgatttttactaactttacagtaattttacttatgactttacttatggttgtgaaatcatacagagatatgttatatcagaatgtcaaaatgcttgttttaattaagatcccagaaaatatttatttccaaatatccaaatttataaataactttggagctctgaattagcataaaatcagtcaagaagaaaaagagagtataaaaaaataaaatatatttcctcctctcccttccccatcatcagggactttcatagaatatactcgagacttaatctgcttcattttgaatttcattttcaaagctatttctttttcaggctgcccattacactttatttgaaaaccagctcttatcatttagtcattattgtcacagatcccaagttcttaaattatgctcatcacaaaagatactagttttatgttctcatcccattcaggggctattccaatataccagccgagggccacattggtgacattcagcacagatgacagcttttgttctgagcaggcacacaaagaaatgactggggaagccgaatcatcgtttcactaaggcaaggaagaagtgtctttctgggtcatgcagcccatggccaagagatgtcagaatacctacagcaaacatataagcagtataattagctcattgtctctagctgggaggaattccccctcacttggcattattaatccagacctcctaaaggccaaagtgttgatagcctgcagtttgctgaaatacatattgaactatgcattcttcaaaatgcagctttagctaacctcctgcatgaaggattctgtgactccaccctctacttccttcttcccagttgtattatgttcctaccactattctggcatttctcacgtgtacttttaaagtgtgtgtgtgtctctgtgtgtgtgtgtgactctctttttgattgtgagtttttctactgcagagatccctccgtaccttctctccccctgtccctaccatatttttattataaatatttttatagattgatagctttgaaatgattggattttagcagtataatagaatgaaacacctggattctgcttctgactccatgagtacagggagtcattgaataatgattcgttattatttaatgcttttatttaacatgtgctaattgagtgcctcctatgtgccaaactgttctggtgctgggaatatagtgatgaacaaaatagtcaaaatatagacaagacaccgctgttctcctagagtgtgcatttctgtgaagaagacagacagtaaataacatagcatgtaaataatcaagacaaacacccaatacatggtatgcagagaattaaaacaggaaatgtgtaagttgttactttaggttaggtagttggtgtagctgagatctgaagaaaccaccaatgaaggttaaggacgttcttaacagagggaataacttgtgtagagactccaaagtggcaatgaacttgtcatattctaagcatatgaaggtcattgtgatgagtatgttggatgaagatgagctatcagagaaataaaaaagatgagtggtttggattttattcttgatgcaatgggacagcattggagactttaagctgcacaaggttatgatttagtttattttaaaaacattacccctgcagtatgtaaagaatggattcacgaggataaagagatggtagggatcctccgtaggaagttattactgtagcccaagcaagagatgattcattgttctatgtggtggtagtagagatggagatgggtggatagattttgagatatgtttgagatagagttaaagatgtgctgatggtttggagaagttaagtaaggggagaaatcaaagtcttagtaaactttggtaagtcacttaaatatttctagtaacaggcccttcataaaatggggattacagataaatcactggttcccaactgagagcaactttgctcctctctgtttcctcccgggacatttggcaatttctggaggcatttttagttgtttatgtgtgttgagggggaggggttctattactaacattggtaagtacaacccagggtccaaaacatcttacaatgtacaggaccaccccttcaacaaagaatgatctagcccaaaggtcaatagtgccaaggttgagaaaccctgaaatagcaccttacaaggtggttgtgaggaccagctaaattaatatattttaaagcaggatgaaagttttaaatgctctgcagagacaaagtgttattgatgcctcaattttacagtgtctgttggggtaaagataattcattcttgtagttccaaagaatctcttctctcctggtcctgaatgaatgtggtgcattttgaatgtgatactttgggccatagcccccttatgcttcagtagagaagcagagaagaattgaaaatttgggcttcaagaatttttttgactccactacagccataatttaaaattttgtggtagaaagtctggttataaaattcactagaaatgagttttaaagtaaacttatttttaaaaggaagtagtgggtgggtgaatgtgagactttagggggattgtgccaccttttttccctgagaaatgccaagggaactaattaaagaagctgaagggagagcaaaggcacgaatagagtagcctattctccattccttctgtgtcaaacaccccacgctacactctacactaagctcttgttagtaacctcccacaggacagggcatttgccctccagaaagttggaccttaaaatgagggaaacaagtaactcttacctgtaattagcttcaagaatactccctcaaatgaaagagaagttaaaaaaactgcctcaatgagttcttaattgggtacaagataatgttggtagaagtttaaaatatttaaccagcagtaaatattcaaggcagtcatttgaagtaatcaatagctaggtgaatgcatacattagctggcagagaatcacttaatcaacagttcaaataaacaagaggagaattcaaaatgcagatctgaaaatacagagaattagcaaagatgctaattacatccaggtaccttcttcctccagtgactacttaaacatttgccaaagtattgctaaaaataaccagttctgaaaagattcatttcttttcagaagagctgcttacttagagagtgattgatggccaggtccagcaggcagctagaagtacccaaaaatgaagtgctagtaggtgacctcacaataaaaagccttgagaatccttcagctggcatgcgctgctggcaaaaaaggatatttttttaaatttttatttttagtctttaccacttaaaattttcagacttttctccccgcttcagatattatatgatagattttatcagatagacagtgagccatttatgataatatacagaaactgacataatgcatgatttggttcatttaaaaaaatcttacttatcttcttttcccaatccttctcaaactcgtctacacttcccacatataaaataaaatatattaaaaaggcttaaatcttacacaggaggctatttttagtatctccaactagaagactgaagctcttaactcatctactagagtcacttgttagaaggagactttcctacaggcatttttattttgctttttgaaggaattatgacaccccctccccaccaccaaagaattgctgtttctacctctagcttcagtagccattaagcagttcttcattttgaaggatacatatagatccagaaacattttctggttggagaaaaagtgtgtattttcaaggttccctatctttaaggttcctagttcttattaaagtagcaggataatcagcttaatgggtggttgcttacgctttctgtgggaaaaccatgggggtgggagttacaagtatttgttctaatttcagcctcattactaactagctgtgtagacttgggcaagtcatttaccttgaatttcagcttagaggcaggattgttaaaataggatcaatttgtaactggatttgaaacctgatcagactattagaaccctactcaagacttaattactgagtctaggtgtttccaaagtctcaaggtgatggattcttttacagccagtgtttgtgcatcactgataattcattcccttcactttgcagcactgataattcattcccttccatttgcagactatagaaatttaagtttcagagaagcttagtaatttacttaaggtcacatagctagataataatgaaacttgaactttaaatgtaacttactgacccccaagatattgctgtttccctattattaggtgcttatttaaccggagaattgccatgtgttttttgtaacaattacattttttttttctttttgagatggtgtcttactctgtcacccaggctggagtgcagtggcgtcatctcagctcactgcaacctccacctcccaagttcgagattctcctggcttagcctcccaagtagctgggagtacaggtgcatgccaccaagcctggctaattattttttttttttttgcatttttagtggagatggggtttcaccatgttggccaggctggttttgaactcctgacctcaagttgtctgcccgcctcagcctccgaaagtgctgggattacaggcgtgagtctctctgcctggccacaattacaatttaatattaaaatatatacatatgtgtatttctatacatgtgtgttgacttttacacagtatttaacattttcaggtgtgtaaaatgaaagcattaggactaaatgatcacatagtgactatttggctcttttagagagaatgtgaatcactacctaccatttcactgatgcacactgtttaaaagatactatgctaggtgttacagttagaccctgagaaatggggtgctactatgatgttgttatgatagccatgcatgtgaataatatccagattctgcttggcccagatacctctccttcctatcatatttctgggagaaatagatgcttaaaaagggaaaagaaagcaaagtagagcatgttatatatacctgggtctttggccaaggtacaacagtataatgtcatgggccatgagaaaggctctattttctctaagttaattagagaaaatgtacctgctccagtacgttcctgaatagatgtatccttatacctttgtagagggagcaggcactaagtcagctcactactccaattcatcatattgggaaagaaaaaagagaaaaagctagaacatatccaggtacattggccttctgacctccttgaaagcacaactcctaagaggtgtggcccaactaatgctgtatgattgtccaaaccagatcaataacactccttttggtagaagccagtaaacagaatgttgagtataacctgtttatacagatgagaaatctgacacataagttcaaattacaggcctaaagttgcttactgcatatttcttcccttttctttcatagcttcatatatgtgtatatatgaatatgagtggtatgagtgtatttcaaacatacatatatattccaaagattatcatgtaaatgtcataaacaattgtaacatttaaattcttaaatttaatagtaagatatgttttataacatgtatctgagtttttatattcattcattgttatattccatcaggagtcatgtgaatacttaaaaatgcagagcaggtaacttttaagatctttgattatacactttaataaataggttcagtaaaattcacatttcttgacatattcattactcagcaagaattgcatacatctttttaattattcccaaacattcaataccttcaactcttaacaatgaattaattcctttgaagttattatacacatttaataaaattatatgtaactacgcagaaaaataatataagcttctcttttgatcctaaaagtagctaattcaactgtttctttctgcagttgtaggaattgttcacagattcttcttgaagttttgcacttttgtgtatctctacttgttttattggttaagcaaagtaaaacttctgaatggcttttgaaactgtacacaaaactcataaacacaacctttaaacaactattgttaaagtaagaaaaaaacaattaacttataaatctttttcctcttttcagatgtaggtcacaaaggagaaatgctcctctgttaatttttgtttttttttaaaagaactgttggttttaaacttctttttagcctactcactattctcaaaggatgcaaggcccccccatgggataaagtcagctttgtcagaggaatatcagcatgtcagctcctgaagaaccacttggagtttgaatagtaacttattgagtggataattgagaaagctgagttaggacaggatttctggccctaataacatatgaatgtctcataattatcagtacagaatcctatgaaatctaatgcttactttgaaacatatttatttaatttatatgtaagtatttatttatttgtactagacagatacaggttgggaattacttaggttttgcttaataaaatagttacttttttcaaaaacatgaattatcttttttctttttggtgagaagaggtcatgtaaacaccaattgtctagcaagatttttgtattgctttttattagggactgttggttttaaattgctttttagcttactcatcatacttttaaatacatggatagttttctgccatatccaagatatttttaataataaaaagtttttttatttctaaatatcaatattattatgatttttttccaccagtgaaaaaatacagtgataatgcagggaagtataattactaatttattttgtaatataattataaaatatatgtaatataattataatatacttaatattttgtaatgtaattacaaaattaaacctaattttatacttctttgaatattttgggagtcaggtggtttttctctaactcaaacttctaccagagacttgggatcccatgaactgtagggacttctgtattcctggaactggtttgggcctcaaataaaacctgctcaagttctcactcaatcgtaagctcccaaagggcagagatgatgtctctctgattttcaagggactaacccagtgacaggcacagaatggccatttagtaatgaatgacaagggtgctcatgcaattttaaaacatagtccctcagcttttctgcctttgagtccaataagcatactagaaacccagaacgaagctagtaatatttgttccagtaaagtgacatgtatatggttttcaaaaaaacagctgtttgttttttttagaagcataagattattaaataaacttctgtaatgagtggataaaatggtgtatcctatgaaaacaaccaaagaatcactgaatcagcagttctgaaagataaaagtctcattttgaggaaatgcaaaacaactgaatgcattttattactttgcatttaaagtaggaaggtggcaaatactcggaagggtattccagttctgtttctttgtaggcagttatttttactgacaggtgagagtgtttcacctttatttgttttatagatacaagctcttacaatgttctttttccttccatggaccttctcctcttctatttcttaccaagtaaattattgaaacaaggctattttgaggtaaaacgaggaagagaagtaatacctcactgcaacctctttccaaacaatagggaaacatcaaagttagggtcaaagctaatactgtcaacttataaaagagctcactcatcatgtctaactttctttgacagtatctacaaaggcttctgtatctagggatgattttattgtcaatatgcaatcaggcaggtcaatgttcatttcatttgtgaagaaaactacatcaagcaaatttcattataaaacctaaaatcaatatacatttgtgtcagtgttctctaaataatgaatgtgaatactccttcaccctgaaataacatttttaaggattggatttttctgaaaaaaataagaagacatatttggtttttctttgaacaatatttgcacttgattctaagacagtgataccaggaatgacttttggagtcggttttgttttaaatatgtttattgatcaattatggcccctatacaagttgagactgactcgagtaatgaaatattcagacctatcaactggtaatattagaatagtgataataagcatagctagtatttgcttagtatgcattatttatggatactgtgaaggaattttctttcatttttcacatttagtctttgtaaactgccttaatatagaaatacaatacagggatacctcatccgattgcagtttgcattactgcacttcgcagatactgcttttttttttttttttaaagaattttaaggtttgtggcaactctgagttgagcaaggctattagtgacatttttccaacagcatatgctcactttgtgtctctttgtaacattttggtaattctctcaatatttcagactttcttcttattattatattgttacagtgatttatgatcagtgagctttcatgttactattgtaaatttggggggtgtcatgaaccaaactcataaaagatggtgaacttaattgataagtgtagagtgtgttctgactactgcagctaccagccgttcctagtctctctgtctctcttaggacctccctattctctgagacacaataatattgaaattaggccgattaataaccctccaatggccttgaagtgttcaagtgaaaggaagagtcatacatctctcactttaaatcaaaagctagaaatgattaagcttagtgaggaaggcatgtcgaaagctgagagtaggccaaaaaggtaggtctctggcatcaaacagctaagtcgtgaaaacaagggaaaagttcttattgaaaattacaagtgaacagacaaatgataagaaagtgaaatagccttagtgatgagatggagaaagtttcagtggtctggatagaaggtcaaaccaaccacaacgttcccttaaagacctaaccctaatccagagccaggaacgaagtgtctaaaattatgtgaagatagagaggtaaggaaactgcaaaaagaaacatttgaagctagcagaggttggttcagaagtttaaagaaaccagcaagtgtgatgtagaagctgcagaaatttatgcagaagctctagttaagatcattgaaggtagctacaccaaagaagagattttcagtgtagatgaagcatccttctattggaagaaaatgccatgtagggttttcatagttacagaggagaagtcattgcctggattcagagcctcaaaggacaggctgactctcttgttaggagctaatgtaactggtgactttaagttgaggccaatgctcattgaccattctaaaaatcctaggaattattttcaaaatattactgctcatccacaatgcacttggtcacctaagagctctgatggagatagacaagattgatattatctccttgcctgttaacataatatcctttctgcagttcattgatcaaggagtaattctgactttcagctctaattatttaagatatatacttcataaggctatcagtaccatagatagtgattcctctgatggatttgggcaaagtaaatttcaaaccttctgggaagaattcaccattttctatgccataaagaacatttttgcgaatcaaaggaggagcccaaaacagcaacattaccagaagtttggaagaagtttattctgaccgtcgtggatgacttacagaggttcaagatttcagtgcaggaagttaactgctaatgtggttgaaagagcaagagaactggaattagaaacagagcctgaagatgggactgaaattgttgcaatctcatgataaagttgaaatggataaggagttggttctgatggatgagcaaacaaagtgattttctgagatgaaatctactcctggtgaagatactgtgaacattgttgacataacaacacaggatttagaatattatgtaactaggtgataaaggagcaatagagtttgagagaattgactgcattttgaattgactgcatttctgctgtgggtcaaatgctttcaaacagcaccacatgctacagagaaatctttctcgaaaggaagggtctatctatgcagcaaacattgttgtcttattttcagaaatggccacagtgaccccaaacctttagcaaacaccaccctgattagtcagcagccataatactgagacaagaccctctaccagcaacaaagattacaactcactgaaggctcagatgattgttagcattttttagcaataaagtatgtttaaatgaaatatgtacattgttttttagacatactgctaaaaaacaatgcacaccagatagcctacagtgtagtgtaaatgtgacttatacacacggggaaaccaaaaactttgtgtgcctcactttattgtgatattgttctgttgatctggaatcaaattcacaataattctgaagtgtattcctgtagcctgggtaggctaaatgctataagcaatagccccccaaatctcagtgtattaacacaatagatgttttaatatcgcctagcagctgaatacaaatgtatccttctatttgtggcccactattttacagagcctctgagtcctctgctatgttcctgtcaatctcacacaagaggagagagagaaggtgaggatagcacagatcttttacatgagtgggcactgggagaggcacctatctcttcatccacattccctttgggaaaacccatcatttggttacatctaactgctaaggagcttgggaaatataatcaagttggctgatcaagtagctatcctctcccataggtagtgttatacccctttatagatgatgaaactaagacttaaagttcaaacagtattccataccatcagcatcatctacgtgtataatggtaacactgagtctccctagtaacaaaaaaggtccctgttttttaagcactgtggtctccttcaaccctgtgctgggtagtttgccacttactatgatttaccctggaaacaaatggtatcttcccattgaaaaggctagctggggagatgcacagctgagattttgactttatgttttattcagggtccaacgcttgattttgtagtagctctattgataaagctaaaatttaataacagaagtaataagtacaacttctggggaaaattttaagaatcagttggcaattcctgtgctccttctttcctcctattatgaaacaggcagtgttctaaataaagctattctgtcaaactgggtccgtattgactttgataagcaagtgctctctgtgggcccatattggatgtgtaatatgagtaaaaaactttccataagtccccgagagctttatttttattttattttgtactggtattattatcaaagcatagcctagcctttcctggctgatacacactttagcctagaatctctactttcagtgtcttacaaaactatttaccaaggtgtgtaagatatgtatgtccctgtatctatttgtctatccaatgttgttcaccagagtcttgtttaataagttatggttgagagaattatgcttgtccatacaatggaatatgtgaagctgattttaaaaaatgatatgatagatctgtatttacctacatgaaaagatgaccacaagccatgattacatggaaaatacataaaagtatatgcatgatatttcacagagtaaataaaaacttattattattgtaggagaatagacttcccaggaccctgaggagctggaggaggtgacagcacgctgcaccattcccaatgtagtccaaggttccggcataccattgtctgcctaaatcaccaagttagcttccttaatggtctccttaccttcagtcttggccccctccagtacattttccacacaatgtagccagtgtaatctttataacagatgattcacctattaaaaaattggggattatctccattgatagcatgtaaaaatccatgtcttagccttgggttcctaaaaaacagaggctaagacaaaacttaaatgttaaacctttcctgggatttacagtccaatgcagcaagagtgagagtctcaactttgcttcactcttctctatggtaagactcatctgtctcctagttgcccactttgtttcacggctttcttgacatcttttgtctttttgaatctgcccatttccttcaatacatcaaaaggtctttggaagcaaaggcgttttgttattaactgttgtatcttcagaaataaaatcatagaagaaaaacaaatcatgatgttttcaactaatgtttgtcaaacaattatgtttagcccataaaacaattttcctgataattgggttttcagagaattcttgaatcacgcagtgtgtattaggccatttttgcattgctgtcaagaaatacctgaaactgggtaatttgtaagaaaagaggtttaattggctcacagttctgcaagctgtacaggtggcatggtaccagcatctgctcctggagaggcctcaggaagcttttacttatggcagagggcaaagtaggagcaggcacatcatatgtcaaaagcagaagcaagagagagtgtggcgggggttgggcgccacacacttttaaatgaccagatctcgtgaaaactcactatcacaaagacaacagcaagccatgagggatccacccccatgatccaaacaccccaccaggccccatctccagcactggggattacaattcaacatgagatttgggtgaggacagaaatctaaactatatggcagcatctgttgctttagttctgcctttttctgtaggttcagagcaaacttttcctaccgtatgcgttgtgtagttttatgtcactctatgccccacattgattttcttcccttatcaatagaaaactatgtgtacgttttcctacatggattataataaaccccttttaaaaaattttcatatataaggcattctaaaacctgtatgataacacagatttgtctgtaccaactactaatgaggaatttaaaggaaaaatttagtgaattcctcacattgaatttaaatttttattttttttcttggttgttagtttaaaattttgaaatctcagtctgtagcattcttccacatggccagccgtgacgtgactcatgagtcaccaacccatttagtcagtcaaattatttaacaagcatttaccaagtattctgtatgagcagacttatggataggctaaggccaactctctgacatatactgtatagggtatgtttttaaaattttccctacattaatttctgttgtcatttttgcatttagctcagtacagatattctgattctgatgctttaaaactgttcctttctctttctttttttccttttgagatggggtcttgctctattgcccagacgggagtgcagtggcacaatcacagctcactgtaaccgcaaactcctgggctcaagcaatccttctacctcagtccagaatagctgggattacagatgtgtgccaccatacctggctatttttttttgtattttttgtagagatggggtctcactatgttgaccaggctgatctcaaactcctaacctcaagtaatcctcctgtctcagcctcccaaagtgctgtgattacaggcatgagacaccacatcagacctcctcatcatgttgaaactcttcttgaatggacttaaaatgcttctgtattagtctgttctcttgttgccaataaagacatacgcaagactgggtaactgacaaaggaaagaggtttgattaactcacagttccacatggctggagagacctcacaatcgtggcaggaggcaaatgaggagcaaagtcatgtcttacatgacaccgggcaagagggtttgtgcaggggatctcctatttataaaaccatcagatctcatgagacttactaccacaaaaacagtatgaaggaaaccaaccccatgatgcagtgatctctacctggccctgcccttggcacatgaggcttattacaattcaaggtgagatttggatagggacacagccaaaccgtatcagctacctaccaatttttaaataaactttaatttagtttaaaatagtgttttttcaattgttgcatatttgaattgactgaggactttaaaaaatggcagtgacatatccctgctcttagagattctgatttaatttatctgagatgagaaccaaagatattttctaaattcaccttgtgcaattcccatatatagcttgggttgagatttttgactgaaaataatatttcccaaaatgtgatccacagatcattggagatttttatgaatctttgagctcatcagagcgctcatgatattaatgtggatttttttcctgaaatgaaataatgaatttttcatttttaaacctcctaagtatcttctcagaatgggcatcaatctcataaatgctgtggtttgtttggtgttagttagcaagttaggaatctggttcactgaatgaaattactgttttaaagtatcagaaaggacacactgagaatgttggagttgagagttttagtcaagcacatttaatttatggatgaggaagttgaggccagagaaatgagatgttttgtctaacttcacatagctggtctgttcaacactacggagaatctggggctcgtaactttcagtccaatattctttctgctttatttaccccttgcctccctggagccttgtcataggcttcaggcttcacttgttccctctgagccatgtcctaaaaattccaccatttgttattttaatcccaatgctaaattctaattaccattcagtgaattactgtacagtaagcagatgtgtgttattttctaggggaaataaaaagctggaatgtgatctacacctgtaccttcagcagtgtttctccaccaagaagtagcaatcagcattaatatataaactcaagttgccagagtctcaaatgtagcatatgcagagtgcagggtaagggtttctcttgccaacagataaaatgcactccaggctcccattggtgttcgcaaatgccagtcaccaaaagtcagctttccccctgaaaagcaagttttgtttttgcacaattaaatggtaccttggtgaaatgagatagagcctttctcataggaagtgatttttctgggagcataaagtaacaaaatgaatctgttgtggatgtgtttttgttgttgttgttttcttatattgcacacaactttttaaaatgacagaagttggaatgaggttggcaacaaaccacgatgggctcattggcatgctatagcccttattgtgttcagaaattaggatagaaaatgcttggaggcttatttcgtactgtgattcattgcatcatgtcatctagtggagtattatgtttgtttcattctaatttcatggtgataaattctgtacttttcccacctgggcttaacctaagtggtctccatgattgggaggagggaatgattttttaaatgtatatttgctcaagatttgctcctggatctcctgaagataaggtgagtaatgtggtgaaagtacttcctctcctgagtatggaaatctggttcagtggtagcttaaggggatacacacttcaattgaagtctgaagcctgcatatttctacatcctcaaacaggttagcacttcggagcagtggggggtttgtctctcaatttagacacctgatgagtagattatagtgaccagtttcaaatatgtcttcatggtagtcatccatgatcagacaaatgatcagatttccgtgtatttaatattgagtttttataaatgtctgtcattttcttttcttgaaaggggtgatgtccatgcctccatctttcttttacctttcaaaaattagtgatggtagcaaaacagacagtttctcagattgaaggagaggaaaattatgcatgactgaattttgacattatgagttgacatcacagcatacatcctcctaaagtacaatttgacaacaaaaaaatcacaaggtcagaaagaaaatcatagagcccatccactcaatctcttgaaatcaatcataatgatcaagtgaaaaccatcaaacccttaggtaggatagcatatctgtgaggagagtgttaggctgcatcccagtaggtacattaaaaaaaatctcagtgagtatactctttagcattgttaaatataatctgatattcttatttaatagtgattcagaatattggaggtcactcaaaaagagaaagttttgcaaagaagaaaatactctttcgggattttaatttttaaaactaaattataaatattcaaaacataatgtacagaagttgataccaattcatatccatgtattcacagcctttgaaaaaatgggattatcttgctttaggttcagtttagttacagacgcaattgaattcttaaactacagatacaaacatatcctttctcacctctatctcttcttttctgcctcttcagatgtattaaatattccaaagtgaatgtttccttcttattcatgagtttatacttttgttacaaattcatttatcaaaaaatgtatagtatttggtggtgttaacatatatttaaatgacatgctataatacaatatccttggctgctggcctgcttccccctgtatttgatatgatcaacatggattctagttcatttattttaaatgcagtgtaacactattttctgactgcaccatgatgtatttacctgttcttgtactactgggcatttaagcttctttttgggaaaccacagcagtgagtttttcctggtatatacagcctcctgatataaacatttctctagggcatattcccacagatgttgaatcactgggttgtagggtacgtgtgtcaactttactagtattgccaaattgttttctgaaatggttgttctaatttatattcctaccaacagtgttaagagttcccttaggctgggcgcagtggttcacgcctgtaatcccagcactttgggaggccgaggcacgtggatcatgaggtcaggagatcgagaccatgctggctaacagggtgaaaccccgtctctactaaaaatacaaaaaattagcccaggcgtggtggcatgcgcctgtagtcccagttacttgggagattgaggcaggagaatcacttgaacccaggatttagaggttgcagtgagccgagactgtgccactgcactccagcctgtgtgaacagagtgagcctctgtctcaaaaaaaaaaaaaaaaaaaaaaaagagttcccttaaacttctacacttttggtgggagtgtaaattagttcaaccattgtgaaaagcagtatggcaattcctcaaagaactaaaagcagaactaccatttgatccagcaatcccattactgagtatatgcccaaggaatataaatcattctaccataaagacacatgcacacgaatgttcactgcagcactcttcacaatagcaaagacatggaatcagcctaaatgcccatcaatgatagattggataaagaaaatgtggaacatatacaccacgaaacactatgcagccataaaaaaggatgagattatgtcttttgtggcatcatggatggagctggaggctattatcatcagcaaatgaacactagaacagaaaaccaaataccacatgttttcacttataagtgggagctaaatgatgagaacttatgaacacagatgtggaaacaacagacacttgaggtctacttgagggtggagggtgggaggagggagagcagaaaagataactattaggtactgggcttaattcctgggtgatgaaataatctctacaacaaactcccgtgacatgagtttacctatgtaacaaaccttcacatgtaccccgaacctaaaataaaagttaaacaaaaaaagaatgcaaaacaaacatgaatcaacacctagaatgagtaattacatgagcatgttaacaatattaatattttgttaatgaaactaagggtggtggatttcaacccccaaattttcatagtgtgtgttacttttataatggaaaatgtcccaataaactatttttaaacctaaaaaaaggagttcccttaatttgcttatagttgatgttatgccctggctggttccagtctgcatacccctcctcactccatagttacggcctcttgaaaagtcttgcggtctcagtcttatcaacttttcttgaacagatattgccctttcttagcaggtttgatggagctgcaatccactaccctttagctcattggtgggttgtgcctgctgcaagtttgggttttattttatgacttcaaataactagacttctcttttatattaaaagctcttggccccacattctgaaaagtagatctttctactctatctcagctgttgctttaggatcctacatgaaatgtaggatgagactttatctgacttaaagtttctctcccaaggattgaaattcagcctctgaaattcagtctgcttcccgggactttgattgatgctcctgggcttttctgtgacatgagtcttcctcctcatgcttcaacaaccctctcttgtctgcttttggacttctgtctctatttctagaaggttgtcctttatttgttaccatacttgcaagcagtgtgttttctgactgggctccctgtcttgtcgcctttctgacctcgagggctggtctagttccaggatgagttaatcttgttcctctatggattctgccattgatgccattaaagaacaagatttattgctgtcacctccagaagtgatttcatgctgtttgaaacaatcttgtgcaaagtgttgtcaattaaaacaaaaccaaacaaaactgtttcctttttgagtaatctttgaaaatcataatcactttcaggagtacaagatattccaatgtcttctccatagatgtgactaatattcacattctggtggccaagctgcaaatgactgtctttggctcaaatatccagagaatatcgcaaaaccaaaggcctgagaaaagcattataaagagagagagaaaaaaatctctttaacaagggatttctgaagtaatatgtgttcattttagaaaatttggaaaaatacagcaatgcaaaaagagaatcatagatgaccttagaacaactattaactttttgcaccagttgagatataaacatacccacgagtatattagtttaataaatgtctgagtgcctacctagatgctaggagtaaaaagagagtgataaataaatcaaacgtagatctaccacttagggagtttaaagtctatcagagggagtcaagtaacagataaataacgaaatttgtgaaaaattggaaggctggtatttctgacaaaaaatcatttcctctgagtttcacaggatgagaaaaacaggcacgtgaagatcaagggggagagtgcttcagggaaagggaaatgcatgtgaagaatgtatacaggcatgagagaggttttattgcctaaatttaggaagagacaataacggctttttatggtggagtcaaagggagctaagaatgtatacactgttaaaatgtgcaatctaattttaatgtacaagtagtaacagatgaattaaaaattaaaaagatgtactttagaataaaataataggatatatttttattttttatgaaattgcaaacatgtatatactattttaccactttcttttaaagcataagtctagctaggcatggtggcatgtacctgtagtcccagctactcgggaggctgaaggaagaggatccctcgagcctgggagttcaaggatgtggtgtgctgtgagcgcacctgtgaatagtcaccacatgccatccaacctgggcaatatagtgagaatccatatattaaaaaataaaaaaaagttttttgacacatagccaagtctaaacatgtagaaatttacagattggcttaaatatttgtgataactataaaaattccacatctccagctgtctatatgttattcttacacacgtatgtagtactaaaccaaagggatctttttccctgatacaaatgtggagtaaaagtttacatacagcaaagaaggattgattccagcctacaattctactccctagaatttttctatcatgaatgaagcccttccatttttcatcacgataggagtggtttatcagattttcctagagcaattccaattttgcttatcagttaggactaaaatgtgtcatcttcctttctatatttaggaactgtaggaagctgtgctatggcatgtgagatgtgaggagcatctgttagagagaatgccggagctgaaggtgtgagaggtttcaagaaacgataagctttgggctcagcttccccctaggattacaaagggcttgcacatattagagagctaatttttagcatatttccatgaaggcagattttatcttccataaatgcttagattcatagaaatggtgagttggctcaatgctgatccttttatgtctagcttgatgtttacagtaactctggaggtagagggttagtgatttatattttaaccagttccttgtttaacacaatcatcttatcttggctattgcttaacactttttttagggctccaaagaaatacatacatatgtataaaattgttttggatttttgtgtcccagtgttacagaaaatttctagaaatatgcatgaaccagtcagatattctctaagtgagtttaattttatttctttgacttacattttatttctattagtatacctttcagtgttacagaaaggcagatctaccatttgtgttacgttggatttttcaggccattgcatccttttcctgtttattatgttgaggccccctcagttatccactgaactgattaccaaacaacctctcctagagttttggtgttatctctacctgttttttcaaccacgttctcttgaaagaatctttaatttaggctcatatctacaataaaatataataaaataatggctttatttttgttttaattatgacaaggtaatttatgcctgatttgtttatttacttagaactcataatagttattcacatttcagcctgatttaagcattattttttatggttgttttgagatggatcttaaaccatcaaatgttcccagcaaaagatggcatttttttcagaaatatagacattaaacttaatgaaacttactttgccaaattcataccatgcttctatttatttccctatgataaataccttcttacatctcatttgtttcagattatctttctacttcctattacccaagaaaatattgtttttttgcttgttcaggtcaaatgtttaaatcaattgatcaatatttcagtacttgctgttagacaaatacaattactcatttcttctctgccatcactcagagtgttttctccttctggtatactgttcctctcttgtcatgttcttttactttcactgaaacccttcctcagttttaaagtggagctcaaatcacacattcctggtgtcagtttgtccattttctggatttccccagatcttctcatttggaattacactctcccttcagtaatcattcatcatactgtgaacacttatcaccacctgccttgtgttctatgtaggtgaggatgtttttgttttcccactgtggtaacaattactaatggacaaattccctacattttgtaaccctcagggtacttaccttattcataatatgtttccaggaatgttgagtacattaaatgagtaagtttcttagccaaggtattgattccattgaatttactggtcttcaaatatttgtatctgtctactttgtcaagatatgtaagaaaggcaatgaatgacattaatattttccatggaaactaccgactttcagttctatgttacctcctttcagttctgttttacgtctgttttagccttgcgttatcaaatcaattaacttttgaagcctcagtttgatcatctgaaaaaaggaaataatgatatctcctcattgttgtgataattacatagataataattgcaaggagcttgacaccatactgtagcatatagaaagtactcaataaatgccaattaccatcaacagatagtaataactgttactattgtcttcatttttaactttttactcaggatacatcttaggtatccaaggagactgactctggaaaaaacatgaattagaactcagatttcctgatagtatctttatcagaaaaaaggtagagaagtgaatatttctgtccattttatgaaaggacaatcttgatgcacattaatacttcatctcaagccagaatgtaagattcggactggggccatcaaataatcctgcttgagtgattctaccttgtttctaagtagtcattgcctgcagagttttgatgaaacatctaatagagaaattgtggagaggtatcatatgtaattgacagaatacaattggttgtactgaaatatcttccttatgctaaaagaatgaaaacattgatgcatcccagatttgtgggcctttcgttggaagtttgtggagatggaaatttaatgtaaagggaaacatttgtttttcctctgaggaagtctgaaaacttctgcatttcagattttaggttaaatttttcattcacattaacatttctgtcttttagctgatgtatagctcaaaatatctcagatcccctacctcacaccatatacaaatactaatttaaaattaattacaaatcatctaaatataagagccaaaactctgagaagaaaacatgggagaaaaatctttatgacgttggattaggcattctcttgagataagacaaaaaaaaaaagacaagtgacaaaaggaaaagatagattgcactttatcaaaattaaaaaaaatttccttcaaaggctgccattaaagaaataaaagacatcccaaggaggtggagaaaatacttttacatatatatctgatatgggacttataactagaatacataaaatctcttaaaattcaacaataacaagaataataaccaagttaaaacatggcaaaggatttgaatagacacagcttcaaagaagatatactagtagcgagcatgcatatgaaacaatgctcaaaatgattggtcatcaggtaaatgcaaataaaagtcacaatgagataccctgttacaattactaggatggttaaaataaaaaagacagtaataacactttttaaataataagcaaaatgtgcagaaattgaaaccctcatacactgctggtagaattataaaataatgcagccaatttggtagacatcttaacaattcctcaaaatgctaaaatagagttaacatttcacccagtaatgccactactaggtatatacccaagagaaatgaaaacataaatgaacaccaaaacctgtgtatgaatgtttataacagcatgattcatagttgccaaaaagtggaatcaacccagatgttcattaactgataagttagtacacgaaatgtgtttatatccaaatagtggaatgctgttcagcaatgaagaggaatactgatgctacaaaatggataaaccttggaaacattctgctaagtgaaagaaagtagtcacaagggatcacatattatatgatactgtttatatgacatgtccacattaggcaaatccatagagacagaaactagataagtagttgccaggggctgggaggagaggagagtaggcagtgactccaaagaaaacatgggagtaaatgtatgtgggctgatttttgtgaagatgaaaatgttctgaaattgggtggaaactcttggaaagtactaaaaaccattgaatcatatactttatttttaatttttttaaataggcacagaaccaatacatgaattgtatactttgaaggagtgaattttatattatattaataatatctcaataaaactcttgagggatataagaatttatacgcacaaccccccacacccccaacacacaccccagggtaccaaacagaaaaatgagtcagattcaggctccctagtaaaacttatcattataaataagctatcgttggccttatcaaatgtgcttcctgaaaagaatgctgagatatatggaatttgtaagtcagattgtcattctgtcatctttctcatctttctctaaactaaacaaacactggaattaccaccattatgtttgtccacattgtttattaccttccccaacccctaaaagccactacagacttctaatccatcataaaagaatctgacagaagcccaccacgatgacttaagtatatcacagggaagtcacattgcttgtgctaccatgttttatgccccattttgcattctttggatgcgaattttggctcccaccttagctgcaaaatcaggttgcattctgcttagggcttgttttctgtgttagggtttaccaaatattgagagttaatagcttctgagaaccttcaccaaaggggaatggagagccagtaagtaaaggcactcctttactgttctaggtggacaacttggaaggtaattttacactgttccgtccagttgccctgtgggtgtccgtggtggtaaccagtttaataaccctcccttggattacctttctatccctgcttttcccatgcttcctaggcatccctccatatatccttcccccttctgtttcatggtatcccttctaaaactaaacttcttgtatataagcccttaactcagtgtctgtttttaggagatgtcaagctgacacactgtctgatttttagaatatcaaggaccctaggtgaactacttaatgtttctgtgtctcagttgcttcatctatgtggaataataattattattgcctcctgtgcagaaaagagttgacagagtaggcctgataatgctattcttacagaggcctgcttatgagaatgtcccttggctggcatctgggatcgtggctggtacagatataaaattctcccttactgattagagtggatcaccatgcctagactgtacaatgtggtttatgctgcatgcctgcatccttctgggagtttggaattgtggtacatggtagtataagggagggaaaatggcttcccgctttgacacaaggctggttaacagagaaaaaaaccctaattacatatgtaagtgcagccatcccacaaaacggggtcccacaacttgaagaagggtcagatgattgaagcttatgtagcgtcctgagcttacacaaagggataggaatttggggcttcttggggggcaggtaggtgtggagagataagagacaggagggtgaggtgaatacaggatatcttcttatgcagataaatgtctttcaggtaataaaagttgtctggagtagccctcatatagatattttttactaacgtagatttcttttatagatttaagtttcttttacaaaaggacagcttttcagagctactcctgtggctgcagtttcttagaattaccagccaaatgtatgccaaagaaatatattttagggtggcacattctggtcttctacagtcatattttcgggtggtgtgtcctgagcctcaacaataggcagagcatacctatgtgaccagcttctccttcctcacctgctcctctcaaaaaatacccacctgggcactgagttcctaataggcatccctggacggaaatagtccacatgtgttgttgcatttttgttcctgggaaagacgatagtctgtgagaccacctcatgggagagagagagcataaggaagcttgcacatgagttcctccaaattctacctgggtcctttccccttattattcaactgtgtaccattactgcacagttgtcatatatttttgccatgagtacaacttagattctgagtcctgtgagttctagtgaatctctgagtagaggtctggtcttgggaatccttgacacacttgctatggttgttgagaagattaaatgaggtaatatagaagactttagcacaatgcttctaacatcctaaatgtgcagtaaatgttaagatttactaaagtacatcctgtcagctcaatatggggtatcagttggctctgggattcccgagttaatcaggttgactcaatctgtaaaagtcatattagatactcaagagccataaaatgatattagaagtactaaggtttgggtcgggcgcggtggctcacgcctgtaatcccagcattttgggaggccgaggcgggtggatcacgaggtcaggagatgaagactatcctggctaacttggtgaaaccccgtctctactaaaaaatacaaaaattagccggttgcggtggcgggcgcctgtagtcccagctactcgggaggctgaggcaggagaatggcgtgaacccgggaggtagagcttgcaagtgagccgagatcgcaccactgcactccagcctgggcgacagggcgagactctgtacccaccacccccaaaaaaaaagaagtaataaggtttgaatttagcttagtaatgctcagtgcaattgctttaaaacccaggtcctgccaggcgcattggctcacacctgcaatcccagcattttgggaggccgaggcgggtggatcacgaggtcaggagttcaagacaagcctggccaagatggtgaaaccccctctctactaaaaatacaaaaaagtagccgggtgtggtggtgggcgcctgtaatcccagctacttgggaggctgaggcaaagaattgcttaaatccgggtggcagagcttgcagtgagccgagatcgtgctgctgcactccggcctggacaacagagctgagactccatttcaaaaaacaaacaaacaaaaaacaaaaacaaacaaacaaaaacccaggtcctttcccttcatctttggtacagccaatagaaaatgaacaatactatctcacgacttttctattctcgtcagcatgggcctcttccacaagcactccatttaaagtcattgatctaaacttattctttactgtgctgctctttttactgttcacgtctgccttgacaccattccccatttggggtgcccttcctttgccatcagctagctcacatctgaccccactcatcatggactggctcacatcttctgtctaggaagttgtcatgaaggacttgaatcttatgggtctctccttttaggggatagagtgaccctgctgtagttttaaaatcttggatttgagtacaaggatctggattctgcactatagcttttcctctaactttaagaccttgagcaagttacttagattttctgaggccctgttttgtaatccgtaatgccaagataatttgtttaccagggattatttgccaggctacagtgggatgggggaataaatgtgtttaaatactggtaaaagcattgtgtagatataagacatcaaaatacggcacccacgttttgctttttttttacatatataattcttacctccttgctgtatggttttatgttgccattacattcttacttatgttattatgttttatttcttcaggtagattataatatccttgaaggttggacttgcctcgtctacattttgacactccctatcgtagttagcaaagtagtatgctgctatttgggctccgtaagaatcttatcatgtttattgatgaggaattgtgagtttggaaacaatagtttaaggggatttttggaagaggaaaaagcactggattgagcataaccactttacatacagagcaggagctactgaagtggcagattttcagggttactatggggaagtcaaatcttctacactgctggttaacagcaccttaattattagctgctttagaaataagtgccctattgccctgtaatttcatttcattaattatgctcagaggtagtggtatctgaggcaaacaacccttagatttccactgcaccttcatcataggcaaatatttatcatggatagggctattaagttcttcattaagaactttattaagtttattaaaactttctttctcactgagatttaaaaagagccatttagtagtgacctatgaaaatgcaagtattataaagcagtaatatagactatatattattgaataagaattttagcctttttttaacaaatgcagataattattattatgtgccagacattgttacaagaactttaaaaatattaactactttaatttttgtaactctttgcagtagctgtgatcattatttccattttataaatgaagaaattgaggcacagagtgttgtgtaaattatctgatgtcacacagatatgtaagtgactgagctcacaaaagccagtcaattttgctgtatagaatgtgatagaatgtaccctattctatgctgcattctgttactacctgcgtatttatttatttgcagatatgtgcattcattgtgatgttttttaattatttggggaccaatggcatgtcatatcaaaaaaaaggaaagagacctactttgtggatttgcaaacttctattatttatctttacattcctatattttcacttttcattgtaaatacattcaagaagataagttggtagatgataaaatatggatagattaggaatgctaggtaaatagttccaaactctttaatttgatgccaagagagcaagtaatatgaacctcaacagtccatccttaggtgcttttgtcagccagcttcatagtctcatcatagctgactaatagttagtgtcctttttcattttgcacataatccagcattaaaagcataaggtatgaaaggatgaaaagattatgccccactttacttattcgactaaattattatgccttgaccttttgaccaaatcagattcatcttctctctctctgcacttccacccattttaatgctgcggcacagattgaatggattgggagtctgtgggtaagtaataagaacacagagaagagtggccagcatgattaagattttatttgtagtgtaattccattataattaacattatgtaactgtagaaatatggtgtttgcacctcttcctggcagatgcttttaagtcagtggcagagaggagattaaatagtaaatgaagacctatttattgaaaattgtttctacatcctgtattgttggattcatttgtttgtttcacaaaccacagttaatttagtaaggaaaataagcaatatgtttaacaaacactcaaagtaaatttgtttgcagtgctttgaagtaccatagttgaacttttgatattagaagtaaagtattactgaaagatctgcaaattaagggtgtttaaatagtgaaaacaaaatgtttattttttccaaagattactaacagaatttaagtaaatgaaaataatatggttttgcatatggtttaaagcatttctagttacaagtgattttttttcaaaaataaattggccaaataattatgtatttaatttatatacattttgatcagactcctctagccaaggaattggcaatccatagcccactggccagatttgtttctcttcttcttttttgtgttgcccccaacctaaatgtggtttttacatttttagtagtggaaaaaatcaaaataataataatatttcattcacaataaaattatatagcatttaaatttcattgtccataaataaaactttattgggacacagtctcactcatttgtttaagtattggctgtttttacactacaacagtagaggtaagtagctctgagagtctgtatggcctgcaaggctgaaagtatatatcatctggccctttgtgaacaagtttgcagatctctctaccttagcaaataaacaaaacatcatcatcaacagtaatgataagactgtgataagggctttatatacattatttctaatgtatcaaatgatggtattatagacatattattatcttcatttatagatcagaagactgagggtctaatgattaactaatttccttactgagagctgagttttagttggaatatttatagcaacttgtaatatatatgaatgactattagagtttagacttatttaaaaacaacattgtgagtattttgagagtgagattttcttctataacccaattaatatttattaaataggattgggttgattgatttgatggtggttattctagaatatggaaatttggacatctcagttaatttagagctgcaaactaagagaaaatcagtgcttcattttgatgatagatgtcagaaccacttttctgcatccatatggatcttgtttgcttctgctgtatataagaatgattacaaattgctccaacttttattttgaggacgctaatgcattagccttgtagaattggcctatagggactttctctggaattccttgccattcattcatttattgtagaaaaaataagttggctaagatgatggttgttcatactaagagtatattgaaccaggtctgtgaaaggaattgagaagttatcgatgtatttcatcatttatctcattggaccacagtaaatgattattgcattaggatgtggtgataatgggttttgggtattattaaaaaataatttcaaaggaggtccaatatataatatacttagcctagctttaagagtggtagcagagggaaccactgtttccacatcagcttcctgaagtccagtgttaaaagattgattaaatgaaatctgttaggtaaaatgcatttcagttcataaaagtcatgaggcttcttgaataggcccttagaaaaatcaagactctaattatgcagtgctaaacattagaattacagccgaatattcatatagttacgtaagtatttgaaaatatctaatctaagacttccttagatatagctgaaagataatagtctagataatatcttgagggcagagcctctgtcttaaagtatcttcatgtttatatagtaaataaataagagtaagtattattattttaactaatatttactgagaactatgcaccagaaattgtgctaatttttgtaatcaatgcctcatttaattgtcctaaaacctgctgaataagtactaataattattaataatttattccaattttacagggtttacaggcccatatcaaacattcagattagttgagcttaacaatcaagtatctccagctccaaagcttaacaccttttccactatgctgtgttgtgtagcgtactccaaatgtttgatgagtgaatgcatgagaatgtgagggagttatcaggaaaccatcttcatcatggaattttaatctgttcttaacctaaagtttctctactctgaatgctgctactgtggtcatcattattaagctttattagagatccctactctatttacttgttttgaaaagataccatttctgagcaatcccagctgtgacttaagattgaacaaatcagctgtcacctgtcctacacagcagcgcattgacagcacaggtgtggtatttttgctccagtttggatgggttgccaacgatcaggttttccaaatgtgatttgtttagataaaactaaatattaataccacctcaagtgccatagtgtgtacaaccagaagagctctcatatataccttgcgtgattttcccagcaatacggttgttcagatagacaacaagaaacttgcagataagaagagggactcagaaggtttaggtgatttgtccaagtataccagctggaaactcaaactttctgatttcaacaccgtgctgggcattgcctcaatttgagaggggaaaatttggacccacataatgggattgcaccagccttcccatgcccagtgaagataggattgtaccaataatatgggttctttccttttagaaactaacttaatcactggaaccatcaaagcacccacgggtacatacaaaagaacacatgtcatatacctgtgtcatgaataataatgttatgtgtctgcactgtttaatagaaacatgatgtgagggatgggtgcggtggctcacatctgtaatcccagcattttggcaggctgaggcagatggattgcttgagcccaggagttcgagaccagcatgggcaacatagcaaaaaccctgtctttataaaaaaataccaaaattggcttgagcatggtggtgcacgcctctagtcccagttactcaggagactgaggtgacaggatcacttgagcccagggggttgaggctgctatgagccatgatcatgccactgcactccagcctgggcgacaaagcgagactctgtttcaaaaaaacaaaacaaaacaaaagaaatatgatgtgaatcaaaaatataatttaaacttttttggtattcacaccaaaaagtaaaatgaaacaggtgaaatttactttaataaatcattttagttaacacaatatgtcaaaaaatattatcattcaactgtaccaatattaaaacaattaccaattagatactttacactcattttttgctctaaatcttcaattcatactagccacattgcaaatactcaatagtcacatctggctagtggtggttaccaagtaggacagcttggctctgaatagcatgatagtacagttgccatgcttaggcatggagatgctcagagaagaggactgggaggaaatttccctaatccatccccttaactcccccacattttgtcattcagatgatctcctttttgtttaaatgtaaatgtctttttatatttttaacctaactggctattcatctcactgatattcaatcatctgataaagagcttctattctcaagagttctctgaggaagcagtacatctatgcaaggaaatacataaacatgactccagtgattggaacaaaattagaagatttctgaggaaaaattgctgctataatttaagaaatgtaccttagcaacatccaaggctcacgagaatcaaattggttattttgggttaaagtcaaataaaagcactttttcttcacatatttttctttttgtcatttatctaaaacgaatggttgataatgattaaaatgtaattttactatagaatgagaagaaaaagccagaaaatatttgaagtactcttcaatttatttaatcaattatgtcctgataaaaatatgctaattgcaattcagattgcaaggattttggtattttttcttagccttttaggtatttattaacacaatacaacacattcctatgaaattaacatataggattatacctgaattatatatttctataaagaattttccctaaatgacaaagcttaccagagagcatttaaataacatgttttagatatagatatatatagtgcacacatgtacttttcttaaaccttcgtgaatatgactctcttctgagacctgtctgaaattttatatttcctaaaatgacttgatcacatcatcatcgtcatccaataataataataaaaacaatgacctgaaccagaaattgtgcttatttttacagtcaatgcctcatttaaatgtctaaagcctgctaaataattagtataattattaataattgattccaattttacagggtttacagggccatgtaaaacattcagagtagttgaacttaacagtcaagtatctctagctgcaaagcttaagatcttttccactatactgtgttgtatagcatactccaaatgtttgatgagtgaatgcatgagaacaactgttaagatttatcaatgcttattaatactagtacaatgcaagtttttttaatactctttacatgccttatctcattttatctttacagcaaccctattttggtagctattctgaccaataacaggctgtctaaaaactatatagctaaaaattggtatgctgtttttagttttttataaatattgctaaataactccatagagtttgtactaatgaaggcactcaccaaaaatgtatgtgaatgtctattaccccaggcatttatcaacagtgtaacacttttgatctttgccaactcaatagacgaaaacattgagtgaaaatatatttgttttcatttgcattttttaattataattgagatcaagtttttttcttagctcttatcactctctacctctacataatggcttgatcaagggattaacaagctctaaatgagatgactttattatgagtgggaagtcataagaaaggttgagtggaaagaagagacagaggaggtttttgacccaggaagacagattctacttttatgaatagtccctattctcttctctgaaatgaatcgagcacttctgatagaaatctgagtgcatgcaaagaaattggttaatggggcgcctgttaagagcagtcaaactattcaagcatggctagctgctgtggctgctatgattatatttttaaactaatgggggtcagactgaactgtcttgagctatgacagttattaaacatatacccacagaaaccccaaagagaagctaataattgatggccttttatttttacataccagattcttcactgatccctgtctgaaatccactgttgactcttcactcaataaaatcatatgaatattgagtattttaatgtcagtagatggcattctccactggaaacacacttcataactccaccgtatggcctctacataacctcttaagtggtcgatcaagaagcctttgcctgtttttgtttttcgcagtcttgtgatatattctgcattctccgttagggctatatgcattgattagcatatagatggctattctgaactaggccaatactattcagcatgtactacttaatttaggaataatagtatttatgtaaggattatttccagtgaaccaggataggcatagatggtttgagaaatcaaatctgttgagaatcttcagaccgttttcttggtgctaatttcagtgtccaccccctcacccccaattgaaccgtttaacaaagcagccgtataatagaatcatcctagatcatagttattatctgttgcagggacatgaaggtcatctagcttactcctctaattttgtggatgaagaagttcattataataagtaaagacttttctaagaaagtcaatggaaaagtcgggactccctaatttgagcccagtgaattttcctttctcagaattatccatgcccttttaaaatacgaagtgaaatacacagcaaaaggtagaagaaaatcaaacaaaaaaatcacctggaaaatctactttatgcaattagtattggtaatgcttcttcacgattccagcaatgccatataattcctttctctgttaggtatctagtaatttttccttgttttcagctgataatttgtctggtagattctgaaatggcaacctgccatttgacaagaaaaccagtaatggatatgcatttaagaaattttcttgggaggccaaggcgagtggatcacttgaggtcaggagttcgagagtagcctgaccaatatggtgaaaccccgtctctactaaaaacacaaaattagctgggcatggtaacgcacacctgtaatcccagctacttgggaggctgaggcaggagaatcacttgaacccaggaggaggaggttgcagtgagaaaagatcgcaccattgcactccagccggggcaacaagtccatctcaaaaaaaaaaaaaaaaaaaaagaggaagttttcattgcgtctggctaagacttacaaacttcatcagcttgtggagttagtctctgctcatctcatttatatacagagctacttatctgatttgactttattcctgacactggaccaagaaattgttgatggggatttatgctgctgattctattaagaaaattcattaaatgcccttttatgaaactagcaggattgggtacaatacctaacattaggaaaaagtcaaataattttctttagcatgaggcagatgcattgttgattgcctttgtcataaagaaattttatttgaatctttatcagcgactccaaaataagcttgatcattttatgagtgtgatcgtcacaaagagcatatttctcttttacttttttctcttctctttttctcttgtttaagaagtagcaccaatttctttgccagaggaacatgtgattgtattttcagtattttctcactcacaaaagattcaagtttatgctaactggagaccagaaacttgtctttcttgttgcttgaagctttgacaaaatctgtttacttgctttgaacagtattgccctgagtttatttttttggggaaaaaaaggccatacttggaaaaattgagttcttatttatcttggcttatctgttgtatagataacatctgctgtctcagagcttactcagaactaacaaaagaaccaagtggcagagaacacccgtaagtttatacatttcagagacaaaaaggatttatttttgcctgttctatttgtcttttgactacagtttgaaatgagtgattattgtgaatagtttgagatgtaatgatgccaacattatcaatttgtacatttatcaaggttatgcatactaggattatgcatgctatgataacctaaaaactatttaggttaagcagcttattaatatccaagttaactttgatacagttacaaacacagaacctcaaatatctatccaggaaaggaatatcttagcctgtttttcaacatgctacagtaaatatttaatatttaaaaattttgacatttaacacattcagtatctttttattttcctcccctttttctaataattcctataattgtttttataaatttttgaactcttctctctgcttaaaataaaatttctccccaatgcaaattgtgttgtctgttaactgtttagtaagaggagctttgctatcctatatgatgaacacttgattatgtattttgattaatggttactatgccaactagagaactagatttcagtaaaatgatcccactagattgtaaattttgttaatttagaagtaacaagagcatctagtattatgcttattcttgggctaattcatttctttactatcatttattttatattaactcatttatttattgttacaatacatccacttaacacccaggttttcaatggccactctgaaagaggcattgttctaagtgctggaatacaaatacgaggcattatcttgcttcagtacacatacaatgtagttgaaggaaagatttcagtaaactagtcaaaaaatttagtgcaagtagaaatgttattataggagatacagcagtgggccatcttaattcaatggagaagggttcaggaaattgaggttggtcaagttgagttttgagggatgttaagtaagtgcttctttagatataaggtactataagttgtacacattattatgaaagcactgtgtagcagcaacataatcataatcattatgaagttacaggatagtctcattgggagcagttgttaagtttacatcctctaggtcattgctaaaactcggtaatttggcaggaagtacgtaggagctgaagataggagaatccactctgctgattagcaatgaaaccacaggccacccactgaacctctcttactttacttccttatctgtgaactgggataataccattaggtgctcatttaatgtcatttaatgcttgatataaagtctaaatgacgtcatgtgtgtggaagcatattgtaaattgaaaagccctataaagtgaaactgactttattctatacatatttattcacacctgctgtgttcaattcattgaactacatgtgaagagtaaatagttttgttttgttttagtcttcaggaagcagtgagcatttttaaaaggtcgttattgaacccagtactttttgtttggaggctcaggaataatgttaattatttcccttgggaatgcaacacaagccatgtctgtgtccaaatgggacattaaaaaagcatgtcctcaaactatcatttttatttattcactttaatttcactcactaatacctattggatgtcaggctctgcactagacatcaggatgccactctcatttggtgggcagttaaggctgcagtcacaaatcacacatcataaaagagagggagatagcaagggagatcacatatcaagtagggagatagaatgagtaggcagaagacggttaagagagatcgtgccagaagaaagggtatgaaatgggaaggaacatggcacattttaagaactgaaacttcttcagtgtagctggactgcagagagcaagatggaggatggtagaagatgagatggtgggaatatttggcaaagaccagacagtgcagggatttgtaggccaattgaagaattttggccttttctctatgagtaatgggaagacagtgaagcatcttaagagggttgaggtaagagggacgatcatactagctactaaagtttgtggagtcagtagtggtaggttgtggggaggtggtggtgaagatgaagagatgtgaatgaagtaaaatggtcttgacttagtggtggattggctatataggagggatgagagggaggcagaatatcacattgaatttaaatttagaaaggtttactgtaagctgggtgtggttactcctgtttgtagtcccagaaactccagaggctgaagcagtaggatcgcttgaggccaagagttgaagctgcagtgagctataacccaccactgcactccagactcagcgacagagcaagacactgtctcaaaaacaaaaacaaaaggaaaagcgaaaagggagaaaggtttagtgtaaaatctttgagagtaaaaagagagagggatttctaaatcttggattgtgcttatgccatttaaaagctttataattgttgtgcaccttctctaacttatttaatataaccttcttgaaggttagatttcaggttttaaaaaatattttatttctggtctaaaaatttggcagggattttaaagaaatggtaagtgataagaagggagttgttttcatttagtttgtaaggaatgaatattggtatttttatgatctgatgaaatttatcctttaatttcaagtgagacagtttgactttcatatgaagattaaataattaattttgcttacttcagatattcagatttaaattagcctataggccattattaaaatagatttactgtgataattttcttgctcatcagggtaacttattaaacagattataaaatatcataataaaatcaggtcctctgtaaatccagtgaagaacgttttttaacatgacttgccattgagacgtttttataaaaccagtgatacccctggaaagtaattgactaaagaaaaaaaaaagtccaggtttattcctcattgtaaaattcactttttaaatttgcaggctatgaacaattgaatttgaggaataacgtattttgggatatgtaccattttatttaaataagtaaataattatatggtgaaggaataataaatatgtattatcttctaggaattgtataacagttttgattactgattttgacgggactacttttccttatgaattatggaatatatagctaaatcttatataaacaatatataatgcaacagcaatatattttctattaaactataaaatagtaggttaattttaacatcagatttagtccaaaatttatttgccaataaaatgaataatagaaaatttttaatcataaaatttcatttgctgatgtataataaaattgtagatttttcaaaataaaaaaatcttagaaaatatcttaaatttgttatctgaattgctaaatacaatcttcaatgtatttaatgctttcccttcagctatttatttggctttaaatatttggtgatttttaataaaatgtatgtattttgctatgttaaaaatccgaatgttgccaaactgtgcgttttggaacctaacttactcctgtaaaaatgattttatgtgttgtcatttttaattatcagttggctctgtgttttttttttgagacggagtctggccctgtcgcccaggctggagtgcggtggcgccatctcggctcactgcaagctccgcctcccgggttcccgccattctcccgcctcagcctcccgagtagctgggactacaggcgccgccaccacgcctggctaatttttgtatttttagtagagacggggtttcaccgtgttagccaggatggtctcgatctcctgacctcgtgatccgcccgcctcggcctcccaaagtgctgggatgacaggcgtgagccaccgtgcccggcctggctctgtttttattagaaaaattctcaatcgtcgtcttttaagtgagtcaacctaataccttttaattttgtgcaaagttctctgttttaataacttttaatttagtgcatatatcatatactggagaattatcaatttatttgattcttttagcaatttatattttggtaattctgtgttaataatgtgatttgtatttggttacgcagttgccgataatcctgtggcattacagagtttgatttatgcggacgatccttggacttaaaaaggattactgaccatttaagaaagattaattaatgagtataacattgagtcctaactctgctaatgcttgtctaagctacacacagatacatgcacagacacacataccctcaaatctcataccaaaaatgaccaaattacaacaaaggggatagtatcctatcctgctaggccatcacattatggatcagcagtgtagagcaagtcttgtggggcctgatcttgctcttacaagctttgggatcttgggcaattcagtttccctaagctcagttccttatttatagtcagtgagatgaatcctatggtctcttaggttccttttatttcgtaattcaaaaagttgaagttagaggttaataattttgtattggtaagactgcaatagcagtcttcttcttataattaataaattaagaagttacagggaccaagggagaaaggtaaattcatttatagggataagacaataaaagggtacaattaatttatttggtcaccagtgttcttgttttcttgctgaattttatgggatgggaacagatctaggaaggaaggctcgtctgtacccttttgccctacctgacgtaaaactcaggactgacccatcctaaaatcattcatttagaaagaatccctcataaccatgttagctcaaggttatcttgtatctgatttctctcttcctgcataggttgcagactgaagagcattaaaatatctgttttcttagtggttttcctttctggatttgaataattcacttgattcttccaggctacttaaatgaaagagtgttatctaagaatgctaatcttagttccttttgtttgagattagagaaatcaatgcattatatttttagtctagatagtaagtcctgaatgccctttactctggccatttaaaaaactaaattattttcagttggctttcatattgtggggttagatattcatttgagatatgttttcttttttccttttccgttcctttagttaaaacgaaatcttaccctaaagtgggataataaggggaaagatccattgaatttgagtattgggcttagtttgcattaaatgctccttttgttcctgtttatgtattattttaagctcgtttttccaaatataccaacagcagatatcaaatgaccattacttcatactagaaggaatttttataaaccaggccaaagacttcactagatttctcaaactttgtttctaactctgaaatcctatgattttatgatttttaatatattagagtaaacctacaaaattgtaattttgtaggtgaacaatagttagacagtgtcggtttcatatgattcaacctacatatggaagcttagtcattgcattgtttaggaaaactatgtaactcatgtatgaaaatggtaatgtcaagcaacgaagcttattaagacactaacatcatttttaaaatttagttttgaatactagatattaaaaattatattttaaacgtttgtaaatccagtgagaataaaatgttctttgcatatcttatttcttttcacagggagttttttcctgtgttttatgagaaaaatcacaggcattacagtttgaaatcaatttcattgttttcattgcaattgctacatagctgttgaatatttgtagtaaggtttaatgactaatgaagtgcatgcttgattatatgccattagtaaaaatatatttttatggcaaagggcggtttgcagcatggcattgacaaaagcaatatgtaaatgtgttactccccttcaaaagaatgcaaatcagtataaacaaattttaaggaaaatatttaaaaataaacaattaaaataatggatatttattgtttgttacttattgagatgatatgaatatgtaaatagagcacttaggtctacttattttcagaggccagtgtactactaattagaaaagttgtagatatcataattactgtagtaaattaatttgtctttattgcttacattttattgcttggtattccaggcattggatagatagttacaatgctgacatcaagagtgttcccacgattatttctccgcttttctaatcatcaactcattatatgtcccttatcctcctgctacttattatcacttgccatttcactcattatttgctcctatctctctgtctttgctcattcaattctcttttctagggataccccttccttccagttcttacctgccaaagctgtgtttggcttctaatgtttagcttaatgtctgcatcttctgcaatgtctttcagatgtctgcagtcagaactctttactcaaggtcactaccgtcagcttgtctttccactggagctcatccagaacacattgctttgtgaccaaacacattctctctgtatctgcctcccaattagactgtgtacttctcttccccatgttccctcctttgacacaagtcatgctcttctaagcaatccaggcttgttcagttgaattattttctaaaattaaaacggtatgccagacaaggtaatacaagtctaggcttgatttttcctgagtgttgtgtttgcggtgggtgggccaattatttctgttccttttcaaaggatctcacttatcttcttgttttctgccccattggataaatcatctcatgtcatcatttatttaacttcaaacacaatttctaaatgttgaggaatacgagaacaaaaagagcatgtctgcatctgcatacatggtcttaggtattgggtgaaagaccatcaaaaacttatattagtactaggaagaacacaattattttaaaatacattaaatgcataataacttttaaaattaagggtcaggaagaaatctctaatagaaatcacaaaacgatagacattttctttgaccattcttgctttgcttctctaatgtatatttaatattaatataaataacagcagtaatgacaaccataatggccactaccatgtcatagaatgtactatatgcattcacgtgtttcatctgatttggtccacatatcataacatgaagttggtgaggctgaggctatatatgttattcagactcaagatagaaaggattcattaggaaagggttcatgagaaaaataagcttaaagcacaatgttttcttccaactttccatttcaggggtacatatgcaggatgtgcaggtttgttacataggtaaatgtgaagcagagacacttttttaacatcagttctccagtgagttcatagcagattacagggtcaaaatatatatgcatacaccatagtaagcaccatttaaacttgtagaagtaagaaaattgtccttgaatagtcagttcaatcttcctgtgctctattgagtgtatctatctgtggatacaaaatgaataaagatggatctggacatttcacccttccgcatatgggagtaaaacctataaggagactaataatatcatgcatcacaaattacttgctgcagttaaagaagttttattcagatcctcatgatctcacagggatccagtatcttgagagttgacgaactttccataaaaacactaatcacgtataacagttcagtcaaaatctactgatatagatattccaaagtatggcaggaatttagaacaaaagatggaaaatttgaaggctctgatctgtaacatttcttcttaaaatatttcagctgacttgcttagcctggtatgcagaatctggtgcaagctgagcacggtctaagttgcctcatcatctcagctctccatgcttctgtatttgtatacttccatacttagcaagtaactgttctccctccatggaatgtattattatcctctgccactgtcctcttaaacctggcaaatgcataactttcttttgagacctacctttgttaagacctagctctttgaagacttccctgattgtccaaggtaatgttgactttactttgtaactgtatgtatttttcttatgtcagcaaccactgctctgggttattactatatttttctctcccaaataagacaagaggttctgttagaagtggaaccttaatatccatttttatgtgatgaatttctaggcccatgtgtgggctgtattaaaggattaaagcaagcttgttcaacctgtggcccaggacagcttttattgtggcctgagacaaattcgtaaactttcttaaaacattatgagattgttttgtgatttttttttagctcaccagctatcattagtgtattttatgtatggcccaagacaactcttcttcccatgtggcccagggaagccaaaagactggacacccttgggtgaaagcttattagtaatgagtaaataaacaaaatggagtggatgaatagtgtagttcactatggacaagttaaataatgcttttctcaatgataagggcaaaatgaaaattctgagatttctacatgcattatccttgaaacctttagtattttacatgtagagaggtcattgttcagactcgcatttgatagagtaatcagtgttgaagacattcccaatggtgtaagttgccatacttctgcagtataggctggttgcccacaggaaaatattggagacaaagctgaaagcaatgtaaaaaccttgtgaaaaagcagaatgtatctttgaagaactgcacttaatatgttattcagcctaatttgtgcattttaagtaacatgttgatgagttgtacggtagttttcctttatccatagcccataccacaactccaagtagatgcctgcagatggtactgaacccttatatatactatgtttttcctgtgcatacatacctatgataaagtttaatttataaattaggcacagtaagaaattaataactattgataaaatagaacagttataacatcatactgtaataaaaaaaatctatgtaaatgtggtttctctctctgtgtgtctctctgtcatctcaaaatatcttattatactgtactcacctatttttggactgtgggtgaccacaggtaactgaagctgtggaaagcaaaaccatgaataagtggggactgctgtatgtgttgtagagctgtgctgtccagtctgtcagccactacttacatgtggctactgggaaatggaaatgtgtgcccaaagtgatatgtgctgtaagtgaaaaatgaacattaggtttcagaagataagtacaaaaaaaggaatatgaactatttcactattgtttctctgttgaaatgatattttgagtatattaggttacataaaatatattattaaacttaattttatccctatctctttactttttaactgttactgctagaaaatttcaaactgcatatgtgtcttgcattatatttccattggacagtcctggaaaggaaattatgattatccagagaataaagtcattaaataaaaggaaaggttaaataaagtatgacccgtcaggagagagacaaacaaggagagggaacagggtaagtcagccaagcatggaaacatgtggcgattgctcaagggcttgtgctctgaatctgaaaatgctgtaatggtctatgaaaatacttttagagctagtaaatgaaaataagtgcttatataacatataaacttaaaaaattcatgatatttaatgttcaataactatgagaaggcttaatcaacctactgtaatattttaattaaaaatcattctaacgtcaaataaacggagaaatactgtccgtcttccataatagatacaatggatggtttaatgttaaataccctgagaagtcttacagctaaaaatttatcactgtttcaaacagaattgttcccatatctggatgatagaactcactcctcctatgtatttaataatcagtattctatgagatatattttgggagatacttagtagaagataaagtcactgtattttattagggatgaaactgaggctagggagatccctaattcatttgagatctaatatgtgggcaaaatagacagattggtgcaatatccagcacagtttaacaaacactttccgagtagctactttgtgccagttattcattctggcaataagacgaataatacagccaggttggtgaatatcacaattcatagattctcaggtgattgttctcatgttttcagaaaaaggcaatgacagtgtgtacactgacccagagggtgattgtcctgctatacttaattttccaataactcctattgcattgaaactgttgcaactattcttcagaagtatagacattgaaataagtaaaataaaatagtaacgtacattgagttttagaaatgtaccatgtacatgtttttagaactcttagcattttgatttaaaataataaaaattggtgtacgtattttcttttgtagacaaaagattgtagggtgaaaatttgtaaatttaacctaatattttattctcattggtcacatgttatgaaaaattatatacctttcagctacctgtaactatgtcttctatgagtaatcatgaactgtctagctctgctgaagtttttatatttttcatgaattcgtacttaaatcctagcactagagttccttttttgagaattattccttttctctcagctcttctttcaactttaccagcaacaggcacacagagagatacatctgtgtgcacacatgcgtgctctaccttacactctcacattctcacactgtcagatgctcttagataaatacctttctggatgttagtttttcagaatgtcagtggtcccaattattttcctcaggtacagattaaaattttaaccctacattctctgataggtttctgtttaatagcactgatgtgtttttttaaaaaaaatatcatacaatgcaattgcatattttggacattctcatcctgcaactactttccctccccaaaatgtttagattctgtggctgagatacagtaaagtgcacaaaatcatgcaatcatttacttattcattcagcaaattgtcatcaaggcaatgggctagcaattgtggggataataaggaaagcatttttaataccccttatcctgaaaggaaacctttaatgggaagatatttttgctatcatattacatttttttgagtaataaaattgctgtgtttaacatttgccttaagtaacttccatagatagttactttcatgctggcccatagctgtgctggggatagtggtaggcacatctttaactcgggaattagtttgaagttgcagaattgttagtaaatgtagtatttgttgatttattacacatattggcagcaatgcaatgtgtatatactattataggaaataccaagaaaaataaaaattaaaagacaaacagcttataataattacccacaaagggctttttaccatgaaaaggagagaggggatggtgggttcaaacaaattgttctaatagaagatgagttcctaaaagaggcatagatgaagtttgatggggcattcagaggtggggaaaagtcctctcagggggattcagggaatgttcgtggaatgagttggcagtggatttgttcagtgtaatgtggctgcgatttggacatacagacttggtggagatgttcactgcaagttgagtaagtagtgcaaacatacacatagagacaagaaaagtcttagggcgtggatgtgaacagcaactggaggaggttggttaagtacaagcatagaatgggaaatgaatgtgaatgccatgcacaaagcacatatgcattgtgttctactatatatttacacaggtgccttttctttctctggaagggagatttgcatggatgcctttctaggtggatgtcatacccagcgaattctgttgataagctattgccgttgcagtgactgcaataattcttgagcatgccatctttaccagctctgctagagtgttgaatgttcaaaagaaaaacccaagtacctattaaatcatcagatgccatagtgtgtttataaaatcagatgaaagccaatttctgtattagagcagatctacttttctgtgcttggttggtgttgtaaggagagattattctgcttccctaagaaggttaagctgtcatctagttaaatatggacttaaaataatgctgccaaagcagttgcctcttgtgattgatgatgatgatgacagatgatgatagttttgaaatcagttttacagggaaaattgctatttttctactttggctgatgttgtagttctagatttgcgaatttcttgtcatattcgggaacatttttgattaaaaggaaaattgctaaggactgtattcttgatgataaaatggctctaaaactgagctatggggcaaatgattataagttgacttatacatattatttgagcgacagcagttattcttggctttacagtgtcattatgagttatattttggggaacaaatagcaacccatgtctagtcagcaaaagtggcagaaagtgtggtacttagaagttatgataataatagtgtcttactaaagtcatcaaagaactttcgtatgtattactattaaattttctctacaattctctcaggacttcatgcatgtgtttcctctccttgaattgtttttcccctcagatacctacatggcttgttttctttctctagaagaatagccgcaccctctctgcagtctctcattcctccatggcatttatcaccacctgacatgtgatatatgtatttgtttactatctcctcatgctaggttgtaagccgtgtgaatgctgagactggtttcttcagtgcaataaagtaagaacctataaaagttcctggctcataataggtactcagttagtaattcttgaatcattagctctatgaataaatctttattttatacatagacgactgaatattgtggtcatgatataaaaagaagctaatgtttggtgccagaatcaaattcaagcttttcagtttatttaaccaaattgctttggtttgtgtctatgtaagtaacatagacaacaaatagccctgaaaaaaaggagtaatagtgaagacttactcttaggtgtgaaccatttctgtacctcatcacattctagaatcaatcaatcaattttgtttatacagaattgctggtaatggctactctataccactgcattgtgtgagcctgtgcagacactggtctgaaaaagccattttcaggaaggaaaagaaaacagaacataaaccccccaaatattttttaaaggccaataacatttgtatccattgggtaaacacgatcaatcaaagctctacaagccttctatgggttgcttccttaacaaatatgttttttgccttggccattcatcatatctggaagtttgggtgatgagcttgagcactctcttccgttaatactgaaaatagccacttagtggctttgtgaaaagaaaagcctgttaaagcgacagaacaaacatgcattctcctgacgatataaaacaggatattgtagattgtttatattcgtgtgggcttggtgtaatgaaattcagctgaattttaagaagaggatttgttttaatgggaaattaggttgtgaatggaaaaggctacaatgcagatacgaaaggtattccctcgtaccctccaaacgcataaggagttttctaatgagactgagagtagtagctgctaaaagcaaagtcatcttatctgttgtctgagatgaattaccttaaaaaattgtaccctgacctcattactatacattacatatattgaaacatcactatgtatctcctgatatgcataattattatttgtcaattaaagaaaataaaataaattataaaaaaacattgtagatgggcttaaaaagtgaagaaataggtagcttctgtcaccagcactatttagagggattgatgaactattttgagaaggttggggctgggagaggagtactatgaaaaatgaaaagtcacatctctggaagcaggcatgtagtatcacatccaaaggacactgtacatacaaggtctactgcagtcagagagattaaaataatcttccgacctctgaaataggataatacaccaattataagtgatctcatgactagaaagtgtactttttttccaggacagttagtgtgtctgaaagtgagcagctagaaagttcaaggaggcagactcacttatttttggttatagaatgggtagggtttgggccaaataatctagcttgtagagtcaagtttagtcatttgttgaggtttacaggaagcacaaagagagaagagtagttgaaacagcataggttgggcaaagaattaaatggtgggataaaatgggtcttggtaaaacatgtaaatgagattaaatgagctggaaagaaatcaaccaaacaaatttcaaatgctgaaggtaatagagtgggtaatggttgtcccattatgtggtggctttagttttcagtcctagtaccacaatgccccttgccatagaccttttctttaaaacaaacaaggaatattcttatgccttattttctacataatgagtgtttttattgattttagatttttttcaagatccctatagagggattttgaatacttttcatttcctgctttaaccaggatgtctgccagaaatggatgtaaagcagtgcatggattttaaaataagaaagctcttagaatttccttatccatttccagtgctttgtgcattgctccaaaatattgctgttttcagtatgggttttgggtctcatatagagaagatggctcatttgatcgaataacatttcatataattgccctttataatttaacttttctatgtaaaatcatattcacttctgtgtgatcaattacaaatataaagatttaatttcatgagaattactgctccttcaattaatagactagagaagaagagattctacattttcccttaaatggcataactaattaatagcgaaatgtgactagaacccagattttctgaatcatggactcagtgttgtttctcctacgaagagcagatagagtacttgtagttaaacaaaattagattaaaatttcagctatcaaccctattagcaagttatttatgctgtaagcctcttattttttaatctataaaatgaagttaataatagcatttctatagcattgtaggatgactgtagttgataatatatagctagagggaggatattgaatattcccaacacaatgaaatgataaatgttcaggacgatgcatatgataattaccctgatctgatcacattacatgtatggaaacatcactatgtgggaaataaccaaactgttttggaacccttgctcatgaaggaatttgcattttgtcacactatttgcatgttcatttggttttggactgcattatgcatatttaaaacatactaaatgttatccctcaaagaatgtgtaatcttaacagtcctgagtgaagacaaaagtagacagtgatcgtggaatccagaacatactatccaatgatcaatataatacctagtaatttaaaatagagccttttactgattttgctctagttctagttaatgaagaaaagaagagatcattttaaaggaataattagtaaagacacctgcaaattttatgcataagtctgagtaagagaaattctgctgataatgctaatattatattgtcacctatatatatagtgtcatatctaaatattttaaaaataccaaataagaatatcctgctttttactatagaaaagaagctaatggaaaaccgatcatctgaccaattattaaaatgcatcctctctcctataagctctgttgttaatttcgtgatacaccttgaatatgccacaagcaattggtaatagcatcaattaacatttgggaagttcagcatggccacctaagatattaaatatttgctacaggaatgctaatgaaatccactgatgttatattcccaaggtattgtttaccaataacagcaaagctaagggttaccaaataaatgaaggaagatctacttagagctgttttcttcaattattctaatttttgtgttctcattttggttctgagttttctcacctgcatttgaggtcagagtctggaaacagggctttcagggatgcatcactaatgtcctttaggaaatatgtctttgcataatcaacgtcattgaggagacttttataagaaaatgaaaaaaagaatgaatttgactttcccttcactttttttttgtagagccattgccgtttctgtatttggataggagagaaatgaagcattgttatttaatttagcccttattataacatattatgtagtctcttagggtggcatgttaccaaaaacaagatgttctattttaaaagttgatttagtattacttcttttttttaattcacaatacattatgtaggtaggtttttttttctgtacattacacaccacagactgtattagaaaataatgttggtgtagttttattgaagccacatcatgaaacataagtattataaagagaaggctgttttcccatttcaatcagttgtctagttgatgtgtttatttttcatccaatttattttatatactaaaaaacagctcttaggaaagtgagtacatcaaactcagtttcattgatttaattttatttattttactttaggctaagttaattcaaatcaatagcgtgtatgtatttcagtgtaacctgtgatgatttctgctcaaactctacattcacatttataggaatcaggatattgccagatacgcactgatttaatgaatgaagacattgcagatattagaaacaacagtctctaatgaaataattgaatttatttttccctccaacatagttgagtggtgaaactatactcttgataaagttttttattataatgtattaagtacagtggtaaataaaatggacttcattttcaaatggatcttcagcaaaacattaggtttttaaatcacctttattacatttttatgtatctctttttgggatcttattgctttattagtatataacgtttttgatatttctaaacatgtttccaaaaatctgaatttacacattgataaaaataaaaacgacttagtcttctctgtcactgtgttctttttgcacttccattgactatgttccattcatgaataagaaaaagaaaaaaattagaagagatttattggaaagcaaaggtaactcttactactatttcatagaccatctctttgattttgcaggttagtttgtcctgtctgggggagataaaatgtagatttaatatggctaatgatttagaatcctgtctactatgaaacttaactcacacactaagaaaggtgatataaatgctgaatccctttaagtacatcttggcttgatgatgatatttgatgatccactgatttgtcttccaaaacactgtaacatttggttctttctgaaatcatcaatattattgttgtcgaaagacttcagaaagccagattgtctcccaaattgtttaatacttctttgctttttggtacgttttcttatttagttattaaataagttcttagtctttaaagctgatttttaatttttttgtcttttagggactactatattcacaaaagaataccagtaatacatgcacagcacaatgaaaaaaaccaatatgaagtagttgtttgattagtttcagcaatataaatggccactgcaagtagtttaggagccaaagagcattcctgcaatctagaattagtagtttcatttttttttcaattgaattgaaattggtcaaggtaactagataatgctaaatccccagtctactttgtgccgtgtagttattctaatcgtattgaagaacgttgtccatttgtcagcattttacaaagtgtgttaatgacttctattcctgctaccttatttttctgcccattagaataaacagtgactttatgtcacataaaagtagccttatagcctttttaaacgtttatttttgacaggagttgatggtatggtatttatgagagctgagaccagaattaaaaagttgtaacacattgttttagtgaacgaaacaaaagaacaaatattctgccacacgatttataccataattctagaatttactttatccttttataaattcaacagctaaaaaggtctactgactaatttttcttaattaaattattttcttgaaacagaatataagttcctgctactactactactaatctcatctttattggaatcagttaggtcatattgagccatgattactttttcatttttttttttttattgagacagagtcgcactctgtcacccaggctggagggcagtggtgccatctcggctcactgcagccttaacctcctggactcgatctatcctcccgcctcagcctttgaaattgctggtattactggcatgagccaccacacctggtcaagatttcttattaatttaacattttcaactatttctgcatagttgatatgtgtcctattgctttctgatttttttttaatttgttctttttggttattatactttaagttctgggatacatgtgcagaacatgcaggtttgttacataggtatacacgtgccatgttggcgtgctgcagccatcaacccataatctacattgggtatttctcctaatgctatccctcccctagccccccacccccctacaggccccagtatgtgatgttcccctccctgtgtccatgtgttcttatagttcaactcccacttatgagtgagaacatgcggtgttgggttttctgttcctgttttagtttgctgagaatgatggtttccagcttcatccatgtccctgcaaaggacatgaactcatccttttttaatggctgcatagtattccatggtgtatatgtgccacatattctttatccagtctgtcattgatgggcatacgggttggttccaagtctttgttattgtgaacagtgctgcagtaaacatacatgcgcatgtgtcattatagtagaataatgtataatcctttgggtatatacccagtaatgggattattgggtcaaatggtatttctggttatagatccttgaggaattgccacactgtcttccacagtggttgaactaatttacactcccactaacagtgtaaaagcattcctatttctccacatcctctccggcatttgttgtttcctgactttttaatgatctccaatctaactggcgtgagatggtatctcattgtggttttgatttgcattctctaatgaccagggatgatgagcgttttttcatatgtttcttggctgcataaatgtcttcttttgagaagtgtctgttcatatcatttgcccactttttgatggggttgtttttttcttgtaaatttctttaaattccttgtatattctggatattagccctttgtcagatggtggattacaaaaattttctctcattctataggttgccttttcactctgatgatagtttcttttgctgtgaggaagctctttagtttaattagatcccatttgtccatcttggcttttgttgccgttggttttggtgttttagtcatgaagtctttgcccatgcctatgtcctaaatggtattgcctaggctttcttctgtggtttttatagttttaggtcttaggtttaagtgtttaatccagcttgagttaatttttgtataaggtgtaaggaagggctccagtttcagttttctgcttacggctagccagttttcccaacaccatttattaagtagggaatcctttctccattgcttgtttttgtcaggttagtcaaagttcagctgggtgtagatgtgtggcattatttctgagggctctgtcctgttccattggtctatatatctgttttggtaccagtaccgtgctggatttataaagcaagttcttggagacctacaaagagacttagactcttacacagtaatagtgtgagactttaacaccccactgtcaatattagacagatcaatgagacagaaaattaacaaggatatttaggacttgaactcagctctgaaccatgtggatctaatagacatccacagaactctccaccccaaatccacagaatatacatttttctcagcaccacatcgcacttaattattggaagtaaactctaataattggaagtaaaactctactcagcaaatgcaaaagaacagaaatatgacaaacagtctctcagaccacagtgcaatcaaattagaactcaggattaagaaactcactcaaaaccgcacaactacatggaaactgaacaacctgctgctgaatgactactgggtaaataacgaaattaaggcagaaataaataagttctttgaaaccaaggggaacaaagacacttatgtaccagaatttctgggacgcatttaaagcaatgtttagagggaaatctatagcactaagtgcctgcaagagaaaacaggaaagatctaaaattgacagtctaacatcacagttaaaagaaccagagaagcaaaagcaaacaaattcaaaagctagcagaatacaagaaacaactaagatcagagcagaactgaaggagatagagacatgaaaaacccttaaaaaaaatcaatgaatccaggagctggttttttgaaaagattagcaaaatagatagactgctagccagactaataaagaagaaaagagagaagaatcaactagacagaataaaaaatgataaaggggatatcaccactgatcccatagaaatgcatactaccatcagagaatcctataaacacctctatgcaaataaacgagaaaatctggaagaaatgtataaattcctggacacatacaccctcccaagactaaaccaggaagaagtcaaatctctgaatagaccaataacaagttctgaaattgaggcactaattaatagtctaccaaccaaaaaaagtccaggaccagatggatttacagccgaattctaccagaggtacaaagaggaactggtatcattccttctgaaactattccaaacaatagaaaaagagggaatcctccctaactcattttgtgaggtcagcatcatcctgataccaaaacctggcagagacacaacaaaaaaagaaaatttcaggtcagtatccctgatgagcatcgttgcaaaaatcatcagtaaaatactggcaaaccgaatccagcagcacatcaaaaatcttatccaccatgatcaagtcatcttcatcactgggatgcaaggctggttcaacatacacaaaccaataggcagagagccaaatcatgagtgaactcccattcacaattgctatgaagagaataaaatacctaggaatacaacttaaaagggatgtgaaggacctcttcaaggagaactacaaaccactgctcaaggaaataacagaggacacaaacaaatggaaaagcattctatgctcatggataggaagaatcaatatcatgaaaatggccataaggtaaaagtaatttacagattcaatgctatccccatcaagccaccattgactttcttcacataaacagaaaaaactgctttaaattttgtatggaaccaaaaaagagcctgtatagccaagacaatcataagcaaaaagaacaaggctggaggcatcaggctacctgacttcaaactatacgacaaggctacagtaaccaaaaaagcatggtattggtaccagaacagatacatagaccaatggaatagaacagaggcctcagaaataatgcctcacatctacacccatctgatctttgactaacctgagaaagacaagcaatggggaaaaaattccttgtttaataaatggtgttgggaaaactggctagccataggcagaaaactgaaactggaacccttccttacaccttatacaaaaattaactcaagctggattaaacacttaaacctaagacctaaaaccataaaaaccacagaagaaaacctaggcaataccatctaggacataggcatgggcaaagacttcatgactaagacaccaaaagcaaaggcaacaaaagccaagactgacaaatgggatctaattaacctaaagagcttcctcacagcaaaagaaactatcatcagagtgaacaggcaacacagtataagagaaaatttttgcaatctatccatctgaaaaagggctaatacccagaatctacaaagaacttaaagaaatttacaagaaaaaagcaaccccatcaaaaagtgggcaaatgatatgaacagacacttctcaaaagaagacatttatgcagccaagaaacatgaaaaaacacttatcatcactggtcattagagaaacgcaaatcaaaaccacaatgagataccatctctcatcagttagaatggtgatcattaaaaagttaggaaataggccgtgcatggtggctcatgcctgtaatcttagcaccttgggaggccgaggtgggccgatcacgaggtcaggagttggatatcacctggggcctacatggtcaaaccctgtctctactaaaaatacaaaaattagccaggcgtggtggtgcacgtctgtaatcccagctacacaagaggctgaggcaggagaatcacttcaacccgggaggtggaagttgcagtgagctgagatcgcaccattgcactccagcctgggcaatagaatgagactccatctcaaaatcaatcaatcaatcaatcaggaaacaacagatgctggagaggatgtggagaaataggaacgcttttacactgttggtgggagtgtaaattagttcaactattgcggaagacagtgtggcaattcctcaaggatctagaaccagaaacaccatttaacccagcaatcccattactggctatatacccaaagcattataaatcattctactgtaaagacacatgcacatgtatgtttattgcagcactgtttgcaatagcaaaaacttggaaccaacccaaatgcccatcagtgatagactgggctttctgatcttttgattttgaggtttcattgaatattagcacagattttcttatttttttttctgtctcaatatacatttaggaaattacttcctaataagtaagaagtacatctagatagttgttggatgaaatatattaacattagctattgcttaagaaaacaactggataatgttttcctacctttttaatcatctcatcctgctagtgtactgtgtttgctcatgtttatgaacctaccacacataatataattggctctgaacttcctgaattgcaaatcctgtattcaataatttcatgcatgcagcctatttctcaatttatttctgggaactctaatcttttgcttcacagatactttgaactggcatctcatgtcttagtctgagttcctaacctttttatatttttttattatttgtattatttatatattgatttcttatttctctcccattgaaatgtaagatttatgagggcagaaaacttttccatcttgtccaccagtgtttctcaggcacttagagaactgtgtggcctaagagggattgattgtgtactcttacattattctttttcatttattatttcatttgtttcttataaccttataaggcataagtgctattctgtaggtgaggagacgaagacatacagaggttaaataatgtacccaaagctatattgctctagtagttggttatttagtgatttttttttttggctctgtaaatttgaggccatttttcttcagaacattcccttttccccagcatctttatggtacctggctatgcacttgcttttgctcataagcctaggttttgtctggtcagtcagtgaacataaataaggaatctgctaaccaatcaacaaggaggaagggagaaatcagtgaaaatcgtcactaatgttgaagataataaacattttggacaatgactgatgttttatgaagagcttttcataggaattcttatttagttattctcatgttacatgatggggaaactaatctcagagttgcaaatgttaagtgccaaaggcaacacagccaaaagtctatagctggtgcattagtccgttttcacgctgctgataaagacatacccgagactgggtaatttataaagaaaaagcggtttaatggactcacagttccacgtgtctggagaggcctcataatcatggcagaaggcaaaaggcacatcttacatggctgcaggcaagagagaatgagcgccaagcaaaaagggaatcccttataaaaccatcagatctcatgagatgtattcacaaccacgagaacagtatggggcaaaccacccgtatgattcagttttctcccaccaagtccctcccacaacatgtgggaattatgggagctacaattcaagatgagatttgggcgggggacgcagccaaatgatatcagctcgtgagtgagcatcagacctggggttcacatcctcgtatctttgcattctttcccatccattgtattgtgggaagagcagatagttctccccattcccactcttctttgttgtgtgtgtgtccactgttgatgagaatgtcactctttgttattttcaagtttttttagtcactgagctttcccatgattttcataggtcattggaattttgtattgttttatgaaatatacactgaaataagatccttggctacaattacagttttgtataatttagagagcacgtaggcaccattttcttgcccaagaatggggatagcaattcttttactttctaccacataatgtagctgtaggatgaaatcctgtagctgaagtttctcaactccagcccattgatattttgggccaggtgattgtttgttgcaggagggtgtcctgcgcattataggaagttcagcagctaccatggcctctaccctgtagcaccacccgagttgtgataatcaaaaatgttttcaggcattatcattttttttttggcttccaggggatgtaaaattgcccatggttgagaacctccggattaaattaagataataaatgtgaaaatgtacattttaagacaattttccaattcaaggtgttattaggatgagatttaagaacaatagaaaaaatcattgtggcagatgaggtaagcagcagaagggaaaacagggtatagacattaaggactagagttggctgtctcctattatagtcttgtgaaagctcactcatacagattcctgctataaatttcttgcttttgtatttttccaagcaaatatttaatacaatgttgcctgctaatagaacttcccattacagatttaagttttcttttcttttcttttctttttattttatttatttattttttttttgagacaagagtctcgctctctgtcatccaggctggagtgcagtggtgtgatctcggctcactgtaacctctgcctcccagttcccagtgattctcctgcatcagcctcctgagtagctgggattacaggtgcccaccgccacgcttggctaaatttttgcattttttaagtagagacgaggtttcaccatgttggccaggctggtctcaaagtccttgcctcaagtgatctgcctgcctcggcctcccaaagtgctgtgattacaggtgtgagacactgcagccggcctaagttttcatttctttatgaaatactgtgtagcatattcactaccatatgatgaataattaaaactaaattgcaattgtcaaaataaatgaacacatcacatttggaggtagaaaaattcctaatttttttttcccacgtagtttattgcatactattcttatttgtggtatttggtgttatgtagttactcaaagttgttacagcatttatactatatttgttttgttgaattgaaatcatagaacctgccaattaaatttaaaacaatgtcatacacgttggtttctctattacttacagagtaaaattctcaaagccccatgaggcatccttgtcttaatggcatggatatgttactgcatgtgctcttattgtccagccagctggtattcatatataagattttattaaataacatcttacacattatttatgtgataggctttggtgatggggctttgagaaagctgtccagaagagagatgtgagcattctctatgttaataactttctactattttattttaatgtaacttgctacatttgccatctgggatagaagcttctgcatcaaccattaactatcaacaccaactattccaggctgcagaatttcagtttgaaacggttctaaaattctatggaatagtgaaggcccgcttgcttcattgtgctttcctttaagtggagtattgcccagatgtggaagttagatgtggaattttcagacagaactgtttaccttgagaatggctgggcaccttccatttgtactactttttattattgtcagaactgatcaaataaatctgcccgagtatctgtgtgtgggatgcatgttgaaagcgattttattgttgcccaataagtccccaaatgctgtcgtcttttgctttccctctcccatcttaagtgcctttttgcaacttgcctcacaaatcacattgtctctacttattacccaggcttttctccagctggtaaaatggatttttttttcctcagccagattcagagtttgccctgttcttattccctgtatgtttcccttcacttttaatgtgaaaattgcaaatatatttctaaacccttctgcacaacactttccatttatggaaaactcacactatataaagtaacgagaggagatatctaaaatgtgtcttccattttctgctctgtatctccaactggaccaatttttccagataatttctcctttctttccaactttatctgcatcgtagaattcagagaactgaaagcatttcttcctttctttattttttttcatattctttctctactgcagacttcgctaactgatgaaacactgccagagcccacttggactgtttcgcaactttacttaagggaataaaagctctcatgctgaggtaaggcaaacagtccatgtaggttctcactaaaaagaagagtggattttataagctcgggcctgtcttataatctctctgtgtcttgttcttgtatgtaccttgataatttactatctgtcctttttctgcccagtggatttttgaggttcacaaatgtgagatacacaaagatgtgatatacacttgctgttccgtgtttttttttttttgcaaatatgcattttccctccagaactgttactggtaactatcctgagactcaagatgactttaaataacacttttttaaatactatacttagttagggttagacttggctgcaagaaacagaaaattcataagatcaggagcttaaatgagatacaactatatttttctctttgaattaaaacttgagataggcattccaaagctactgtagtgttccatgatgtcagggatccaggatttgtcagacatagcttttgtcctcatgattgcagatggagcataaggacaatgtgttatagtcacattccaagcagaatgtgaaaaggtacaattatttccttgtaaggaaagttcccagtagttgtggtacaactgtgctggttaattctatggatcggtgcttagtcagagggccatgtgtggctgcaaaaaaggctggaagatacgatacagtcctttttcttgtggccatgtgtccagctaaaatttatgtcctctaagaagagaaaaattagcagtattttgctctcaaacattaattttaatatatcctatattttaaaacactgttgctgggtagattgtgaactacatgtgggcaaggactgtgtataataaaaaatattatgttgtcagctcttaacggtgtcagcaaaataatgaataaatattcattgaaaatgtacatggagagatggtatttttatcatgtgaaatatgactcaaaatgagactgattttttacattttaaaacaaatgcacccaaccattgtttattcattcagtaatcactgagcgtatataccgattcattaaagtatcatttttctttctttaattaaaaatcttaaattgatatataatagttttacatattcttggagtgcatatgatattttgatatctgtatttaatgtagtaatgatcaaattagagtaactgggatacctattacctcaaacatttattttttctttgtgttgggaatactgcaaatcttctcttctagcgattttcaaatagacaataaattattgttaattataatttccctattgtagagtcaaatattagaacttatttcttctatctgactatatttttgtgccctttaaccaacttctcttcatctgcctctcccttcctttccaagcctctggtaaccatcatcctactctctatctccctgaaatctacttttttagtttttgtatataagtgaaaatatgtgttgtctttttgtgcctggcttattttacttaacataatgacctccagttgagcaaatgacagaatttcattctgttttatggccaaataatattccattgtgtgtagctataccacattttatctatccattcatttcttgatggacacaaagagtaattccatatcttggctattatgaatagtgctgcagtaagcacggcagtgcagatatctcttccatatactgattttctttcttttggatatacacctagcagtgacattgctggatcatatggtaattctatttgtagttttttgaggaaactccttacttttttccatactggctgtgctacttttacattttcacaaacagtgtataagctttcccctttctctgcattcttgccagcatgtgttattttttgtctttttgataatagctgttctaagtggggtgaggttatttctcactgtgttttttacttgtacttttcttgatggttagtgatattgaaaattttgtaatatacccattggccatttgtttgtcttcttttaaaaaatgtctatttgggtcctttgcctattttttaatgacattattggtttttgctattgagttgtttgggtttctcatgtattctggtgattaatctcttttcatatggaaagtttgcaaatattttctcccattttgtaagttatctcttcactttgttaattgtttgcagtgcagaagcttaaaaagcttaatgtagcttcatgcaatccaatttgtctattgttattttttttgtttttgttgcctgtgcttttgaggccttaccccaaaaatcttttttgagaccaatgttctgtatcatttcctctggtagtttcatagtttcaggtcttacatttaagtgtttaatccattttgagttaattttttatatggtgaaagatgagaatctagtttcattctcctgtatatagttttcccaacactattttttaaatttatttttcatttcaataggttttgggggaacaggtggtattttgttacatgaataagttctttagtgttgatttctgagattttggtgcccccatcacccaggcagtgtacaatatgtccaatgtgtaatctttcatccctcacgccactcgtactctttcccctgagtccccaaagtccattgtatcattcttatgcctttgcgcccccatagcttagctctcacttatgagtgagaacataccatgtttggttttccatttctgagttacttcacatagaataatagtctccatttccatccagattgctgtgaatgcaattatttcgttcctttttatggttaagtagtatcccatggtgtatgtaacatattttctttatccacttattgattgataagcatttgggctggttccatatttttgcaattggacattgtatcagcaccatttttaaatgagactacatgcttttggagctttttctaaaaatgagttggctgtaagtacatggatttatttctcagttctctgttttgttccattggtccatttatctgtttttatgccagtatcatgtggtttgtgttactatgactttgtaatataatttgaaatcacatagtatgatgcctctgcctccagctttattctttttgctcagaattgctttaattattcaaggtcttttgcgattctatagaaattttaggattgtatttttcatttttgtaaaggatgtcattggtattttgatgaggattgcaatcagtctatagattgctttggatagtataaatattttagcaatattaattcttctaattcatgaacatgggatatttcttcatttttaatgttcttttccatttccttcatcagtgttttatatatatatatttttttttgtggagatcttccatgtctttggttaaatggattcctagaattttttttgtagctattgtaaataggattgctttcttgatttctttttcaggttgatctctgctagtgtactgaaacactactgatttttgtatgttgattttgtattctgcaactttattgaatttgtgtatcagatttaagagtttttcgtggagtctttagatttcctaaaataaaaaatcgtatcatctgaaaacaagaataatttcacttgcttttcaatttgtatgccttttctttctttttctttcctaacagctctgactaggattgccagtactatggtgaatggaagtggtgaatatgggcatctttgtcttgttctagatcttactgggaaggctttcaattttaccccattcagtatgatgttagctgtgagtttgtcatatatgaccttaatcacgttgaggaatgttccttctatacccattttgttgacagttttcatcatgagggctgttgaattttatttcatgcacaagtgttgtttttcttatagtgacttctttaaccatttatcaagtcatgttttggatttctccttaaaaatgagtctcagacttaaggttcaaaacacctatggaaataattctctttacgactaatttttctctttaagcctacttttcttcatttctcagagaagttatcttgctctgataactttttaactcttcctaaaaatcaaatctccccccaacaagatggagatttggtcctgctgggggatttttaagtaagggctgttagctgtgattgaggtgcctgtatatatgagacaaggagccttaagggactaggatcaaattaattaaaagtcacatttattgagccctgccattgaagaatttataatgtcttctatgcaaaccaattcattggtaaggaacagcattgctattctcagcattttggaaataccacaatgttggagtcgtctcagaaggatctctgaagagttctgggaaggtgacagtcaacagcagaatagcagctgccaccacagtcaagcagttggtttgcttggcttggaagttttagacatcaaaggagtatggcttcttcaatactaaaaccagtgacaaaattgcaaaagttatttttattcctcttcaaatatgagcaaacattactgtgattcagcttatttttatataatgttacagggaatcaaattaagaattaaatgcattttttggcatagttatgtcttgtaaagaaagaaagatggtgccaggggaattttcctttcaaatatgtaaagaacttctaatgagtgaacctttcctgtgtcggaaagatagcattcacctcctttcctggcttctgtgccaacttacgattgtggtgtgtagaaatttagtgtcagccactgaaagaactatttcctaagatgatactgctttttactcaaggaataagtaggttccctttgaattgacctgtgtgtgtttggaaaacaagcttaaatatctcctcttctcataggaagaacactatttcaaagagccattttctttcctaacaaagaaattcatactgcagaaaaatcagcaatttcacagctggtttttgaaatcctgaaatgatgtatacaaatcaaagcaggagagattcatttggaatgaaaggaatatttgaattgcatcccagtttcgaataggatattgtttcacggttctacagtattataaacatgtcatgtctgttatacatgacaatcatatctcatctgtgactcatgaactttataagaaagtgacaatttgaaagcatagaattgcaggattggatggaacgatatcttctaagttatttccactccttttcccatttttggttgaccatgctaattcccctctaaaacattcttctgtagctacttgaaaacacccattgcttcttaaagtaacctattgtcaaagaatattggattttcttatgtacattgaaaaaatgacactttattggttttgattctaccaccaagagtcacagggaactttctatcttttcatcatatatataacaggcttttcatcttatatgtaacagtccttaaatattttcatattgtaataatttcctatggaacctgttgacttttacgctagagttatagtgatggaggtaatgagaagtgatcatattctggatatatggcagcagtagacagaaggtgtggttcataggaattgatcatggaatggatgtgggctgtgagaaagagcagtcaatgtttttgacctgaagatgttttactaacatatgttaagcatttactatctgctcaatatactttgctaggcattgtagcacaattaaatgtgcatttgcatagctgttcgatgatacaggtaggactattctctaagactaagagaacattagtcaggcctcttatggtgagggaggggttccctttctttccattctcatgctttgacttgagagagcaagcctatatgttattatggatcagaattgagatttcatgctcagttttaagtctaaaaatatgcttttcaatatctagtatttacatgcgtgtgacttctcaggaattataacgagagcctgaaaaattaccaggggcaacattttcagtccggagatgttataccccagttactgccactaaattttaagctccttgggagcaggaatttgattcttttattatattaatagtatctgttacataatattaactcagtaaatgcagggtatgctattgtaaaactatagtctcagtctctgtaagtggattttttaggatagactaggtcctagttaatgtgatatatctctatttctgtctatctatctgtctacctacctacctatgtatcatctatttatctgtcaatcaagagaagaaaataaagaagcactcttggagaatcaaaattttttataacatggtatgcaactcccttacgttctttatcagccacctgcatgcaaacagcattatgtctgaagttaaaacatgtaagatatatgagagtggaatccttggtgcatttcactcttgaactcttgtctatggagtaagtagcctgggggtagtttctcctcctttttatatatgtggggagaaggaattaggtggctgattatcttgtgctaaataggtttctctgccgatccacaaggtggcagggagtccttagtgccactatgacagattaaccaaataggcatctgtcgaaatgtctgatgcattagttgcactgcctgtaaaagagatgggcctccttgagaaataaatccacactgaatttcaaatgtggttgtgtccccaaaattagcaacgttttcaaaggtgtacccttcaaaggagagcagaaataaactgtaccttaaaagaactagtgctcagaggcctttgtttaatcaatggttagtttggtggtgattgcacaaattcactacattaaatttaatcagggatgtttctggtatgtgggtggcatgcttactgattaattcatttatattcttgaaataacatatgttctcctggatgaatttccacagtttggtaattccacagcatgcatttcagcatctctaaatggctgttttgttcactgtcccagagcctaagacatgctgggtgctgggtactgattagtttaccagactaagaatgacagacaggaaatggcaccattttaatctctcagaagaacatcagaggaatcatttcggtggctgtaaatacttcaggattttgatgtcaccttttcaagttgctttaagaaatcacttaggaatggtttgggagaccatgatacaatgaggtcccgcaaagaattacacctttctttgtcagggttctgaaattgattaagtataactatgtccgtgatgtaatcgattacattaaaactatcattttggagaaaagagacctgatggattacagagtctctacccttatttataaaaaacgatgaaatgaaactcagtagttcattgacttttgtagatggaaagatagtttgtagtagagctttgcattcaggactagtagttgccaccaccccccgcccatcccctattatagccagtttgtttgtttgtttgtttatttatttatttatttatttatttatttatttatttattttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctatttatttatttactttaacttttattttaggttcaacgacatatatacaggtttgttatataggtaaattagtgtcatgggggtttggtgtacagattattttgtcacccaggtactaagcctagtacctgatagccagtttaaagtgtgtacattggggaagggggggaatgaggttgttcttagacagttagaggcacagagggtatatatatatatgggattgccttatgttaatacatcacttggctttaagtgtgggaatggacaggagtacttgttatgacctgtggggccctactttccttcattctcagagagattttgcaaattgcctaaaatatctgttaatatgctctgtggctacatgcttacagacatgatgacaaggaggggggaaaatattgttcattgttgtcattttctagctggaaccatgagatttgcttaaggaagactgaaggctagtgtgacagaaaatggagctcaggaggacccagaataaattacattcctttggagggtcctgagaggggcaggccatggcttagttccttctattccactcatttcttacagttcagctgcctcccgatgtgcagttgtttagtatgcaaatcaataatcattacctatgtgaagtgttagttcacaggcgtgcaggctgtggtcagttggtacctgttccctcctaaagaactatctctgaagttgaacatctctgtttttctttgtataaatctgaatattaattagaccactgcttattaacttagggacctctctgcttttggtgacagtagcaggcagaatatagatggtagaaaacgaaatatcatgctgtttctgtaaacggtttggtgtctccatataataaaactctttagaattaactgcctccagaaacagggacaaatgtgatgtcctttctctgccccttgaattaaataacaaaatgaacagcagatcattttgatgttgctactccataaagatcattttgttattgttactaggagagagtggagtgtaatggaaagaatacatgtttacagctgggctgtaatcttggatcttctgaaaagtaagaatatgttcttgaaggaacctcaaattttgtgaatgtgcttattattttaaagataattacatggattcaatttctgtctccgtagtaacctgctgtattatctttctctagctatataatctctctttgcctccatttcttcatttgttaaatagggataataatagcacctatatcataggtttattataaaaaatgaaatggattcacatttttaatgttctatgtaattacttatcattgttgttttaatagggaaagtattggttatataaatagccaagaaaacagccaactgagacttttcttcctagattaccttggttatatcagtgcttctgggtgtggtcactgatattctacagcagaaacagctagtggggtccccaactaaagaatgtatcttattggaggctaagaattatgaggcaactatctctgacttgagaaccctaaccttatattgacatctgagatttattcatcaataaacacctttttgtaatccagaatcatgttatgtcattactttctatatcagaatttaaatgttaagggaccaagacattatgcaatgaatactaaaatgttactaaaatcatgtgttgtgaagaatatttggaaatatggaaacatgttcacaagatgttaagtaaaaaaacaggttagcaggttgtaaaacagtatttcagtatgattctaaattgcaatcattaaataattttataatcatgaaaaatgttattaaaatattataatcctgtgataaattctaatgagtactttcttgatttggctttaacattttccaaaattaaaattacaagttttttttctgattataacagtaatacagcttactactgtagctattacaagcaaaatagaaaattaggtaaagatgattaaaatcatccacaatcccagtttcttaaaatggccttactaagatttttaacaaaaatttactccacatatttatttatgaatttttatatgcaccatttctctaattttcctaaatggagtttataatatctacctgttttcactcaataatatattgaactatatgttgaccctcatcattgtcccaaagtttaaagtcattgaatagagatacagcaatcacttactgatggagatgtgtagtttggttgtcttacaatttgtacattaaagttatactatgataaagatctttgtgcataccaatttaccctaccaaaagatatgagaatatttccagttgaattttaaaatgaaaacctcattattcttttaacttactctcatttgattattgaggtggagtatttttccataggcgtctttgagcccctcaacttgacaattgtattgacaattattcactgtatgattatcgtgattattgcaattaagtgattacttatggtttctcatttattggaaggagcattgtaagggtagcagaaacactacagagcctttttttttttatttaaccactctcttgccctggacatgaggtggtgattggactctcagatgctgcttttgtaatatcgcatggtcaaatcaagccctatcaaagtgccctgtcatgtcctttcatatctccttagggttaagtatgtccccaaagccctgcgtcttgaggtaggcatgggaattatcttcaaaaatatcaacataggatataactttctctcttagattagctaagcttagaagaaaaatttctttgtggtcaaatgtttctgccatattaaaatctacaagtcaggtggtgaccagattttgtgatgccatccaaaaggttttagtacaaatttttcttaaaaatgcagtaagtaattgtaaactgtgatacttttaaattatctgcaagattattccatgaccatttttaaaatagatggtttttctgttgtggtcttagttgtcattttatagttgaccccacgtgtaacttttcgaagactctcaggattcccttcagtcctattctgtgtatctatctagtcattgtcccagtgaaatgataaaaggcccaactcagcttgttttgcaatgtgggcaacaaacatctcaataggatgtgtctcttccagttgtttttcttgtactattgatgtcttatggggagatatttaacttcacttcttggtcttattcgtagcaacttccatgactgatgagccagttgaattagtctttgggatagtcactaagtagatgggaacaggattttcttggttggaagtccatttcttgaatattcaagtttgtttgtcctagaaatttaattgactgagcctgcctagtaaaggaaatctttgtcatgccagtgtgaagttctgcttcccactttactattttcctcttaatgcagtactaatatatgttgaaccaaaaacaaaaacctgggcttatagcataacacacctggtattaaattgtggtaccaccatttgttatcctggttagttaacaactttctgaaaataaaataaggataataatatctatcttaatgtatctttttttcttatgaggtatctaagatagaagaatttctttttctttgccttcgcttaatagaggttagcattattttattttatataaacatagaaataaacatctgctggaaactcatttgagagaaaacaacccatgttggatcttagggaggtagatacacttttccattctttcttcaatctacagaggttcatgtcatacccacatcttcatctaaaaatcaaggaatgaggctggataccgtggctcacgcttgtaatcccagcactttgcgaggccgaggcagacaaatcacttgagctcaggagctcaaaaccagcctgtccaacatggtgaaaacctgtctctactaaaaataaaaaaattagccaggtgtggtggtgggtgcgtgtaatctcagctactcgggagactgaggcaggagaatcacttgaacccaggaggcggaggttgcagggagccaagattgcaccactgcactccagcctggacgacagagagagactccatcaaaaacaaacaaacaaacaaacaaacaaacaacccaggaatcattctagacattatttgtttctcaaatctgtaattgttttaggatctatgtttgttttcttttcaccaaaactaaagaaacactgttccttatttgctttttttttcctcagtctggctacttacttttctccctcatagacaaatgctaacaaccaatgaatcaccatatttctcctttattaaagctgtctccaatggcattctcagcaagttaaaatgtcaagtatatgggcctttaagaaaggtttcaaaagatatccctggggagggagggaagagaaatttgaggagggaggagggaagccatgtgacctgagaagcaggaattctgtacataaatactgaagtttactgtcaagcttccgagtaaaaatgttaaatatttgcagtgtccacaacccatgtccctgtgataaggctggttaattcctagaacataatgctaggaattcaagaatggggatcatatcctgagtactgatgatccatcttgatactgtgtcaaagggcacaggatgaggaatggaagggtttggagagtgagaataaattactgcaaatccaaacatctgactggataaactactccaagtggatatcatttattattcactccatagaaagattagaatgtacaccctagggagattaaggtaagagtaagagagatgtctaaacattttatgtgtccatcatctacgttgcctgtttatcagagtctgtcactataatgtttactgctgtaagtggttaattatgaatatatcagctgaatgctttcatgtcagttgagctgtgcagttgccacagtgagcactcttttcatgtggacttttggataaaccagcgtttagagattgtgttttataaattatatgaccaaattccaataccacatggagaatacgtgatttatgtgctaattggatcatgtccattagacatcctcataactatcttttatcggcactacagtttttatttactaaaacatagtcacatgaaagtttcctataatagtattctacactttctattctctgactcttaggaatcactactccttctgaactcctttagcaatgaatttcacaattatatattattaatgtgaaattcacaattatatattatatacatttaagtatatgcagtgagtttcacaattacatgttctttcatgtgtttatttttctcatcaaaaaattaaatcttggccaggcgcggtgggtaacacctgtaatcccagcactttggcaggctgaggcgggcggatcatgaggtcaggcatttgagaccagcctggccaacatgatgaaaccccgtttctactgaaaatacaaaaattagccgggcgtggtggtgtgtgcctgtaatcccagctactcaggaagctgagtcaggagaatcacgtgaacctgggaggtataggttgcagtgagccgagattgtgccactgcactccagtctaggtgacagagccagactctgtctcaaaaaaaaaaaaaaaaaacaaaaaaaaatattaaatcttgatttgaaagatttgaaatatcaggtgagtataaaatcattggtaattctaacaactgaaattaataatttcaaaaatattgctttttgtatgtctataaacttttatatattgaaaaaacgtatatatgcaaatatgttgaattcatgtcatatctttttaacattatctgcattataattttgaatatctttttgcttaattaattaatttatttttattatttttttttgagacagagtctcactctgctgcccaggctggagtacagtggcaccatcttggctcactgcaacctctgcctctcaggttcaagtgattctcctgcctcagcctcccgagtaggtaggattacaggtgcaagccactgtgctcagctatttttttgtatttttagcagagagagggtttcaccacgttggccaggctggtcttgaactcctggcctcaagtgatccacctgcctctgcctcccaaagtgctgggattacaggcgtgagccactgcggcaggcttctttgcttgatttatgatcttttaaaaaatttgtcatgctgggtcaattaagtggtaggtatttagaaagtaagactcttctattttttaggatctctgtggcatagtgcattgcaagtagttctcaataaatagcttttgttgtaaactaacacactggttactttctaaagtcatttgctcttttaaaatccctttggtatactaatctatactatatcactatacttgtagaccaagggatttgtctggccaacatggtgaaaccccgtctctactaaaaatacaaaaattagatgggcgtggtggcgcgtgcttgtgatcccagctactcaggaggctgaggcaagataatcgcttgaacctgggaggcaaaggttgcagtgagccgagatcgctccactgcactccagcctgggcgagctactgcactccagccaagggtttggtctacaaatatagtgatatagtatagattaattcagttgctttaaaaaaatccatatgccacaggatggctcaggatatcaatctatatcttagaaaaattattatacaaataaataggcaacaagattgagaaaaactggtatatttggtaaaaatacaccaaaaaagcaagagaggaggagggagatatgtgttttagaacccacacattttcaccaggtgaattttaaaggctataagagttcataaaatcttagcatcctgagtcatttgagagtctgataaacatcatttaaatacgtaatttaattgtttctcttttcttgttagagaaaggtggtgcaaacttattcctggaagacggtcagccatattaataatgagcaaaatgcctattgagttggttttttaaatactaagaaaatgacttttgaagttaaaacacatgctaactgttgcttagttttaaatatatatatatggagtggaacaaaagttcccactcaacagcttactgaaaaatacaaaaaggaatgcagttttcagcaggttctatttgccataaaacattttcttttcttaccattgttttatttttttctttctggtctccccctcttgccaacgttcacagctggacatctttgtccatctttcaggtactttgtgttgcatatccgtacgtgaaacacatatatgcataactattcaggtttccctcctgtctccattgttggcagaattctcattcaagttaacattaatatacttttttgctcttctcttcctcctggtttgtccttttgtcacttggaaaatattgatttccctccattgtaggtgagatgcacctacatggctcatttgtgcttacttccttcttgtttggagactcagcaagttcagcacaatgctatttattgaatttatctgtcaatttcttcttccttgcatggctgactaattcagtggaatcagcacaataccagaagcacagaggataatggcttaaattttttttttcgcagaaaattgtaaatcaaaagtagagactaaatttgaggaccaatcccttcagaaggttgcaacttgtaaagtgtgtgcaggactgtctaggtgaacatggcaacagatatgattttctaatggggcacttctcagcttttcattaaatgtctaagaaatacacagaaagacatgaattggcagcaggattgtgaaataaaaatgagaggagcctctaacataggcaaaaactttcctccaaacagacaaacaaaagcgtataatcaatgaagaaataaaaatcagaataacctcattttcttcacagtacaaaatactaaaaaatcaacagagttattttcatgaatggcttagtctttggaattggctttggacatgcattcctacttcacacatcccagtgaacctcagcacattagctggttactgagaaggtaggaaagtaaactgacctttaccttttgtgaactgggtgctacttactaggatcttactggtctctttctgccaaggtcagctcctcttgtgttacaacagagaaacgactaatctcagaatgtaacatgttttagataagtggtatggagaagcagtcatgcttagttgttgaaagagaagtatacagtatgcacaagtgtatacttttgtaagtttttatgctgttcaaagaagaactttaagatactattacagcatagtcattaagagaaaagatgttaaatagacaagatgcttttgaattgcaagacccctgtgcctaatcctgaaaaagttttctaacttctttgtgccttagtttcctcatttgtaaaatggccattaaacacttcataatattactgtgaggattaaaaaagtaagaactaagtccagtgtttggtaactgtagtaagccctagatggatgattgtcactactgttatttaccctaaataaattcaatatttatctttagttattattataccacactgttactaagttaggcttagaaggaaatgactccctgttagctttgaaggttgagctacaagatcatgcccatcaagttaaaattaaggttttgacctgacaattgaaggtgcaagcctagagagattaccttccacataagcttaatacctggcctaagtggcttgctcacgttatctaagtagaaacaaactgaaacaaacaaaactaataatcaaaactaataaaaacatccaaataaataaaattattgattcaggcaaggaataaggattaataaatttgataatgaggggctggataattgtataatgtcaaggtggaatcacacgtgtaactttctaatcaaagaaaaaaaacacacactggagagatcctactatttccatcctattccagtagtcagtcagttgttatatgccctgggatataatgcaagatataatgagcaactttcacaatgtagtctagtcaaaaaagttttaccaacatcagatcattaggagatacaggagatagaagaacaagggagacatcatcacatggatgcaatcagacaaatgacacgtgcgagacattctgtgaaacagcagacctggtctcttcaacaagtcactgtctggaaaaaggactgaactatattaagaatgactgaagaaacagaatcagatgcaatgattggtcttgaattagatacttattttgtcaaaccagatgaaaaggcatttttgacaggattgcctgtttttgtaacccaaaatatgcattgaaaaaaataagcaagacttttgttaaaatatctttagacagaattttggtatatatatatgatatatatgtgattatatctacatatatctatatatatattctgtctaaaaattctcacaattctgtgtaaagatattttagacagaattaggagatatctgtatctagctctagatatagctaaatatatattcctttatatatctataaatctatatatctagctatatatatttagatatatcttgctctagatatatatctagctcttatatatagagagagagatagatatagagctaggtatagatatataaaggaatatatatctatatagtatgtttatgacctacaagtattcttttttgatcaggttttcttgaacatcagatatatgtatataccagaccattcaacatgcatttatttttttatttttatctttaaatagagacagggttttctcatgttgcccaggctggtctcaaactcgtgggctcaagtgattcacctgcctcagcctcccaaagtgctgggattacaggcgtgagccactgcacccagtatcaacaggcatttataagcataggtataatctagtgctcttgattgattaaaagtatattttgagaattgtttattgtgattgcttgaaaggtgattattataaaaatgagtaaaataatgaatcactactcccttttttgtttcttattttgtttgtttcttccttttgtactcaagtaacaaaaatcttaatttagctctgaggatacaaatgaagagtaatgtttcttgcccctggtcccacagttagtgacagacagtcactaaaaattgaaatgcagacagtccaatttcagaaaccatgctcttgaccaatacattgaagggtctttagctattagctgcctataaaatatgtggtcataaccgtagagaacacagcaaaataccacaataaaaaaggataaatgaaacttcactatttttcatggaaaaacccaacttgtattgcctgcttcctttgtcagctttgagaacttcagtatgaagttttgtacctatagctccagctcctgaaaaaattgttccaaaagcctcaacaccagttaaattaagttcctgacagaagttggaaacattatgagaatgacacacatggtttttgttcagatcatctggggaatgcacgtcacactggcatcaacctccaacagagccttgggatgacagaagcagccgttcggaggaggcctctccttgctctgttagtgaaaagttgagatttggatggtatttttcacactcttgacagtttatgacacgctgatgggatgaaacagagagactgcatactaaaagttggctgtgacctaacaagcaaagttacacaagtcatccctggtcacataagaggtttcacctcctcatttctaaaagctaattattactagctttttgtgattaccagatatacctcttccattttttatacctcctactctcttaacatggacagcattgttgaactcaggatctgaagtcagacagcattgtcttctttgagcctcaatctgcttgtcaatgaagtagggatgatgacaattctttccatatagtgtagttgtgagcatgataaaatgcctagtacagggactgtctagtaactcctaaccacaactattatgcttgttagtccccatggcctatttattttaagcccaaagcatcttctggagctaagcactgtaatgcccttgaagtgttttttaatctcttcagttctgtctactgcacgttgtggtcttacactgctcctggccactgttgagttattcctaaaggaatacagcaatttcagaggccttctgaagctccctgtcatgcctggcaatgtcattatataccaactgatacgtttttacttttcccaattcttgacaaccttctatagtagtatttcacatatctgcttggaaaaaatatttgggtaacagcttttggtattgctaggtgttttcggttttcttcttacctttttgtttatcgtagtataattataggaattaattaatttgtcgaattgtgttatttctctgctcgtctagcatcatcttgctgtatggagataaagagcagttaattttgagtaatatactagaagtttggtattcgtgactctcatttttggtgaaccactctactgactcaaaaacaaagatttttatgtgctttgaaattttaataatcaggtaatgtctaacatttcacattttctccaatagccactcttttttgcttttatttttgcatataatcctgctccatttctaaaattgccctttgaaattttcttattttcctacacattccagtttattactatgtggaagctgataatatttatactttgttttctaggaggtcattgatataaaattttattttatggttgattttcttgtgaatgggtgttttacacaattttcaagtaattggcgtggattttatgaggccagtcaaatgtagcaaacattataaaattactgaaaatgtatcagtgatgacaaatatttaatgattggtttattttgattggtcgtagttccatttttctctaaggcatcttccttaaaataagcatatataaatgacctttaatgtatacagcatgcattttttcattctctagcaatgagagcaagcacataatgttgtgatcactgttagcccatctgtgttttaacatgctctccttagttttattctcctgtgttgttcatttagtatatggcctcattcttccacttttttttctgttttgatgaatagtttggataataatgactgacccaaggtgtgcaaatgatttaagcaaacaaagcaaaactattccactgtcttttgaaatgtaggcttcagggtatcttgaattgcattcaaaaagataaaactcttcatcagaattaaaaacatacgtttacacaaaatcatgtacacaagttcatagcagcattatttgtaatagccccaaagtagaaacaactcaaatgttcatcaactgataattcgattaaacaaaatctggcataaccataaatggaatattattcaggcataaaaaggaatgaagttctaatacgtgttacaagttggatgaactttgaaaatatgctaagtgaaagaagtcatatacaaaagacttgcaaggttctatgccttcatgtatatgaaatacccagaataggcaaatccatagaaacggaaagtagattagaggttcctaggagccaggtacagaggggaatggagagttattgcttaatgggtatggagtttctttagaggaaaaaattctggagtggtggtggctacacaattttgtgaaatatactaaaaaccattgaagtgtatgctttaaaaaggttaaatggtaaatgttacattacgtgaattttatctctaaaagcattttaagagaagacattataataaacagagagtacaaagatcagaagacaaaagaaattggtggaaattatttgacattatgaagagcattgtaagtctcaatttcagggagaattgaccataattgacaaaatattgcataaataatatcagggatgcatttggataagaaacacatattacaatcctttataatgttaacttagtatgtattccagtttccacaaatgcactccatctcccccaaagtataggcaagtagtccttgaaagttggaatggaaagattaagcaacattttcataaatatgtcactgaaacaggctcacaaagcagtacatgccatataatgggaactggggtatagaagagaggttaatcaatgctgtatagctaaactggaagtaaagagggatttcataagagaggttccctttaaacttgttttggaaggatacataggagttctccatagtgtggataatgagggaacaatatgagcagtaagaactttcatctaacctttaacttctttcttctatccagaaagggttagtcaattttgcattgagcaccatcacccattccctaaatacaattcaaacggcttacaatccttgtttttttggtttggtatgtaaggtttagttttcctccaacttctgcatttctcttcaagggaggccattaaaccctgtttttatttctaatctacaaaagctaaaaaagcatatttccctttatgaatttttcatatgctcatctgatgcttgtgtgctctctgcccctttgcctggcctgaaatctgcttcttacttatctagttcatctcttgctatttgccaatgcaaatgtgggctaaaaccagctgaaacagtaagggcatgttagcagagggaaaaaggaaaggaaaaagaggcaaatagagtaagtacccaaagaaggaaaaagagcagagatcatagatggctatatgaggttcaggcagaggaattaaagaaagtgaagaaatggttgggaagaaattagaatgatgcctgtagactggaagcagtgaaggaaacaacatcagaaattggggcaaaagttaagaataggaaataagcttttactttttaactgtgctgcaaggatgcaaaaccaattaaattatttgaaaatgtgctttattttaggccaatctatagtatacatatcaaaacttagcttgctctggtgttcaaggtggctttatactgtttggctatcctgtgtttattatgccattaatccttttaactggtctggaaggcaatttagttttaagtcagttacttttttgaaatgaatcttatttataccaaacttctcatgtttgcttgaatttaatcaaatttttatataaagtgtaatttcaaggaatttataatggagcatcaagggaggagttggttatgtaatcatacttttgtaattttctattgtggagaaatttatctgcttagttattgaaatcaaattcctgcaatagagctattaaaatgggctagcatcatctttgagaatgttccttcttaaaggtaatataaattatatccaacaggagagaaaaagttaacttatgaggtgagtagactaagagtcattaaaaaaatcttgaggaagatttttaataatatgtaaaatatttctgatgtggtagcataaatatatattataggacattattaatagtaaagtgatccaaaacatataccacagggagatgacttgaaaaaaatgcattaatgcttcatcagttgttatcttagggtagtgggtaataggatagtttttattctctctatatatatttttgccagattatctaataagatacgtttttattaataataaaaagagagacaaatgatacaaattttagaatgaggactgctcagtctgcataaaaattattttcttgcaacaaagatgcactatggaattcaaaaatggtggtaactattgtcaaacatgtagagattggagttcctaactgttgcaggaagatctaagataaagtactacaagatgagtaacaaatacatccttaaaagcccatttaaggagttcttaatcgcaaaaaatttgaataggatttaatttgatgaatggtctagttaaccaaaatagtttatctggttcagttactgttgataaatatatttaacgacattgcaattgcatattattcagccacaacataatttcattaatgactcattaaaattattgtgaaaaggaaacacttaagattgcattggagcattgggatacctcacagtttgattttttcttcttcctctccctgcacattttttacttcttatatttaagtattctgctatgattttaaaaactagctacaaaggggagataacaaaatgagagccttctcatattaaaaaatatcgtttcttctcctaccccttatttttcagtgtatgttcacattaagaaactagaaaaatctagataagcagagccaaggtaattagttttctgtaattcttacacgaagagatcatcactaatgtcattttggtattatttactgagatttgttttttctacacttaaataggcacataaatacatgattatgtatttctcacactgttttatggcctgtatttcacacttggttttataatatgaacatcttccatgtcagaaaatattattcttcattatactaatggccaaatattattccatttgtagatgtatgtacttatttaactaattttctgtctcttgaagatgaattcctgcagtggaattgctgaatcaaatatgtatatattttgatgctttacggcattaatacattttcccttaagaaagttgtatcaatttatacatctatcatcctcagttaggtacatccttgctgactttgggtggcttttttattctgtttcccatttttataagcaaaaatggtattatatcttctttaattctactggtaggttgaacttttaaacatttaactatactgtatttctcggatctcctgccgtgtgtgtgtgtgtgcatacaccccctgccccccccacaacatacacatacaaatacatatttggactttaaaaaacactatgaacttgaattttttggttgtgtatacaccagtttctaattgattagaaaaatgagaaattctcttttttttaagtatataggaactaaatcaaaatattgtgaaacctgaaaagaaaataccacaaccccaagcagaaagggcttagttagctttaaaaaaactacatggttgttaaacaaggcttgtcaagctattaaaaacaagagtaacataaaacttacaatttctaaataggaccactgtttctaaatatgttaagtggtgtttaagtcagttaaatcttacagccaaaatgttgtattaatgcatgagtgagatgcattatagatgacttgataataaagttatgtatgtttacaacagagcattttgttcttagaacatagtgggagcctgaagtcttgggattatccatgatcataattgaacatatgtttagtttactctgggcaccatattttcaaagggacataaatgaactagagaatgcttaaaatgttgggacatggttaatcatagtgtcacatgagaaacgtttgaagaaaccagggataaaaaaagccggaatgagttaagattcaagcatggcatcattatatacaaatgctagatgagctatcaatgcagatttcaggttttgattgtacccctgagatggattaagcgtttgtaggtagaagtatgaagaatctaaacagttttgtggagatattcgtagttagatcaaacattcccctaaaaatgttcagggcacattgtctcactggaactctttgttcagaaactgaacatttacttagcaaggcttgttgtagagatgattttatcatttgatggtagttgaactagctaagttttacactcattttcagccctgaaattaaaacaaacttgaacaactggaggaatttatgccattatacacattgtaactctagcatacaatgcgtgaaaaatatgctagtttttttcatagcacattttaaaactgaacatttgaaatgggctgtgtataaagataaatgaggctgggcacagtggtgcacgcctgttatcctaacactttgggaggccgaggtgggcagaatgcttgagctcagaagttccagaccagcctaggcaacttagtgagacctcatctctacaaaaatcaccaaaattagcagggcatggtggtgcacacctgtagtcccagctacttgagtgggctgaggtaggaaggtcactggtgcccgggagatcaaggctgcagtgagctgtgattgtgccactgcactttagcctggatgacagagtgagaccctgtctaaagaaaagaaggagaaggagaaggagaaggagaagaagaagaagaagaagaagaagaagaagaagaagaagaagaagaagaagaagaagaggaagaagaagaagaagaggaagaagaagaagaagaagaagaagaagaagaagaagaagaagaagaagaagaagaagaagaagaaggagaagaagaggaggaaggggaaggtgaggaggaagaggaagaagaagaaggctgatctgattgactttgtgaactatttatattcatctattgttgcttgtattacattgcaagaatacaaaactaataaaaatgtatgaacttattgtaaacttggtaaattgagaataaagatctcattttttttgtgttaactttataagaatctgtgagagccagaatgatttcagacactgatgacaattttaacagaaacataggcgtttcacaatgcagtgggaaaattaatagcagaattagaaaataaattagaatagatattagttgaaataatctgaaatgcatttgaaaggaaaataaggaacagagatttcttagtccatttgtgttgctataaaggaatgcctgagactaggtaatttacaagaaaagaagtttatttggtttacagttctgcaggttgtacaagaattatggtgctggcacctgcttctggtgagggcctcaggctgcttccactcattgtggaaggtgaaggggagccagtgtgtacagagatcacagggccagaaggaaggaagagagatagaggggaggtggcaggctctttttaacaaccatctcttgcaggaactaaaagaggtagaactcactcactaccatgaaaatggcactaagccatttttgaggtatctatctccctgacccaaatacttcccattaggcccctccttgcaacattgaggatcggattcaacatgagattttgaggagacagacatccaaactatagcaagaggaagttgctataaaaacagatcaaagaaattgggaaagattgcaacacactgagatccttaaacagtttccatttcaaatggaatagataaagccatactaagtataaaacaaaatataatgaaaatgtatgttatcaaataagtggaaggattgtaagaagaatatgaatctggaaatcagaatgaaagaaaacaatacaagttttgttttgttggtaggaaaatgttggctggaaaatgttaaataaagatataaattagagaaaagagggatgtttgtcttgaatgttcattcagtgacatagggaaggtggtgaaaagcaagaaattccaaggaatagagttaaatgaaggcattttatatgagtattaaagataggtagcgaaattcaaggtacacagaaccatcttaaggtctgaaaggccttaaaaataatccaatcccatacccagtgaatggagcttggccctatattcttgagaagtgcttgcttagtatagactcaaaagtacatttcttataaggctatacatttatagttttaaacagcttcccaatgcctatcatacattcgctttagaaatattttagaaatattattttaaaaagaaatattttagatgatttctaacatgaatgatggagtgataggtacagggaaggatgagagaccaggtcccctaaaacccagagagactaaatgtcatttgggacttttgcacagaaagaggagcatggatttgacctatgtttctcattgcatagagatatcctaggaagatttcaaaacttttgtatgtttagttttctcatctgtgaaatggcgataataatagtatctataagacagagtttctataaggattaaatggatagtatatgtgaagaccatatcatggtgcatggcacatttatgatgttcattaaacgttgctgttaatatatgagaagggctgaagacatctgctttaagtcagcatttattgaacacagttcaggggaggaagattggattacataagatggtcttcctgtcccttcaaatcaacttgggatttttttttactttgggcagctacctttcaaccttcagtgcttcccgcttccccgtataaatataagagaaaataagataatgaagaatgaactataaaacaatttagaggcttcttgcaactatatctggttttgatctctttctaattttattccacttactgcatttctaagaatagtcattgatgtgtaagttattacgatagtggctgaataacattaaaaatattttatcatgaagtagttctttctagacatttgatgattgaaaatttcatactacctctcggaaacttggaggcatagttttcagggttacagaatgttcattattagtatttagtattttttagattaaaattcccatcttagggtgtaccttctctgagccagtcattttcttagattttgaaacttttctacacctaacacgatggagtaacagggactggatttatctttctgcccaaaataacaacaaaaatgtgggaaaaaatgaaacaacagtttctagacagtaaacaataacaagcagcacagagcattgatcccagaaacaggggcaatgaaagagacaagcgttagaattgtcctggcttacatttcaaagagagcttccgggccataatgcaggaagggggaagccaggtggatcctggaaatatccagagtgattatgagaaactgatcaggcttgtcttggtatgttatgacttgaataacactgcactaattgtgttttatggaattgacattggaacattcatatctttacatttatacgtacaacacctgttaatgaagtacttagtaaggtctgtggttgcagttacaggggaaaatcattaacgatgatggtgaagcaagaaaggctggataaaaagagagaaagacgatacgtgagacctaaataagtgaaaaaatgaggggtccattcaagagaatgaaaaagttcagtttgaatgaaatcacaattgtcaaatcagagacatgatgaaagaactacaggtaagccaggctacacagggtcttagagcatcttaaagatttgtgtattgttgcgagggaacaggaagccattgaagagtttaagcagagtgtgagatcattgagtatatactgctggggtctttggatgctaactagagataaccattaaaattttctgacttaaatctgatgagaggaaaaaacttatttccctttcaacagaaacttcgggtctgaactttgtagagtttattgtggctaaaatgaccacgtttttcaaagaaaaatcgacactataggattttttaaaatgacatgtgaaagccttacattataaattaaatcaccatctcatattcagctgcattttttaaaagaatccaactatatatattgagtgtcttggtcactttggtcctgacttatactgtagctgtacttttgaataactgcatctgtccatggccactgagaatctagaccccatcactgcagatgtgatgatatttttgttattcttatttctttgcttggatttatgtaaatttttttacccttccagcctacctaactacattataatttttttggtatcagggagtatataaaggctgtgttcgtccccagtgctaagtacagaccctaggcattcaatacattcttgttcaaatgaatcttatggagaattccaacccatataggagaattctcactattcaagaatttatctccaaattttcagcatcatttaaaaatgacaaataaattttgacatgcaattagactagcagagtcaccctagttacaactggttcctatcctctccccctttagatatttgaagaaaataaagtatgttaaaagaactcaaaataaatttttaattatgatattatgattgatgattattgaatgcatgctagcttttttccctactgtttattctatatttcaccataggataatgctaatataaaattattaaaggattaattcactgaagtccttatgataaagtatttggggatccctaaaattcttctgagttttaagtggcttatttgtgttgatttgttttgaactataatattttattttattttattttatttattaactttttttgagatagagtctcgctctgttgtgcaggctagagggcgatggcaggatcttggctcactgcaacctccgcctcccaggttgaagagattttcctgcctctgcctcccgagtagctgggattacaggcattcgctaccatgcatgactaatttttttgtgttattagtggagatggggtttcaccatattggtcaggctggtctcgaactcctgacctcaggtgatccacccgcctcagcctcccaaagtgctgggattacaggcgtgagccaccgcgcctggcgaactataatattttaatgccattttttacagtaagtaaaatattaatccatcacataattaaccgttaaaatgtctcatgcccattccctgtctcatttgtaaaaagtggtacttgtattgtcacttctacggcacttatctgtcccacacattttggcaacagattatttttcttctggattcttctctaatagtgttatatttataagcttgtctcttgcacaacagaatgaacttcacaagggcattggcttttcttctatctcttagtgaataattgtcacttaggatttattgaaacacagtaccaaacatgtattaggtaccccactgatatttgttaacttgaataagttgaatatgacaactttgttttgctttgttttattgaatttttcaggattatttgtatgcaataaaatgctcatatctgaagtgtacaatgtgttaactttttgacagccattaactactactcagataaagatatagtatatcttcataattttccaaagttcttttatgtcccttttaggtagtagtctccactgtaccccaggttaccacttttctgactttttatcccttagagtatttttacttggtctagaatttcttataaatagaagcatatagtatatactcttctttgccttcttttgctcaacattttaatattcatacatattattctatctatcagtagtgtgatctttttcaattccagatagtattctacagatgaatatatcacaatttattccattcttttgttgatggacattttggatgttcccagtttgggactactataaataaaacagttatgaatatctgctgcaagtcttgttgtggacatatgcactcatttctataggagtaaaactgctgaatgataggttaagtatatgcacatattcattagaaactgccaagctcttcttcaaagtgattgtcacatttacactgttaccaacaatgcatggaggtttcatttgtgtccacattcccactaacatgcgtattgttattcttttgaccttcacgattcttgtgggtgtatagtgctattgcactgtggtttaacaagagttcttgaggactgttgattgcagatacctaattttaagagaagtatgtgtaaattgtgcatttttcaaacatatttttgtacaaaaagcagcaattactttgtctccctgtgcctttgctattcatggaaaaacgggaatattagtagtactatcttatactgtgaccctgaagagtaaatgagataaatttagcacagtgccagacacatagtaatcactttatataaaatgttaactattattgtgagtaaaggcaatatattgttttttcatcattgttagtattattgagaggcagaatggcatagtatttattgcctgtgttcaaatcctggctttaccacttactaactaatgactttaggcaagttacttaatttccctgtgtctcagtttcctcatctatacaatgggaataatgcagcacctgtttcataagattttgtgatactaaatgagtcaataggtttcttggcacataataaacaagataaatgtgttggctgttattattactaacagggtgctgttattactttatatctttcttacgagtatatctctttaaagtagcaatttatttaaatgttttcattttagcatattgatagaatattaattttaatccagcaatccagtttacctaaatattctccaaaataaaagttgaaactttttttttaagtgtaggcagttctcttggtattgggtttgtgtcaattatctcttgctgtgtcacaaaccccaaaactcagtggcctaaatcattggccactaatttagtgtacaattctggaggtcagcagttttgactgggctctgctgatgtttaccctggtcttgaatgcatggatggtcagctctgtttctagcagttgagttgcttcagttagtggaagcatttgaaccatacatcttatcagccagccagctttccctagcttgttcccatggtggtgaggcaggccaaactgtaaagagcaaagagcagaagcaaggtctctggaggcccagccttagctcttgtgcagtgttgcttccaccatgttttattcctagtgtaaatcataagatttagggacctgagaaacagacaaaacctattgatgtcaggagctgccaagttacattgcaaaggaaaggcagaagagttgtgactttttttttttttttactgaatacctcactcaagagcttgttaagaataggctgtctctggggtaggtgcggtggctcacgcctgtaatcccagcactctgggaggccaaagctggtggatcactcgagctgtgaagtttgagtccagcctggacaacatggcgaaacccagtctctgcaaaagcatacaaaaattgctgggcatggtggcagacacctgtaatccaagctactcgacaggctgagatgggaggatcgcttgagcctgggaggcagatgttgcagtgagccgagatcgtgccactgcaccacagcctgggtgacagtgagacctgtttcaaaaacaacaacaacaacaaaaaagaataggctgtctctaattctttctttttttaattattaatatactttaagttttagggtacatgtgcacaacgtgcaggtttgttacctatgtatacatgtgccatgttggtgtgctgcacccattaactcgtcatttagcattaggtatatctcctaatgctatccctcccctctcccccaaccccacaacagtccccggtgtgtgatgttccccttcctgtgtccacgtgttctcattgttcaattcccacctgtgagtgagaacatgcggtgttcagttttttgtccttgtgatagtttgctgagaatgatggtttccaatttcatccatgtccctacaaaggacatgaactcatcattttttatggctgcatagtattccatggtgtatatgtgccacattttcttaatccagtctatcattgatggacatttggtttggttccaagtctttgctattgtgaatagtgctgcaataaacatacatgggcttgtgtctttatagcagcatgatttgtaatcctttgggtatatacccagtaatgggatggctgggtgaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgatcgccattgtaactggtgtgagatggtatctcattgtggttttgatttgcatttctctgatatccagtggtgatgagcattttttcatgtgttttttggctgcatgaatgtcttcttttgagaaatgtctgttcatatccttcgcccactttttgatggggttgtttgtttttttcttgtaaatttgttttagtttattctagattctggatattagtcctttgtcagatgagtaggttgcgaaaattttctcccattctataggttgcctgttcactctgatggtggtttcttttactgtgcagaggtctttagtttaattagatcccatttgtcagttttgtcttttgttgccattgcttttggtgttttagacatgaagtccttgcccatgcctatgtcctgaatcgtattgcctaggtttttttctagggtttttatgtttttaggtctaacatgtgagtctttaatccatcttgaattaatttttgaataaggtgtaaggaagggatccagtttcagctttctacatatgactagccagttttcccagcaccatttattaaatagggaatcctttccgcatttcttgtttttatcaggtttgtcaaagatcagatagttgtagatatgcagcattatttctgagggctctgttctgttccattgatctatatctctgttttggtaccagtaccatgctgttctggttactgtagccttgtagtatagtttgaagtcaggtagcgtgatgcctccaactttgttcttttggcttaggattgacttggcgatgcgggctcttttttggttccatatgaactttaaagtagttttttccagttctgtgaagaaagtcattggtagcttgatggggatggcgttgaatctataaattaccttgggcagtatggccattttcatgatattgattcttcctacccatgagcatggaatgttcttccatttgtttgtatctcttttatttcattgagcagtggtttgtagttctccttgaagaggtcctttacatcccttgtaagttggattcctaggtattttattctctttgaagcaatttaattatttcagtggaagttactaaagaacattgaagtttgttagaaaaaaagaggatgtcactgtaatataccataattgacaagtaataactatttgagtactaactggaggagaccaagcttaaatggttattcctgggaagaatgatttgtctcagggtgcgtagatacaaatgttaccaacccaccatgacaaagtttaggcaaatacaaagagcaacactaactttgatattgtatagaacaaaagggcacaagaagaataaaatggtccacagatattgcaggtgacatgtactatatgcaacaggtgtttgtttaggttatgttatcaccctttgctctgaaaaaaaaaaacaacaaaaaactataattccaatgaggtagaaaattggattgtaacagaaaactcacctttcagatgttcttgaaagatcttcaatgtagtattctaaaagttctattgaattattttaaaccatgttatttctattttcttctgaaaagaactaggtgacattaaagaagtctggatagaggaatggaaacaatttcaaaaagtctttcttcaggcctttgatcataggcattattttcaatttggatgaactggggtattctgactacctaagaagtctattgtcaaaatctgaatttattctgcaatataaattcagtttgggtactttaaatgtcaaccgtaatgtctttcaatcagtttattactgagatttttccagatttgatgtgtggtatcaaataacttacattatttgcaactatgagaatgcacagaaagcttcgtaatttacatctaaaaggaatgcaggacagatttggttttagttttattttaaaattttcatcagaaggaaatcatctgtatacatcatactgttgaatatttccaaatgatgttaaacattctgatgctttaacaattacattaaaaattacagaattgatttaagattgtgttaagaggttatgttgttgcttttgaaaacagtgagataagataaatcagattccatctcctcagtgctgcctatgctgacctgcctatataaaatagcaaatcccatacatcgtctgtctgatttcaccctgcccatttaatccccacgcattttagacttataaaatactgtatatttttcttacttgttatttttattttccgtctacctacaaataaatttgagcttcatgcgaccagaggtttttgattgttatgtgttttggtttgcttgtttttgtgtgttttgtttgtttgttttgttttgttttcttttgttttgtctgagacagagtctcactctgtcacccaagctggagtgcagtggcacaatcacagctcactgcagcctccacctccttgggctcaagcagtcctcccatctcagcctcctgagtagctgggaccagaggcacatgccaccacacctggctaattcttataggttttgctagagacagggtttcactatgttgcccaggctagtgtcgaactcctgagctctagcatcctgcctgccttggcctcccaaagggttgggttttcaggtgtgagccagcgtgcctggtcatctgttatgttaagtgaagaatacttagcagctggaagagtgcttggcacaaagtgaacactaggtagatgttggttgaatgaacaattaggttgataaatgaaggcatttaattaagaatgtaattagtagcaaatcacctttaaaaatatatctcattttatgtttaaaaataattacaaatgtataattttaacctcctcctttaaggttcttgtcgtcttgtcagtcgaattaaaatctagccttaacttttttcttgaaatttaacaggcttattttcacacctggcttttgttcttgtagttgtaattagtcagaattagtatattaatttttaaacacacactacctcatcttttgctctacttatcaaattatctaattaaaccttgaattttcagaaaatagtttcccaattgcattctgtgtatatcaaaatgcccttgaaaaaaatggaatttgaaaatttctttcttctgtcccccgactcttgcctctttcttagtctctccgtccatatatctctccttttctctcatacaatttaatagagaatgaatttccatctttggtacattcatattaaaaatctaatgccacatatgtggaggaaaaatcatatagctacatttcaaccaaaaaagtattgtgtatgaaatatatattctatagtttacttagtgaatgttattcctgaagactacaagtggcagcaaagaaattacgtggcatatatgtgtagattaagcatggaatgagtattgttttaaaattaacctattacctgtatggccatgatagtttttgtgaggagtaaattaatgcatatatgggagaaggctttgtaacatgtgaaacacttggtatatgagaatttgtattgaaatgattagacattaaagcatcttgttcataaaattttgataatcttcttttagccatttcttcaaagtcacttctatttttgtcaaatttcacctgtcggggggtttttagcttctgacctcagtattgtttcagtggctgagattaaacagcattctgacttgtacacagacaagtaactgtgctaatatccagtgaaattgaaaatggacaggaaatctttatacagctaaggaacaaataaatgataagagaattaatccagcattattgttcagaaaattaaacacttgagcagattaacaaaacacattataaaatttggattatttgtgaagagttgcaacatttggggaatgtttttattaaatgaatcttttattttactggatgctaatgaaaacaaactcattattttttatttggggtacgagtgttttttggtgacatggatgaattatatagttgtgaattttgagattgtagtggacccgtcacccgagtagtgtacgttgtacctaatatgtaattttctatcccatacccccaccctctttcttctgaatcttcaaagtccattatatcacactgtctgcctctcaagctcatattattgaagacttttccctataattttatattatttttatgccataatctgatgcttaatttctattttatttattaagtatgtttattttagggttaacattcataatgatcataaaaatcaggtaagctacagtagatgtagaaatttaacgtgtgtacacaacagaatatttcatgaaatttgtgtttaaaaacttgatttacatgattaaatcatttatgtagttttgaaatcagtgttatattctcctcaaaataaattgcatggaagttttaataggaatctcccacatacagtataattatttatctaaaacataatagtaaatatgtttataaattttactcaagtttaaatataaatagcgtttaccgcattaaaatatgaatttatcttattttattacatcaaattgtttgtcagggtcatattttatttagcgttccactaatgactacttgaaataaatcagagaaggtaagtcccataacagcttatgatctaggtcagtctcttcagatgaagataatgaagtgatttgaaaaactgactctattactgaatagtggtatgcttacttgagatagattatttatagcccctgcaaacaagagcagagttattttatattactgagacattttgaacaagaatgttagacagagtgaattgaataacttttcttaggatttagctcattttctatcatttcacatgtgttgacttttaaaaatctatttttaattatttcaactggcaatttaataaatacatttgcataatgtcctgaaagttcagggtagatttgtatgtgtaacgttctcaaaatagaggggagaattgttgggaaagctttgcatgttttatcttaagcaatactttttccttaaaaccaaagacattgaaaattacagccacaggtggatgtttgttttgagctaaaatagttaacagtctcatttatgagtccttgctctttccatttagccccatcaaaagggatgagtttatttacacagtgaccgtcttttttttttttttttttttttttttttttgagatggagtcttgctctgtctccaggctggagtgcagtggcacagtctcggctcactgcaacctctgcctcccgggttcaagcgatttccctgcctcagcctctcgagtagctgggatcacaggcgcgcgccaccatgccatctaattttttgtattttcgtagagatggggtttcaccatgttggccaggatggtctccatcaacagaccttgtgatccacccacctcggcctcccaaagtgctgggattacaggtgtgagccaccgtgcctggccgatccttctttatttttaataaaatctttaatcagagaaacctggaaaatagcatgaaggcgtgtccatttggtggcttccagataggaacttgatttacctgcaggaagtgacagcttagtaaatgatccttttgaaaatattgctgttattactctttaaatccggatttgtattaagccatccttgctatgtccttgatccttctttgaatccattgcagactgaaatatctcaatccgccagatgttctggtactgaacaatagctgtacaataataatgatacaatctcaaacacatcacagatgcactgttagtatccattactgtagaagaaaaaactttgttagcacacgctaattacttctgtgatggggaggaaaacaaaaatccatattaatttatatctttatggtctgcattatatttcttcatgaataatctatcttaaccatttattaaactatgaatacatttttataaatctggttgacatttaggtattttattaaacacaataaatgccagaggaaattgaattaagaaagcttgtaatacgctttactactagttaaaaaaaatttgtagctgtaaatggttctgctctatatcaagaataaatctgttcccagaccacagaattcttgttctttttcataccagaggccctgatcttttttgttgatagctggtttttaacagcttcaccatatgttttattccttttgatttgtaagaaatttgattatcagccttgaacagaaatcataatcacagcaaaaggaggcaagtaacttggggaataatacagagtcatttgaacagcagtgtgaagtctgagtttaactgactcagatgcccactctagtagagcactcatcagacttcagaccgaatccacttcggacagagaagtctccataaggtattcagactggcttcccctgtctttaaaacaaataaataaactctacttaatataataataactgaatttaagtatttccacagattagcaatttacgtgagagaaatcagcaataacatcaagcatatagcctgaaagtctgaaattgatgagagggatacaattggagccactagttattaatcatacgtgtgtatgtgcatgtgcacgtgtgtgtgtgtttgtgtacaattctgtctaaattggaactgatcttaaacccatttatatttttttgtggcagaaattttatgaggtaggcagggtgaaggaaggcactattaactttgactttataaaacttagaattgggctgggcacagtggctcatgcctgtaatcccagcactaagggaggctgaggcgggtggttcatgaggtcaggaatttgagaccagcctggccaacatggggaaaccatgtctccactaaaaatacaaaacttagccggcatggtggtgcacacctgtaatctcagctactgaggaggctgaggcaggagaatcacttgaacccaggaggtggagtttacagtgagctgagatcgtgccactgcactccagcctgggtgacagagcgagactccatctcaaaaaacaaacaaacagacatcttagaattgtttggctctacgttggttatgtaatttgaaacaaatatatgttgtgggataatcttaacgtgagctaactggtatatattaactaaagtcgttgaaatatttaattttgaaatgcaataatattttctcaaattaatgctcccgcctgaaaatctgtgagccagatagtaataattaacttctacctctacctaggattcctccacctccaactattttatcattggaaatgcatgaaggacaaacaactcaccatttctgcccactttagatgctaaggtgatattgatcactttgtcccatgtggaagaacatctaatgatatgttgggatgtctcatccataagtttattagtcaatcttatgttttatttgtacctagcaatgccaagcacactgtatgtgcttcattaatacttgtgaataaatatgtgaatgaaatttcaaaaaccatgaggtgcccttttgtggattcaatatgttttgtataatggtggagccaccctggaagaagctgctttgtttacccataacagcttatatttattgtgtgagacattgtccttcacagtttacatatataatgatgatatagtcttcaagagtatgaagtatagatactgttaacatctgttttcagataaggtgctggcacttagaaaagttaggtaacttttcaatcattccagatttcctaagacatagagccatggcgtaaatctgtgcacttgttttaaaataatacagctttattgagatgaaatttatataccatatagtttacttttttaaagtgtacaatttagtatattcagagtgaataataattataatactaattcatcattacaatcaattttagaatgtttttatcacccctgccccccaaaattgcttccactcgtttcccctattcactccccaacccagctctggacaaccactaatccactttctgtcccgacatttcattaaatggaagcaggcgatatgtggttctttatgactgacttatttcacttagtctattggtttttaaggttcaccaggttatagcatgtatcaatttctttttattgcagaaaaatattacattgtatggatataccacattttatttatttattcattagatgatggatattaatcaatgctcatttgaccacagctgtctgttatctgtctttctcatgactttggattaaattactactatagcaggtctctcataccttgcaatttcagcagctccgttgttcagcgctgctagttctctttcagcactaccgcagaggacagctccaagtttatggtttctgagtcccacaggcgcctctgattctgcctagctgagatcctcagagaggtataataaagcaagcaaatctgggtaggagcacagcgactttccctctgtctgcaggtatttagagctgattgtatcctcagaatactgtgtaaacggtatattttgtgtcacaatagattatcacctttggatttttcattttcaataggaattagattatggcatctttggttgagtgttatttagatttcctgtaaatctaggttacatataagtaggtaagatgcacagtgaaattcagtccatctatcttttgatgggttattcgaagtagtagtattaaggatcatttggtgaaattacttgttcattacattgtaatgggaagttagaagccaatatgtaagtagataatttcttttacaatatattttcttttcaagtttagatttatatgcttattaactttatccttcatatcaaattaaatttgttattgaatgccttatgtaataatcatgtagcttagttacaatgctcaatcttctgtcataaggtatatttgtatacttaagaatgaaattaattacacgttataaacatcacagtggaaaatattagttggattattaatctacaccatttacattctatgaaacatatttagggccagattctattagtacttttaaaaattttacatgatccttgacattgattatgattaaagacagaccaaagggaggaaaggggtgttatatcacttatgaggaagacacttaacatcttttcgcttgagttcacaacataatttagatgaaacactgttggccttggtaattaggaaaataataaaggcgaggagttggctttatcacattgtgtgaactgacccaacaataatgtgtcagaaatacagcatattcccagtttgtttgctcaacagaagcagataaacagaaggagctttctctaagccacatacattacaatggagacataaattacaatggagctttttccattgtaatttatgtctccattgtaatgtatgtggcttgggaccattgtctttgtaataatctggtaagattgtatcttttgaaaacatcaaatgtgttattttttcaaagtgatttggccaacggggaaattatgcagttatttatttatttattcataagccactaataagggcaaaactgagattctaaaatgattagaataataataagggtgttaaaaagtgatttttcacttcctatggcaagcagaattcacttataggtccatttccctggtgctgctatgacctttatattcattttatgctcagagctatcaattgttttcaaatgttgacacttgaaaaatcgctgtatgaatgatcatgtagttcccacagttattggtgctagaaatttctgattctactctggcctgggcagctgtcagcctagcatggcagtaagtagctttcttacctattagagaatgccctcagttcaaagaaaggagacatatgtgacaactgagagggttaattgttcctataaatgaattcattgaaaagtatttcacagcacacttgtttcaggcaagtctctgagaattattttatttattgtttttttggttgatcatgaccttttattgtgtttatttgcttaatattctgaatcaacctattgctgaatttctaagtaatgtactttattagttgctaaatttaacttatcctttcttatataccaatgatatagtttccaaatcttagattcttcttgaatagtactttctctttatgttgaccaattcatatactatactttgatgaaattatttttgtgaatcttctttttttctaaatgagatattcatgtatgataaacataacctttttaaagtacgcaagtcagtggtttgtagtatattctcagattgtgcagccattatcattattaaattccataatattttcaaaaccaaaggaaacccaggacccattagcagccactccatatttacctgtccatcaactcctaacaaccaccaatgtacaatctgcctgtatagatttgcctgttcaagaagtgtaacacaaatagagtaacattatatgtagagttttgtgtctgacttctttcagttagcatgacgttttaaaattaatccatgttatagcatgtatcagtacttcacttatttttatggctgagttatatttgattctatggatatacaacattttgtttattcattcatcatttgatggactttggggttgtttttattttttgtaattataaataatgttgctttgaatattgtgtacaaggttttgtgtggaatatgcttttattttgcttagatgtcctaggagtggaattgctgggtcatatggtaaagctatgatgaactttttgaagagtgataaatgaaactgtttaccaaagtgtttgcatcattttacattctcagcaacaatgcatgagggtttttatttcttcccattcttgtcagctctatatgttgctagatttgtggttgcttgttttttaactatagtcatctaagtgaatggaaagtgtttctcattgtggatttgatttgcatgtctctaattgctaatgatttgagcatctttcatgtacttgttggacagttgtgtatcatctttggataaatgtctgttcaaatttttgtctattttttaactgggtcttttttcaatatttaattataagagttcttgatatattctggatatattttggctatgtagtctaagtcgtcagacattgttttttttcaggatgtttcagttacttggagcgtcttgaatttccatatgaatataaggaccatctttataatttctgcaatacaacaaccttaaacttttacaaggattacatagaatctgtaaatcaatttggaggtattgcaatcttaacactagtaaatattccattccatgaacacgggatgtcttcccatttatttaggtctttttaaaatttctttcaatgatgttgtctagttttcagtgtacacatctttaatatactgattttattaaatttgttcctaagtattttattatttttgatattttaaatgaaatttttttatttcatgtttgaattgctcattgctagtgtatagaaataaaacttatatttatatattgaacttgtatcctagaattttgcttgaacttgtttattaaatctaaaattttctgtggattccataggattttctatgtagaagaaattgagatagttttgttcattccttccaatctaggcacattttattttattttatttttcctaattgtcctagttaggacctccactacaattgaattgaaatagcaaggccgggcgcagtggctcacgcctgtaatcccagcactttgggaggctgaggcgggcagaccacaaggtcaggagatgaagaccatcctggctaacacggtgaaaccccgtctctactaaaaatacaaaaatgtagccgggcgtggtggcgggcgcctgtagtcccagctactggggaggctggggcaggagaatggcgtgaacccgggaggcggagcttgcagtgggccgagattgtgccactgcactctagcctgggcgacagagcaagactccatctcaaaaaaaaaaaaaaaaatagcaagacaaccattcttgtcttctttttgatctcacgggaaaagctttcatcttttactgataagtatgatgttagctgtgagatgcccatttctgcaggtgcccttttttaggtttaggatcttccttccaaggattttcctttctagttccttgagtgtttttttatcatggaagagtgttgcattttttaaatactttttatgcatgtatcaaatgatcatgtggcttttgttctttattgtattaatatggtgtgctacattgattgatttttatatgttgaattaatcttgctttacttgaataatctggtctatatcattgctttacttgaataatctgttgtggtcataattctttttatctgttgctagatttggtttcttgaaaatttttgtgtctatcttcataaggagtattaatttgtagctttcttatgatgttcttgtctggtttgggtatcatggtaataatgggcttatgtaatgagcctggaagtgtttctttgtcttctagtttttgaagaatttcaataaacattttgtggaatgtaccggtgaagccttctgctcatggacttttttatgagaagtttcttgattactaatttatttactttccttgacacagggttattcagattttctgtttcttcttgaataaatttcagtagtttttgtctttctaggaatttttctatttttgtctaaattatctaatttgttgataacgtagtggtttatagtaattgccttataatcctttttattaaaatatctgtaaattctgttgttatccccccttttattctcaattttaggattttgaattttctcaattgttttgtcagtctagctaaagttgtgtcaattttatttacattttctaagacccaatttttgttccattgatttttttctgttgttttttgtttgcaattccctttatattttactccagtctttattattttctcccttctgttgctcttcttttccagggtttcaaggtggaaagttaagttattgattttaaatttttattctttttaaatatacgcattcaaagctttacattttctttgaagcacagctttagcttcatcttttaagttttggcatattctgttatcattttcatgcatctcaaagtctgaaagtaatttcccttttgatttttttcttgaccccttggttatttatggataagttatttattttccacatatttacaaatttcccaaatttgcttttagttttgattgctaatttaattttattgtggtcagagaacgttttatgattttattccttttaaactcattgaagtttgttgtatcattttttatattatttataaaaccgttaatatttcaatatctctaaaatgtaggaaaaatgtatataaaatatagtctgtagatcttttacagtctaagttgaaaaatgttttcaatgcacttaagaagaatgtgtattctactgtttggagtggagtgttctatacctgtttgctggtctagtttgtttatggtgttaaatcttctggatcctttttgatcttctgtctgattttctttccactatttaaagaaggattttgaagcttttcaactattattgttgaattttctatttcttctttcatttctatcagtttcccttcctctattttgagtctttgttttttaggtgcgtgtaagtttataggtattattttttactggcagattgacccttttctcattataaaatctgttcatctgtactaaaatttttggcttaaagtattgaagtgtgatattagtaatgctgttccagctctttttttggttactgtttgcatatgtccttttctgtcttttaactttcagcctgtttttgtctttgaacctaaaatatttcagttgtagacaatatatagttagatcatgtgttttttaaaagccagtgtataaatatctaccttttaattacagcgcttaatatatttatatttgctataattacaaagtaatattgatgcctgtgtttcctacttgttttttatatgacttatttctttttgtttgcgactcttgtttcttccccatttccatcaacatccctgcagtccaggccttcacatggcagggaaatgacagatgtattataccctgtttaggtaattgttgccatttcagaatggagtcccagtgatgcttggtcttttaatatatgagtggaaatcagaatttttaagtttttggaacacttcaatattttaatgttgacaactaatagagtttttaaaaaatacattagacatagtttgtggaacaagcaagttatgtctaatgagcacatggaatcaaagagaaaccatttgccacctctgttttccacatgtggaaagtctcaggaccagctcaattctggcatgcttgctttcatatatgttgtttactgatacttacataaatatttcctatctgtaaaatagtgggaaatagaaatagtaaaagcttacttgtattaaatactttatggtatgctggtgatgtttatgtccctacctctttttatatcaacttattttagttttcaggtggaatatgttcaaattttatcagactccaatcaaatactgcagtagtttctaagtcttagagctgttggtaccagatggatggatggatgaatttgtgttctcatgattgagacattacgataaggggaaagagtattacagcaacagacaaatgacttggctttagccctcaactaatttattgggtgcttttcaagtttcctactcttataaacttcagttttctcttctataaaatgaaaagattagccttgatcatttttaaagtcccccaggctaacattggctatgactgacactgtggagctatgggatctgcatgagaaatttttctcagtcagtacagcatgcacaagggagaatggctttattttatgtcacaatgcagaatgtctgttgtttgctatccctaaaagtgatgtcctctatgatttacaaagcctatggagacatttgcagcataagggaccgccttcccactttttcacctcagcacatgctacctcatcacactttctccttatttttagttttatgccatcatctgcaggtaatgtttgacctaaaacctacaccattacttgttcccttttaaaaatggcttcacttgtaccccaatggcatatcgagcacctgtgagacttcaggtgttgtttgatagtttaactaaaattaccatgattatctgtgtatatgaaaggcttttaaccctccactacctaaaactcactcgttctgtgctctcacttgttttctattataatacagaaataaaaggattgcatttgaatactgaaaaattgtcttactgccagtgcttgagtgcacaaatccggttaactctcaaatgatagctattcaacctgtctttcaaagcagtagatgtgttttgaaaatttcacatttgatttataaacaaaaagactcccttgactttatcctcctgttttccagacttttttattttttaagaatgaaaaataacagctaaggaatgtggcctggaatgaaaatatccgaatcagaagcaaacagaataaaaacacacctacctttccccctgaaataacattaatgtcttattggatctgacaaaattcaatgaatttctaattaaagactgtttccccactcctgattcaacctgtcctgcctagcagtagtagcaagaatgagtcatagtctcttcagaaagtaaagcattgcagattgagttaatgatgaatttttcccccttgatttgaaatactcttgcctctgtctttccgtcaaccctagaatagtaccttgatttgtaattttatattgattttaatttgcttcattatttttcttgtagccattaaaaatatatcaaacagaatcatacttgacaagaagcataaagaaaccttccactgatactggaactgttgggttttctttctactgaagcttttaatgattctttgccaatctactttttaatcatctgaagtaaaagtagtataaagcgtgttacttgaagcattcttgacagagaatgcagctgtgcacctgtgagaacaaataactgatgttccttttggtcactcagcaggaatagcattttaataggtttcttcactgatccggcatgctaagagtagtttgtagtgtgcatttaatctactgtctgtataggtagctcattatgtcaaggaaaggcttatgcacatttataatactttgtaaactgtatgattagatcattatttagaaaattgcttgtatgggaaatggttgaatagaaacatgttttccaagcaattacgtttccttcttaaaactctttgtccttcatttaaagataaacagaacttcttaggtaacccttagatattttcctgagttatagagttttggaggattcttaaggatgtgtatctgacatattgtaagcacgtaataaatatttattaaatggatgaatgaaactaattaagaaaaaagtgagagtttttttttgatacgataaaacttttttttaagataaaaatggcactttgggaggttaaggcggcaggatcactgagcccaggagttcaagatcagcctgagtaacatagtgggaccttgtctctacaaaaaataaattagccaggtatagtggtgcacacctcgtgaggccaaacatattgctatgaccagtggaataccagtggaaagaacatgaatcacaacaggatggcaggttttaaaaccagttgctaggtctccttttattaatgttgtggagatttcagaaatgtttattaatattaaatagttttcatcctcctgaataattagggcaatcaaacactgccaaccaacatttgacatacagcataaaagtcaagtaaattgcatttatttttgctgttaatattggactatcactaagcaaatcttgctggtgtaaacttcttagtcattggccagtttgttacaaagatctatgaaaaattcttatcccagtgagccaggagaaacttctcccaggagatcctgaaatctaaagtaggaacacatgcctctctatgtgacatccattgtgacacagatggtttggtcctttccaataataaaaaaaatggtgcgttttggaatacttgtgctttttgaaactataaatcacattatgagtataaagaacacagcttttgaaaaaaataaacttttttttccaaatgttggagaaaccagtgtttccagttgattgacctaagatgggtgttttaggcccttttggatttttaaactgtttttacgtgtatgtttctgtgtgtttgtgtggtggcttgtatttatggatgtgtgctgttcgttgctatgataggaaataacattgaaaactggagttatatgttattaagaacataacaaaaataaaaacactgtgtgaaaatctgtgagttaggatcaaaaattttatcttcaggcaaatatatatagccttaaaaaagttatcacatgacatattgtaaataaaatgaagtaatgttcaacttgaaaagttagaaaagacaataaaactattggagtaagtaaaataattaaaagatgattaaataatgatcaagaaatagaaacaaaaaatagaaaacaacagaaaatagattagatagatccaagaactattacttaaaagcaagacgtacataaactgtttaaacgtcttgtacagaaaaacaaaaatatagtcattataagaaggggttatatcaatactgaagggattaaaaatattaaggaaaatggataatatttttatcaatgcaaattatataaattaactcatgtttaaaaacattaataaacaagataacctaggaaaagaaaccctgaaaagttgtcatttttacctccaaaaaaatgcagtgtgctgtcatcttaatggataaaccactttaaattattaacagataagcaattttatggtaaaaaaattgattcagaaatagaggaaaaactgaaaagtgtcctttaccaagcagcataattttaaacacctgaaacagaatctgacgctcagaataaatatcagggccggaggtggggtggtgattctgaaacccctgttagccattagccatgctcatacagtcactcccaactatatgtttgatatactttcttaaccattcctgactgaaaaacactatagagtaacaaaaataattagtagtgtagtaatagattgatactttatatgacgcaaacctaagacaatatagtacttaaggagaaagcatttcaggcatacccaccaaataccccccaaaataaaggatgcttcccttatactttgtttaacttagtgattcttaaagtttttctgtctagtaagagatgaaaaaggaataactgtaaaattggaaaagcatataaagttatttctgcctataagaaatatgattatgcccttatttatacctatgaatctgaaaactttaaactaaaaatacatgttttataacaccttttaaaatgtactgtttttatttaatttcagttttcttgtcaaaaacaaacaagagtgtacaattaaaattgataacaacaaagtataaaattcatatgaattgacttaacaagagatgtccaattcttatgtgacagaagccataataatttgccaaagaacatgaagtttcaataaaatgggaaggttaaatatgatacagaatttagtttcatgcacacacatacatatgtatatatattagaattctaaaattatcctgaagtacaactggaggaataatattcaagggtagccaagggagtttcgaaaataactaaaaaaattttttaatgaaatgtttatataatattagatggattagacaaatgaaaaggtcaagaaactgacctacatacatattagaagtgaatttctgttgaggttggcatttcggtgaagctgtataaatgtggattatatgagcatgatgtgataataggtgaaagggtagggcaaatcattatctccctgtatatcagatgaaactcagatttattaaggaataaatgttaaatatataattacaacagaatccaaacaaacaaggtaactatatgatttggggataaggtgagcctttctttaaaaaaaaggataaaatgagatatctatcgatttaatactgtagtaatttgatacaaatgtaaaagaaatacaattacaattattaacaaaatgagaaaaaatttgcaaatcttaaacggaaaaaaattgcgatatctctaaatctaataagcaaatgacatatcaattaagcagcaaaatatgaacaatcaattttgaagaataagaaatacagagagcttcttaacagcttcagtgttaatcaatgaactgttcatttaagttattatatcatgtttcaggtatcaaattggtaaacaggaaaaagaaaaattaatgcccactgtttcagaggttttcaataaacatgttattttatatttcctaagagtttttaatttaaataataaaatccactgaaatgtacatcaaaaagaaacatgcatacaaaaacaaaaggagctttattggaaatgtataggacagttcacagaattaaaagaattagctatgaacagctatgtagaaggaatttgaaagttagtcaatatcattgagcataaatcagctccattttttttttgcacgctataataagtaacttctcttgaaatgagaatttctagtagagaaagtgaccaattgatttaacttaggtaatttttgccacttgtatgaattaaggtgaaaactttagacgggctgtcttgttgacactcatccaacatgtattcatcagtttcccaaacgagaagtgggatgctgttatctgaagtaaagagaggcacttggtaggcgaaaacagtggatatccagcttggttattaataaggatgttaacagtattattttttttaatggtgggcttacgagatttctatttttctatttatgctttttgcttttttctatttttttcctcagaaataagactgttataatcagaagtaaaaaggttactgaaatatgtaactggagaatatgttgagacaccctgaactggcccatttttagccaattcatttttttaatgtgctagataaatttatgcgtcctagaatcagaaggctttgaatcaatcaagttctggttttaccagtaatgaacattagtaagacatttaactagtgttgagtcttggagctattaactagaaattatgaattatgttactatctatataaaacttttaaaaatttggcttaaaaaattacatccacatgtttaatatatttataaggcagaattccttgaacatatatatgacctttgatgaatgtttgttgaatattttcagagtttcttaatgccaatcccaaatatcacttagtcaaaaacttatttatcttgagacttctaacttctggtattatttggttatattgttaccgtttcttcactgaaaaaaatgtcacctcccaaatgtctcatccttgtgttttatttgattttgaagatgtgggtcatcttttatgatgaacacaggttctatttttatatcataatctcatgatgattatggtgaaatgaacaaattaataaatggaaataacagtagaatatttggtggattgttaatagatattaagtactctagcagatagagtcttttattttatttgatctctatatattaattcatctgtctgacaataaaatgtgtttttaaagacatgctttatcaagatgtatttgaggcatttccccccactgatctattgtacttaaaaatttttgaaagctcaaattacactaaatgactgcagaaaaagtcccaaatagtaagttgccaatttgaaacttttattagtctcaattagttaatttattgaactaatttaaatagatcaataaattaaggtttataaagaatattcgggcagtctttttcttaagagaatcctgcaagactgaggcataagatacagtctgttgatgtttttatccctttcatttatccaaacagtgtaaaacattgcttatcacattggtatgacttacaggattcaacagaacacttagtcttttgtcttcattttccccattgctttgtatttctttagatttaagttataattaacttgaatattaatcttagatggcatgatttgatatgttaaaacgaagagtttaagacgccgagctctgtggttctcgccttagtaatgtacacattacagttgccagttgacaggtttcatttatccatggttttctttaaaatgcctattgatgcaaacctttttaataagtaactcaaaaggaaaaacacacaccaattaagttgacagtgatcccatatatttcttcctctaatttcccttttgtgacttcattttccttcccccatgccttcctttctttctacatacatgcacactatcaccattctagtggcccctgcctttaggcaccatgtttaagctctcagacctctcttaaatacttgtaacactatcaatactacctattttgttagcataattgtatggactacatggcaaatatttctgaagcacactgtaaatgtctgtataaatgcaaggattagcgttgcccgctgaatctagacctgatggattatcataaagaagacaagtttgcatatctgaattcaattaacagtggtacttgtttgtgatggagttggggtttcatttaactcaatctcattaatttatgcaaggaccaaatttgtttagtgtagtttatttgttagaagaagctagcgggcagaggattcatcaaaataataaccaaaacactcagaaaaatcaatagctacttttcaactcctgatctttgtcctcacccagagtgagttctaagcaaaattgtgcaggttatcattcctggatttcgcgctccctctcacacacaaatcctgaagagcattatcatacccattggttcgttgtgcagtggatcaccgaggcatttctttatgtgtactctttggcctaccattccgttctaatggacagtcatagttcatagtgagtttgaagtctttcttctagttaatctgtcaatttttctcacacagtgcagctgctgtgaaagaaattggagctgttacactttgtgctttggtacagtttgtaaaatgctaggtaggagacaggaaaccaaacacagcatgctactaatttctttaaaacgactgatgtgctagaactcagagtctgtgtcccagagagctggcatccctttttttctgagaagactaacgtcgtttgaaagtgttatcttacttttgcatcaacgatatagatgcctttggtatgacttacaggattcaacagaacacttagtcttttgtctgcattttccccattgctttgtatttctttagatttaagttataattaacttgaatattaatcttagatggcatgatttgatatgttaaaacgaagagtttaagacgccgagctctgtggttctcgcctgtagttccagctacttggaaggctgaggcagcaggactgcttgggcccatgatattgaggccacagtgtgtgatgattgcaactgtgaataacttctctagcctgggcagggtaacgagaacttgtccctaaaaaaaaaaaaaaaaagagtatgtgtatattgatatgtaatcatgtgactagacccttcactgtatactatataggaaaagatatataatatgctagaaaaacacactataagaactgttcttaccagaaagtaagcttattccagaagaggttggccctgtctccatcaggaattgtcagaattacagggatatagcaaagtgttctttttgacacatcaggattcctttctcttgaatgaaatgactatattcttcttcattgaagcatttgtataattaatcaagatgtttgtatattactctcctcctaacatgtgagagctgcaggtattttaaatgagaatgcttcaggatgtgtagtactgtctctgtgtgcagatttactttttattttatacgtctggtttttttgtgtgtatgcatgtgtgttgtgttgtgtgttttcagacagggtctcccactgtcacccaggccagagtgcagtggagctcactccaccctccacctcctgggctcaagggatcctcctgcctcctcctcccaagtatctgggactgcatgtgcatgccactatgcctggctattattattattttttaatgtagagataaagtcttgctatgttgccaaggtttgtcttgaatgtctaagctcaagcagtcctccccacttggccgcccaagttggggataaccccacttgggataatccccaaaacgcccaaggttttgggattatagatgtgagtcactgcacctagctgtttattttacggaggggccagttaactaattccctcttctaataaaattgttttgtaaatccaaatttgttcttgcctgttactactatttagaattttgcaattttattatacctagtcaaaagaaggaaggacgattcaaaaggaagaggaaagaaaattaatattaatcaatatatatcaaatgcatactaggcttttagcatcatctcaaatattttatatatattatttaacattcacaagtaccacataagataaatattacagttatgattttacacatctgtaatatccagagatattcaagaatcatagccagtaagttggatgaacattgcctaaaaaacacatttttaaaatctgaaagccagaacacttaacccttgaacaacgttagctgcatgaatccactaatacccacattttttaaaataaaagttacaccaagggtgcctgcctttcctgcctcgccttccatctctttcacctctgtcaccccagagacagcagaactaatccctcctcttcctcatcctcttcagcctactcaacttgaagatgatgagggtgaagacctttgtgatgatccacttccacctaatgaaaagtaaatgtttcctctttcttatgattttcttaataacatttctttagcttactttactgtaagaataatgcatataagatacaaaatatgtgttgactgtttatgttatcggtaagacttttggtgaatagttggctattaaagttttggaacagtcaaaattaaacaccgatttttgacttcatgggggttggtacccctaccctcctcgttgttcaaggggcaactgtatattctttttggtgtatatagagaccctgtaaaagagaattaaactttttcaagtccctcatttgtaatagtaatacatgtatagcctttaacaattttaaagcgtgctcttaaagaacattttctttgcccatcataataaatgcttatattaggcattattacctccgttttacttgttaaaaatcctggacttctacaatctgtcagagttggagaatcaaaggagaaagtgccttagcaaagagaatatagctgaaacaagaatcaatcaggctgttggggatataattctggaatgaaaattagactgaatttgttcttaagcatctttgttgtttgagctctttgttttctcatgtttagaatgagaagtggggggatttaattacgtttagtgacctttcaagctctaaaatgttttgctacttgaaagtgtacttagatgtgttaatgttatatacagaaagaaactgactgaagctacttaataaaaagtaatcaagatgaattataacagaaatagtaatataagataggaaatcctgaactaatattaggttatgtgcctaaatttgtgatttttatttaaacctggccttaatatttggcttcatttacctttcccttttaacctcagcgtcccaccttaacatagaatcaatctatgctatttgctatgtatcccaggtggataactgttcttgtagttgaccttcataatgtaactttattggtatagttaaggttaatggcacattaattttctataagacatcagtcagtatcccattttaatttaccattttcatgatgactgctgttctaagttgtttgtgtcatttttggctgccataaattatcccgaagcaaatatcaatgtgaactcagaaccatgcatgctgatgacttctgaaattattaatgccagtacataggaaaaagaaatacatgagtgcacatttggttgataatttctttatagattaccattaacctctttctttaagggaacagcataagtacatctgtgtttatttgctctaagggaaacaacagttataattaggaataattataacagcagcagtgaaactctaaaaaatatcctggaattactatcattcctaaaatatttttatttcagtggaaacagccaccattaggatctcatgggagagttcaaagagaaatgatagattatttcagatagacccttgttgggtggctgaattctcagagtggaaatagcagataatttgggctctgttcaaagcagtctgaagaagctctgtcctatagctctgaagggacccattttaattcacagagcacattaattgttatcccccttataaacatgtctttgtttgaagcattatctcaattgtgaaatgtggcttagaacaattctagatagtatagtggtaaaaaacttcaactcaggagtcacatagatatgggttcaaatctcatctccaccatttattagccatgtacccccatgaaaattattttaaacttttagtttccttagctttaaatggaaataataaggctgtccccacagaactgtcctgagggttaaagaatctttccagagtgacctgtacttagtaaatagctcccaaaattgtggaattctgtagctgtttaaatgagaagagatttttattaagaggtttccaaatttgtcctctttagcatgccattattgtcactttcaatcacttgggttttcagtactattattttattattttttcttcatatcagctttaaatttattctcttttcatacttagtcttgtcaaagccagattgtctcggaggtcttgatgttagacgacctagtatctcaggtttctctttgtaaaacaattgaattaatacatggatgtggttaggaaagtcatttgtggtcacataaacttcagaatcctttatgtccagttcttctctgtcacttgggtattcctgttataagagagaaaggagtcatatttagtgacatgatttgaccttcatttttacttaacctttggtaagtaacagtgagctgcttcaaaatatagtagtatttgtgtattaaaaacccacattcatgatccttaatataaaccaggcactgtgggaaaccacaaacagaggaaagaacattaccaacacctgtagttatttattttatgtgctttggaaaataagttaaatgccctcaggagcagtgttcatacatgaaaaaattctctacttatgccacaaggtcacataggattgtctgtatgataaagtatacattagattactctatctattttgtaacactttatagctgtaaggttgtatttttaaacgagcaaaaatgaatcaaaatttaatttgaaagcagggactcaaacagatacttctgtatcaatgttcacagcagcattacttaaaatagccaaaaggtagaaacaacccacatgtccatcaatgtgtgaatggataaacaaaacatggtgtaaacataggacggaattttattcagccttaaagaggaatgaaattctgatacttgctacaacatggacgcaccttgaaaacactaactgactgaaataagcaagacacaaaaggatgaataactatatcaaatatcacatgtaaggcacccagagtagttaaattcagcaagacagaaggcataatagtggttagcaggggctggggagttatttttttaatgggtacagattttctattggggatcatgtaaaagtgttggaaatggataatggcaatggtgacacaatcttgtgaatgtacttaatgccactgaattgtacacttaaaagtggctaaaatgcagactttacattatgttagctctccacaataaaatgtatactgaattttaaaaagtgaacagaaacttagaaactaaaatactaagcatctaattatctgaaatatgctgttaagtgtctttttcttttattgagcaactagctgtgtgtatttaatattctaagatctttaaaatagaggaaaagttgctcttttcctatttaacattctaagatctttaaaatagaggaaaagttgctgtctcagattggtggatttcacattgatggaatactggaggattaccgaagttcactttcctgggggctctagttcatgtctgactcctgtcatataggcccaaaattgccatctcagctacacagagcctcagcttgataagcaaaggtatttttcttgcaagagctctcttgcctctggagagactgatctggaatgactgtcaataacaacaaccatatacctgaagaatcggtctcttccattttaatttcatagacatgcaccgctggaactatgattattacaggatgaagtctcctataggaaagccggctgagctaacaaaatcaagccccattagtctgtccctggagcacaaactctaaatggccaggggagggaaagtcacacaggagagggcaagtgattggaaattgtagaaaatgggagaacgttgttgcgtgccatggtctcatggagattcatggaacctggtaaattaaagtgcacatccgtcccttaaattgtcatgctgcttcaagtttacttaacttttgtacagacttttacagacttttagaagtatttgtacagacttttagaagtctctccttcttccattgcttgtagctcttagatttaaatgatcacctgttcttttttgtagtcaagttgggatgtgcccccaaacacgtaacatgttttgaaactaaacaaatatccaccattaaattaagtttctttgatgctttcttttttcctggcagaatttggtcaaagcaactatttcattgcaaccctgacttgaataaacaagtacatgcatgctcatatagctgtgtatactcatgtgggctgctttagtgccttgactcaaatttacattactttcaagtataaacaatacaatactaatacaaacaattttgggagacagtaaagtttagtactgggctctataatatgcttgtgtgtttttggaaatctgtaccgtgcattggcaatccagagagtgctggtggagacaggactaacacaatggttcccaactaaggttattcctagagaagggcttctcaacttcaacactgttcacattttgggctagataaatcttggttatggggagctctcctgttcattataggatatttatcagcactcctggcctctactattagatgccagtaacatctgttctcctctagccatggcaattaaaaatgtctccagatattgtctagtgtcctctggcggggagggggcaagaagagcagtttagagcatggcatgaaatcccaggggcagggtgttgggctaattcaaagaggcttagggttttgaagcagtgagtggtgagaggagaagaatgatagaagaaataactggatgtgtctgcagcattttcttcccatggcattgcttcttgtaagatacacacgcacactcacactcatacttttgttctacataacatatatattgtgtagtatgaagtttatgagttataacactgtcgtcagagttatacctttatcctatatccagaagcataagacggtaacttaaaatctgactgttttatctaaaaatgtgctttcttttgggtattgtcaggactcttggtttcagttttaatttctataaatccagagatttgaacaattcccctgctagcttctgtttctctttgtgtcccagatctgtttccctccatctatagccaggacaggagtaacttgattctgagaaccctgagcctaccccaaaaggtaaaggaatcacctttccctatgtccacagattaaaatgagaaaaacatttttgggtttgcttgagtcttaagtgttcttctgacctaggcacttctccagggggctggacaagcctggctcatctaatttctaccctcccctagcccccaactttccaacctcgcaaacaatcataaggagtgctccccccacctcaaaagcagagatgctttatttagtactctgaagacaaaatgaagctgcaatttctttttgaaaatcttccccccagtttttcattcccttattttcagtgagatattcatcctctactttaaatgtacattctcttatagtagttctcaaagtctggtcgaggaaacctgaaggggtagtgaaaactttcaaatggatgtcagatcaaagctatttttgtaataatactaagaaggtatttgcctttgtcactctcagtctctcacaagcatacagtggagttttccagaggctgcgtgacatttgatgtcacataagagcgaatgcagaagcaaataggaggatccatttgtctatgattaagccagacattaaagagagatttacaaaaatgtagaacatgctatcctcctcattattttttgctttatataatattttcccattgaacatgctatttatgttaatatgtaatagacttactgttattttatgaattgaaaagtattttagaagtttccattttaatttctaatgtagtaaatatcaataaacctaatccattaattaaaactctttagcattctccctaattttaagaacgccttttgtttttatggtcttacttgaatacctgagtcttcatcaagttcttgccacgatggcttttagaactccaacatttccagcccggtgaaagccacagaatcttttcagctcaagccctccagtggatgttcacaattaaaaatttcccattttttcctgtatttagatgtctctttgctgtacaacaaggaacttaccagcggtcactacacatactggattataggcaagatagccatttaagggtagcgaaaaatgtaagaatttttatttatatattttatgtgatttgaaacgattgtgatttatatttcattatgtatataacatcagtaatagagtacatatgtgtactttagaaataaaaatacctaattagaggtgtatgctttattttctaatagaaatatgctatcaacaaaagtgatacttatcctataatatttgagcctgttttggggaaaattataacttgatacagagtgaaaagaataaatatttcttttagaggatgtgatggttaattttatggttcagtttgactgggccacagagtgcccaaatatttgatcacattattagtctgggtatttctgtgaggatgtttctggatgaaattaacatttgaattagtagatggaataaagcaggttgctttcccaaatgtgggtgggccttatgcaatcagctgaaggcctgaatagaacaaaatagtgaccttcccctaggaagagagaatttccctgtccctactacctttgaactgggacattggcttttttcctgcattcagattgaaactgaaacattggctcatcctaggtctcacacctgtcagccttcagactggaaatacagcatctcacgtctactgggcctcaggcctttgaacttggactggaaatagactgtcagctctcctgggcctctaacttgctgactcaccctgcagattttgggacttgtcagcctccttaattgtgtgagccaattccttctaataaatttacacacacacacacacacacacacacacacacacacacacacaatcttactgattctgtttctctggagaactctgctacaggagattacacaaactgtaaaggaaatatactatcgcataaattaagcaatgatctctataacttcttcagtctgagaactcattccttctggtcactggatgccttacaaggacagaatagggaaataggttttacttgaagcaagaataggaatggctgtaactgtttttgaattagtactgtctgtgagcccctgggcaatgaaggtattattgtctccattttacaaacgcagaaatcaaagctaagaaagaatactttgcccagggtcctacagaagtaaataaagtagctagaatttgagccagcctttttctaactccgaggcctatcctcttactagttgactatccataaatcaattttctacctataaagcttccttggacttgagtatccataaaacaacttcccacctacaaagatgtaggtaggaaagataattttcaaagtgttttaaatgtagcattgcctaccctggagttcagttaagccacaactgatctgtggtaatttggggaaatttcatcaagttggtctagaattacagactcctgggaatagatgtgtgtgtgtgtgtgtgtttgtgtgtgtgtgtgtctataaagtgccaagcttattttccaaaaggataaaggtatttcccagtgagtaggaaatgtttgcattcttcatgtatttgtgcatggatttccaaattgatggattttgcttcaaaattagtcaagaaatcaatcctggaagttattgtgtgtgtagctcaattcagtaaagtggcaaaatattatttatttcatcctccttatgctatttagtttccatctcattcctcatggtaatggagaaatagtctatgatattgtaaacacatatggatctttaagatttattttatatttgttttagcgttcaggaggcacttggcttttgcatctctccctctttaggaaagaaaaccaggtcatgccttatattttatatatgttttacatgtatttcctttcaaaaatgtgtcatggtatacttagtccttccctttaaagaaaaccataatgcagatctcattaaggaacataaatagtgatacatatatatggaaaaggacacacattctttagtgcagtggtgggaactagtgatcttcctccaaatgccagaataaatagatgttcctagcaaaaagcagggactatatttggaacctcccctattctggagttccagatctgattactcatgtagaatctcctgtttcatatataggtgacagtgttcaggactcattaccccaaaacatggcatcttagcatttgaggaaacagccaaagcagaccatacaaactagaaagaattcccctcaccccttccccactgaagtaggtcataagaccctcatctggaggagtcctgacttatacccagaggaaagcaatatcacacatggttgccaagaagaatttgaacaaacagaatttgctaagttcttcctggtttattactgttatattatacccttttgtcttccaatcatacttctgcacggctgtccattaaaaatacacagttttggccgggcgtggtaatcccagcactttgggaggccgaggcgggcggatcacggggtcaggagatcgagaccatcctggctaacacggtgaaaccccgtctctactaaaaatacaaaaaaattagccgggcgtggtggcgggcgcctgtagtcccagctactcgggaggctgaggcaggagaatggcgggaacccgggaggcggagcttgcggtgagccaagatggcgccaccgccctccagcctgggcgacagagcgagactccgtctcaaaaaataaaaaaataaaaaacacagttttccccaggtctttaattatgcatttctgaataatctcgcatcatgtaaaacttacgttaaattaattgtatgcatttctcttattaatctatcttttgttgtaggggctttagccatgaacattgataggagttagaaatattttcttccttacacgtatacagttggccctccatatccttgggttccacatctgcggattcaaccaactgcggatcaataatgtttggaaaaaaaaaacaataaaaaataacaaaaatgttaaaatacagtataaaatctatttacatagcattttcattgtattaggtgttataagtaatctagagatgatttaaaatatactggagggtgtgcaggagtcacatgtaaatacgacatcactttatataagggaccccagcatctgcagggggttctggaaccaatcccatgtggataccaagggacgactgcattctccaaatcctgggcatgggcataccatatttcttaacatagctgcttaccatctctaatgttgtctatttaccattttctataaatctactgggttttaaactaatttttgatatgaagaaagtttatatcaatataaatagaagtaaaatttttcacaaatggaaaataataaaataaaaattttcacaaatggaaaattaacataaaaataaatttgcaaatatttacaagcgtaacataaatacacatcaacttaaactcaaatgtttacaaaataaaaataatactgtctaccagcagaagtgcaatgaccatattttttaaactatgatttctcctatatgtctatatttcatggctgaaattgtagttcagagctctcaccatcgtttctactacatacaaatcacttatgtcagtggaaatgttttctgccaagaagtgccaaattgtgagcctctcaggcctccagaccatgtttccttcacttctaaacgccattatgtcacccactgcatagttatctagtgcatataggataaacgctcaacgaagaaagccaggtcatgctttacaccttacattttgttttagacatattccttttcaaaaatatatccctgtgtaattaacccttctgtctttaaagcaaaggagttaagcactcaaatggcaatcaccaggaatgaggcccactacagtctaggagcaccagggcagtgcagtacaaaaaactcaagtagagaaaccagtgataactggggaaagttactttgactcacagaactttagttatcacatctataaaatgagataatacactctgccttattgaggcatttttttttattaaaaacagcctttgctttgtaccaggaaaaattaaaagcacttaataagcattaatttatgtagtcctcctaacagcccttatgaggctgtaaaggaacaaacaaacgtttctctctacttacactaaacatgccacactttttgaccagatgtgtgggttttgatttctgacacatccattttcaggtacatagttatgattccatttaattccgatgctgtctacctggagttacagtcagaacccacatgttaagagctcggtcccacgtgaatgccccctacttcagatgccagtcctaaatcgggctccccagaacttctggccaattgatataaattagagattcccatgaccgcctccttgggttcagccatttgctagagtggctcacagaacccaggaaagtgctttacttatatttactggtttataataaaggatattataaagaatacagatgaacagccagatggaagaaatgcataggaaaaggtatgtgcgaaggagcacagatcttccatccccaagcacctccacatgttgggcaacatggaagctctccagttgcagtcctttttggtttttatggcgacttcactatagaggcatgattgattaaaccattggccagtggtggttgagtcaaccttcagcccctcttccctcctgaggctatttaggagtcttgggccaccagtcattacccttctaaaagacttatcactttggagattccagggattttaggagttctgtgtcaagaaatgaagaagaaagaaatgaagaccaaatatatatttcttattctaaagcacaatatcacagaggaaaagagggtcagtatcttaattttataagggaggcatttataagacacagagaatctaagtaatttgtggaaggtcactcagctagaaagtgaagagctgggttttgaaaacccagattctggactcaatcattactctatgctgtatttcttcttagagtatatgaaattatccctgtgaaaatagttagactctggcattctatagctgttttctgtgacctgtgctctatattgtttttctttgcttcacagaaacgtaggtactgttttcccctaagttgttaattaatactcagataaggggcaagcacctctaggaaaaatcaaattataaatgtccagtacacttttatatcacatcacataatgtgacacattaaacagttgtggaatgtcaaaaattggcataatagatgacttgggaatgtagagtgacaagttttcatacaattgtgcctttttttgtgataatggtaaactctggaaaatttcattttctggttctgcagattgccagcacattgacatttcctgtatggtttcccaatgggaaggacagaattgtatttagccaaatctgataattttccttagttgaaattgaaggggctaaaatgcctacctacacttggatatgggcttcaattttttttgaagatacttattttccttctttgtttctaggatatagaggcagttcaggtagtttttcaggatactgcattgtagaagtaggcccttagtgaatcaagccattcatatacaagttgagtaagtgctcagagtaggtgtctatattaaggacagggtcctgtacattgtggggtgcttagcagttttgccatcatctgcccatgagatgacagtaacaaaccccatcttccctatgattatgacaaccaaaaatgtcttcagactttgccaacaaattacctttagatgtaatcactgatttagagcaatagaatttttggctctgtagggtaaatgaagtgcacctgatagcaataaatgacgcataccctgagaatgaccctgtatggcagatgcacctgaatgtgtgttccaagctaaggaactcgggaatggccaacagggagattcattccttgtctatgaggaacatctgaacctccagcctgtctattggaactcaggccacacaggggctcaagaccccgagttttgggttgaatgaaggttgccaggtggagactgtttgggaaagggtgctgagtgaaaatgctatataaactgcatgccctttgcaaatgattgtagttttcctgcccagtcccctgccgctgggctgcggagttatcttgtctagcccactgctactgggctgtttgtaaggcgattctcctgtccagcccaacaccactggcctttctccgtggtaagtaaagctccagtaaaatcccatgtcttgtttgctggccctgggtctctttttcagtctcttgaacctggtgccatcccctttagagtcgataggggttcagcgtgacaggctctttgttgtaaatatttgagattgatgatatctttgcacatattggaaaactttagatttcaggatagtaacttatgggccacaatgccaactacagctccggtaatgttacagtatgatggtttttaatgtgttccctggactagcattatcttttacaaataaaatcaaatcacatcactggctgaatgtttgagatgtattctcttctcattttaaggtttacgtaagtaatctctccaaataagtataatattaatagctgacagataaagagtcttttatatttacaggatgctttcaacttagtcttttctttaatttccccagtaactctgagaagagtttttattcacccatttgattagaaacagagacttaagaagagtaacttctgtctattctgagttagggagatcagaaaataccactgttctgagtagtattaggtgagaagagttttcttgctgattaaaatcctcaagtaaagctcttacatataagacttttatatataagaacaaaaaaccaaacaccgcatattgtcactcataggtgggaattgaacaatgagaacacatggacacaggaagggtaacatcacactctggggactgttgtggggtggggggagtggggaggggggagggatagctttaggagatatacctaatgctaaatgaggacttgatgggtgcagcacaccagcatggcacatgtatacatatgtaactaacctgcacattgtgcacatgtaccctaaaacttaaagtataataataaaataaaattaaaaaaaaataagactttttcctatcctcgagagcagtgtcaaaggctcatgactgtttttctcctgatctccaaattctaaaccatgtgctgcagtttcctatgttgatgtcactggttgttcaccctgggatgtcctatagactggagcatctgtctctatcctctccaatgagctgtcctaattatgttacatcaagacaacttgtgaagctcagaatctcaagtttctggccttacaactgatgagcagcataagccattcccactgctgttctcaatcccctccctgtcttagattcatagatccctaggctcttaagtgtcttccagaactgtttatcttgtagtcaagacccagaaattagacttccagaaacatagctcttcaaggcaggttcttcaaggtgatgatgcctgtgtcaccttgataggaaacctcctacactgtgtaatactgtcatctcagggagagccactgttcattagcttaaattgtcagctttatggttcagtgaaataaatacacattttccctaaggtaatgacttttttctcacttcgtgagagctgtagggacccttgttatcaagagataatcatattctagtggtgctacttattgtacccaatgaaagtcccaaggatgtgattatctcttaataactctaaagcctgttatgtatcatcttgtattttgtttactttgagtgtgtggtggggaacccattagtgatctctgtggttgatagtattcgttgtgaaatgataaaagaatcaaatgaccatttgtttgcttggagctagacagcacgattagaaatgcatcccaattctgactgaaaaatgcatttaaatgtaatctgttgcttagtattagtttaataaccctgatgttaatactaaattatatcaagcaaagctaatggaaattctgaaaataaacatggataatttagtatctacatgacctttacctcccacagaaaattcaggttgggttttaactacctgtgaaggaagtagatacccatgagaaataacctgctgattctgtgatggaaaatgccatcaataagttaagcaaaacaggagaaatataaggaaaagcctgttaaatacaatggcctttaagaatacggacagttgttaaatggtaactcttacctctcactttaggctatcctttgatattcaaataatgttaataataacaagtatcattaattgaatacctgctatagactggtttggcttgtctcattttatctattattgttattgagatggagtctcgctctgtcacccagggtggagtacagtggcaggatcttggctcattgcaacctctgcctcccaggttcaagcgattctcctgcctcagcctcccaagtagctgggattgcaggtgtgcgctaccacatctagctaattttttgtatttttagtagagatggggtttcatcatgttggccaggctggtcttgaacttcttacctcaagtgatctgcccccttcggccttccaaattgctgggattacagataggagccacggcacctggcccattttatcttttgaagaacctttcaaggtagataattttggccctgtcttacagatgataacaacaaactacaagaggttatataacttggttgagttcatgcagcaaataacgtggtaaagcttagactcaaatatgactttagaacctatattttgtccactgattatttaaaggcataatgtacagagtgactaagcgcaattataggagacttgtaatcaatggtgatcacatacacatttgttgttagacaaatccaggtctgactctaacaggcaaagtaaagagaccactctttggtccctcctaatgttatatgctatgtctgtgagaattgaaagctttagagatgccgcatctgggtttttgaacatgttcgttagaattattttcatgctcttacctgtcacttgggaagggttgtttttgttcttaataaataaccgacacaccttttggttttgaggtatttggaaagggtctagatcaggactgtttgttccctagggtaaaatcatcctttttgacctagaccttgccagctgctgcatctaactatttgctattagctgagaagctctgcagtcattcatggatttctggttcctttgttgtaaaattgcgagtacatttatgttgacagcagctgatttgttcaaagattggacccaatctttctgggcagagggagagtcgtctatttattcacctggttgtgtattaatttcctgcctattttcacatgtgattttatttagtttataataaaaactttaacttaggatagcgggtacaagttatggattgaacatggaaagtttagtgaatttttcatgattaaaaaaatgattataatgatagcatttattttctgcatagtatgaactgggcagtgttctcatggattacctcagtctagcctcaaaacaacagctaaaggtaggagtacattaggctcattttattcgaaaggaagctgagcttaaagaaggtgggtaaaatgaaaggtcttgccttgtgttcgcctctagggagagactattagccaatcaagtgcaatagattcagtttctttccccctgtaaagcagcacaaaagcggcccagaaaaaaattctgtgggttttttttttttttttttaaccttctttcaaggtatgaaattgggtatctacctacttgaatcatctctgttcatgctggctaacctaagatgggaagttttaactatgtctactttttcccctaacaagaatacagcaactgaacattttcccagtgaggtgtgaataaataattcctgcttatataatcagcaacttctcaacatcaactgaggtatcattagatattttcttttaagatcagttatgaaaatccactgtggaagtggaacttattttggcgtaacccttagtttataataactaagactatacgttggatccattcaatcattgagcatacatttaaggagcacctgttttagaccaggttgtactagactgtacaccttcagactgaagaataagacaacacaggtacatactttcccacagtaaaaggtatgtgtgttttggggtaagccgaacagtgataaatattttgtgatgagtggtatgctaaagacatgtgctgagtgtaactggagcacaagatccattacggtcctgagaggttatggttttgttaaaaggattatttcaaaagtaatattctcttactgttttagatacattttgatgatgtttgttgtttatttgggggggggaggtggcagagtagagtagtaattttattttgacagcaaatcccaggaggtcaggaatcttggtctgtttcttttctcctagtaaatactttttgaataaaaaaaattaatgtcaatgtaaaagctattggtctatgatagtaaaggaacagttgattatgattcatattcatgagccaggaatttttatatatggaatttccttacaaatttgtaggttgttagcattgtgacttatttgtattcattgctcacttatttgtctgcctcatttctacaggcacaaagccaggactttgtattactcacagaaaacttagcttcagtgggcttatgatttcttaactagtaaccatttagttgtaatatacagaaacttaaactagctcacataataagggttgttgaaaccatatgccaggcaaaatgatagtcttctaagcataaaaaaattatagctaaaacctaacctcatggggacttgacttaggaagtcaggaaatgtggctgcccctcaccttttaccctattttcagttcttcatttctcatgtggatcaggagtaaggatgtatgtaatcctaactctggttttctctaaagtcttatttttctggttctctcaagactggcttctttaacaataattccaactttacatgcctcaaactctcaagtgttgcaattcaaaatctctgagagagaatcttgttgacttaatgtgggtcaagtattaattgatggttcaatagctgtagcctattaggttgaatcacgtagaacatagggctggtcttttcaggagcaacaggtgggatgcattctttacaaaggagatattgtttcagaggccttcttggggtcagtcccatatattccccctcactcttcttacctttccatcctgctttctattctctttggcattgctctttgctccgtggtagctaactgacctgataaatgcattcatgatatgttagttcacccaacagataagttcttttggccaggattccctctggatgcaattacaaaaatcaaaggagtgaatttaataatgttttctataatgggcaagtatttgggaacatatgttttcttgtggtgctgatactgctttttgtgtgtacagtcaccatgcatgaaactatccataatgtatgagaatctcttgccaatgttactgctactagtggatactataactagtggctaaactgaatagctagtctgcattatgtaatttaattattaatttgaggattgaaataatcctttgaggatgaatactgttattgtccccactttaaaaatagaattgaggattatatcaattaaagaattgttcaagatcacatgattagtaataaattgaaccaatatcccatcccaagaaatttatcccggagcttatgttctcaaacaagaacaacataattattttaatgaataaaattaagttttcatttcaagtattattccactggatagggtaaatgtaatctctaccttctttctgtgaagaagaaaaaatatatatgacaaatttttagtaatatttgaaaaaacaaaaaactttgaccgatgtctgtaggattattataattttaattgttattgataggtaggctggagttgcaaatggtgccaatagctgtaaatagagctttagttttacatcagttgctgtccttaatgtaagaaagataggtgtttagatacatactaaacttttgtagctgactaatgtatatacagctggtaactgaccatattaaaaccaaacagatggtgatgtatttgtgattcagaattaatgtgaatatataatttttcataatccataggaaacattttcttacacatgtcatcatttatgaaattgtatttgttttaggggtatatgagaaaggtcagggattattttacatttctgaatatattagcaatatgaagaatacctgtttagtctctaccttctggttgttatcgatattatcctgagagtaaaggtagttaggtatttaatatagagatgaattattttgcaattcagccagagaaggcatacacttaagaaaagatcatgtttttatggctaatcaagaaactataacatttttatccaatcaattatgttatatttaagaataagccagagtagaatagtatgattaaagatatttctgattagctaatctatattatatatatctacataaaattttattttcagttattaaaactataagacagttattttacaaagaagtgatctatagcagaaacttggttagaggatacacatatgaataaacatgaaaacataaatatatacctttattctacgtaaaattaagtgtgtgtgtatttatatatatatttatagggaaaataaatttagttcttcagggaaaaatattgtgaggcaaaaattatttcacaattaaagtttaagtcggtagctttaagagaatgtacaatttatgtgaagagtgtttgtttttgttaggtaccctcattttatgtattcatatacctaacaaaaacgatgacgtctccatttattgctcaatttttattattttaaaatccttttaatgtaccctcttaagaaattgtctcttttattgaatctgaatgccataaaatattgcaggctcctagagccatcatactaacaagggaaagatagagtggtgatgaccttctcaaaagtcactcagctcatgggaggcaaggcggagaatggatcctggatcctaatctacacaattctattaagctggaaatctataccaaatgtatttaatttttactttgtcctaatccaatctgatttaattttagaccgggaagattacaggtaagcatcacctacccataagcctatctatgcttgaaaaaatgtatttatttgtgtattttttctttttattctaggaatcattgacatagagtaactccacagcatgtgtcttcaagagcttccctaaaaggtaagcttcccacaagggaagattttccttatgtgtagttcaccttgattagcatccttagtttctatggaaacattgaaaaccttcccttacagagtgatagcatgagattgtttttgatgtttttatgaatgttgaaattaatgaaagtagtgaagttacataaattaaagcctgaaactaagaaatagggactatttacatttctctctggagaagatacttaaggtaggttttctgtagtttagattaatttgataatccaaaaattttagaatttgtaatcatagaaagtgtatattgggaataaagttgttgtacttttgccaaatggtttcataggagaggatgttttagcagtcaaaccaacacaaatattaagttaacgcagtcctataaatactcagatcttaaaagttgaagcttttgaagggataaaacatgagaaatgtaactcactgtctacaatgtatgcaaattttttccttaataaaatatatagatgtaaaacagtaaaatggttatgttttactttcctgatgctgatccaataaagtaactggtggcttaaaacaatggaaacttattctctcacatttgtggaatctacaagtttgaaatgaaactctcagcaggaacatgctctctctttgaaggctcttaaggaggaatctctttgcttcctctagcttctggtggttgctggcaatgtttggtgttccttggcttcagatgcatcagtcaaatctctgcctctatcttcagttcacgtggctgtctcccctatgtgtgtccaaatattcttcttcttaggaagatagcagtcattgaattagggcccatgctaatctaatatgatcacatcttaacttgatttttatctgtaaagatcctttttaaaaagtcacattcacagattttggagattaggatttcaacagatcttttagggacatctaattcactcataacagtatgcctaaaaagagagtctagtgaaattaaagttaattattgttaacaatgtatttatgggaaaataatcataacatggagtggaggaaggtctcattccattggtatacataaaatgctgtttattttaatgatataataattatctcttgatggccagcttttctcccaagcaagataaaaattattcggtacagggtttgataacattgggtaaaatattagtatataattctgattctcagatttttaacaccctcagttaaaaaaaataataatcctggacatcagtgagaccctgtctctatgaaaaacaggaaaatttagccggatatggtggtgcatgcctgtagtcccactactgggaaagctgaagcgaaaggatcacttgggcctgggaggtcaaggctgcaacgagttgttattgcaccactgcactgtagcctgggtgacagagcaagaccttgtcataaattttatatatatatatatatatatatatagagagagagagagagagagagagagagagtcagaaatttatttcacttgattcttcaggtatttttcatgagctaaggttgagtaaggtgttttttaaccaactggctattgttctgtaacaaaccaccccaaaactcagtggctaaaaacagtaactttattatttcctatgagtctttgggatcagctgcttgggtcttctgatctggaacagactctgcagtattgactgggtatgctccttggtctgagcgcagctcacaggtcagtgcaagctgctccacaaggtccctctcctccagcaggaaccatctttcttaaggcagcaacattattccaagatactctgagtgtcctcaagcttgtttagatgtgctgtgttttcccttgcttttacttactctgttccttctccttggaatattctttctttccatctttttattccacttgaaaatgtatttcctttatgaatactgctctggtttctttgatcctattcattcatatatctttgtgtagctgaagatactgaactcatatccctgttagggtgaggcttccctcttgtgccaacatcagtgtaaacaatatgatattcacattgtcttgtaattgctagcttaattatcttaccctcccactgtgaacttctgaagccagtgattgcatcttcttgttcttcatggtattccaagaacctagcagtgcatgcacagatgatgtcttccataactatccatggacagaatgaaagatttaatgacatcttccctattctaattcctctcttaaaatttaagttgttgaaactttccagaatttggactgaaaggcaggaggtaggtttcctctcattttgatgatgccccttggactctactcaaagagggcccaggcaccctgtggtgccaccctggcctttcttcctctaccacagattgtaaaagttgtagtctgtgggacagaatatccccaaaacagttaatttgatttacataatagctctttttaacatagtaatttcaaaaataaaaataaagtttaacttgttgccagcacttaaaaatttggagattttacataaaatgattttttaaattctcctaaaagaaatcataataactttctatcctggacaatgcatttccagatgacaaagagggcttagctgaacaatagcagccttccagtgccctctccagttcgtcacaccatgccatttgctatcttctagccccagtagacacttgagtttaatatccttagctacccaaagatacatggattgatacagtgtggaggcttagctttgcttctaaatgtctgaacaaagaagtgtcagtggttgaatgggccatttagatgttcttattatatatccatcaactaagtaaaaataattttggctttgttttcaaagctctgtacttgaattcctgcatgtaatatttgaacagataatctctctgacctcttttttttacacatctgtaaaatggagactgtgatattcttcataggcttgggtcatgttaggttactttattaatgctagacaatttagtctaaactgcactcatagggaaaatagaagaagacagttacattcttctttttctggattggtacaaaaattttcatcttttgttagggtacattagcaatatgaagtactgatacatgcaacaactgggataaaccttgaaaatattataaataaaacaagcctgacaccaaaggtcatatattatatgattccatgttgatatggtttggctgtgtccccacccaaatctcatcttgtagttcccataatccccacctgtcgtgggagggagccggtgggaggtaaatgaatcaagggggcagtgatcctcatgctgttcgtgtaacagtgagtgagttctcatgagatctgatagtattagaagggtctttcccctcacttcactctcactattcttcctgctgccatgtgaagaaggactttgttggcttctccttccaccatgattttaagtttcctgaggcctccccagtcatgctgaagtgtgagtcaattaaacctctttcctttataaattactcagtctcaggtatgtctattttagcagcatgagaatggactaatatacatgtataagaaatacctagaataggcaaaactatagagacagaaagtagattaatagtttccagaaactaaggagagatgcaagcgggcagtgactgactgctacgatttctttttggaggtgatgaaaatgttttggaattagagagtagtgatggctgtaaagccttgtgaatacactaaaaaccactaaattgtgcagtgagtggtgaattttatggtatgtgaattacatctcaataaagtaataaggaaatatatgttttaggaagacaaaatttcatcttcagctgaggcaggagaatagggtctggaggcagggtaaacctaagggcaatttgcactgacttcctacaactgaatcaaaaggaaaaccccacctccccacaaccaattaacaaagggattagaggctactccctttgtactgcattgccgatgaaaaatggaaagtacctctgattggttctctcctgcaaccagtcacactggtcacgggccaagtcttcatgtgtaactttgtaacttcacttcagcctctaatttgccccctcctgcaaccaatcagacgtttgcatagggtgtaactttgtaacttcacttcagtctcttattggtcactctctgcaaccagtgagactggtcgcgggtcactccttcatttacatagtgtaactaagtaaccagtgggaaacctctagagggtaaaccccagaaaattctgtaaccagtgctcttgagccacttgctcaagattgctctcactatgtggagtacactttcatttcaataaacctgtgctttcattacttcattcttttgttgctttgtgtgttttgtcctattctttgttcaaaatgccaagaacctggacaactcatagtcaagaccctccactggcaacatagctatggtgacattctcagtcttttttgcattgctgaaaaggaatacttgaggctgggttatttacaaggaaagaggtttacttggctcatggttcttccagctgtacaagaagcatggcaccagcatctgtgtgtggtgacagcctcaggaaacttacaattatgacagagggcaaaggggcagcaggcatgccacaaggtcagagagggagcaagagagaggcgaatctcttttaaaaacaaacagctcttgcatgaactaatacagcaggaatttactcattacccaaggaatggcaccaagtcattcatgaacagtcttccccccatggcccaaacacctcgcactaggccccacctcccatctaggggtcagatttcgacacgacatttggagtggacaaacatccaaactatatcagtgatataacaaaataagcagattgtcattcaaatccacacacactgccttcctgagagtcctgtctgacctgactgccaaggccaaaggccaggtcaaattttttttttttttttagatggcatctagctctgttgcccaggctggagtgcagtggtgtgatctcggctcactgcaacctctacctccttcctgggttcaagcagttctcctgccccagcctcgtgaatagctgggattacaggcgtctgccaccgcacccagctaatttttgtatttttagtagagatggggtttcactatgttggccaggctactctcaaactcctgacctcatgatccacccgcttcagcctcccaaagtgctgggattacaagcgtgagccacggtgcctggcccaggaaaaaaatttaaacatcaggattcatggtttcatactgagattctgaatgatggggtcagacaggaatgaatttctattctaaatattttactgactacctctctcatatttctcaaaatgtaaaataagggtactgattagctcttttgttagcttaggaaaaataaatatcatgaacctactgtggttccagttaggaaatagaccctccataactgatacttttataattagtattatttggttgtaaatattaggctatcacattagatttttggcagttcaactgttccagggttggcttttctcttcctggcatcttagccagaaagaaaagaatgcctagaatttctgttagcacttaatgaatttaatcagcccccgagggacttttgatgtcagggaaatagttgacagagaaacatgatttttattctttctgtgtttctcttggtagttgacagagctttccctggcagaggtaacattacctgtgctgagagaggagtattaacatgctgtaagtgagatgttagaactaagagaacacatccctgtggccttacattaaaatgttccatgcatatgcttctgaatacaatttaagctgctgccaataagaaaataagccattgcctgaaaatgtgtgattcaattgtctatcatttttatgatttttttttaccctttcagacacattttagagattcttttttaaaaagtttgtttttggaaattgaaatgaaaattatcatctggaaatataagggataattgtgttattctgtgaagtattttataagctgtaatgttaagcagaaatttttaatcttaagtatggaaaaatatgtatatgaattgctccatttgatccaagtgatgttttatgcttttccttatggttaatggaaaggattatgctatgttgaatggccggaatatcaggagcatgggtgtcatttgttctcccaacaactatttttgggaagctaagtacatgccagaacatgtattaggaccaggtgatatggtgccaaataatatatgtatatcttctggaattttgagtttgctgtctaatagggggactgataacatacaagtagaaaaaatacatattgtgctaagtactgtaaaggaaaggaagagaatattatgatcgagaagcagagcttatagttccgcaccacaactaatttattgtgtgaccctctgataggctactgatgatgagtgggcaccgagcttctataaatttgacgaattaatcctttgaccattatggcgtgatcctctttttattcctgatgatgcttgttgacaaaatattacttcatttaaattaaatttgcctgagatttcctttctaatttgttttcaacctttatgtttagtttaggtgtatctcctttcagcagcgtgtagttggattttttcagtgtgaattttccccccttcttttttactaagggaattgaatttttttgcacttattttgattcctgaaatatttttaacattctttccatcaccttactttgtgtcaggatttttgtttctaaatgcttttccaccttcttctaaattaactggttttcttaattccattaatttcttattatttcggacgtttcactgttttcatttttagtgtgctctgccaaattttaaccttagcaaagtcaaatttaatgttcccaaataaaacctaaaattctttaactcaaattgtatcactcaaagttccaagttattttctatgcatattattttagctcaactttttcttcctcttagtaattattattatatttaatacattcaggttttaacttacatagattttcttatatactgaccagtttatttcttatcattgcttccagcatcccacttccttttgctcaaaagttcctattaaatttttagtagcttcttttaatggtaaactctctaatttttttgtatcactaaatatttttcttttgctgttatttttgaataatgttaagctaggattggaattcttagttaatggtattttcccctcaataccatgaagatattgttgtattgttttctatcctttattactacagataatgaaatctgctgttagtcaaattgatatgcttatgtatgtgatctgtctttttctttcctgctcacttttaagatatttcttacatttggagttctgcagtttcacaatgataagtccaagtatgcatttttgttgagtttttctcttacgctattctgttttccaacctcaggacacacttttttccagttgtagaaaattctcatttattatttatgtgaatattggtatttctaaaattacttttgttgtctcttttctgcattcttaaacatatttggaccatttatttctcctatccataactcctagctagcctttcacttttttctttatgtcttcattttgcattataagaaaattcctctggagtccttcagtttttaaatttgttgttcatcagtgtctattctgctacttaacttttgtatcatcaggatggctagttcatgctgcattattagcaaacagccccaagtgtcatggattaaaacaagaaaagtttatttctctctcatgcaacattctcaatgaaagttaacaggggagctctgtcttggtggaggcaccatctgggaatgtgaaggcaaaataaagaaaacctgtggaatcataaactggctcagaaagcttcctcccggaattgacacacgtcatttttcctcatattccactagcaaaagaagccaatggatgactccaaaggctataaggaaatacaatcttttttttttttttttttggagacataatctcgctgtcgcccagtctggagtgcagtggcaccatctcggctgactgcaacctccacctcccgagttcaagtgattctcctgcctcagcctccctagtaactgggattacaggtgcccatcatcacacccagctaatttttgtatttctagtagagacagggtttcaccatgttggccaggctggtctcaaactcctgacttcaggtgatccacccacctcggcctcccaaagtgctggaattacaagcgtgagccaccatgcctggccaggaaatacaatcttaatatgcacctggaaacaaaggagaactgtagtatttatgaaaagcactgcacggctactccaaatgttcatttttttttttaatttcaatttcttgttttaatttttagaagctctttttggtttatcttttttttaagtcatgttttcttgctttatcatggattcagttcctttttatttgtaattcctttacatactcttaatttctcctcatgttcattaatcttttattatttttattgtttatactgtatgtttcttttactgtgccaactgaattttttcatggtagtttttatttccacatatagttcgtaattttatagtttgagcccaccttagtgaactacttcctttctttgggaatgttgtgaactctgtgttgtgacagcattccccaagagtggttctgcttttgcttttattgagtctttaggatataaaaggtcacatatcagtttttgttaacttcttgcattttataagtagagtaaattagatcatatacttaacgcttggcccagccgtgaggtttttatttcttataggggtcatattgagtccaaagacaacagaattcctcacttcttgttcaggccatttgcatcatttttctaccttcttttcatggatttagggaatctgtgttttatatagggactttagatatatctccctgtgcttggaagactatgtctcctgtccctccttagacatcaaaaccctggctcaccagccctcaggcctatagcgagaaccaccctgtccctgaaccaccaccacattaactgaaacttattgcagagtcttcagttcctctgttcctttatcagaccttcagcattccatttcctttccttaaacttgatagatttttttaaattgttttacttatattttattcattatttttctgtgcctttaggtggtcattgatctatattagctgggttcattatgttttcaaaactggaagtttctaacatcagcttcctagcctataaaaaattattcaagttgcattatccacaatgctcttttaaccctatgactcatatcttaatatgaactaatacgaagaaaaacaagaattaataccaggtctcttgtcttctttccattttgatattaatcaattgtgtcatgttagacaagtcattaaactttcttgggctcaagcttccccatctataaaatcagcagttgaaactatatgccttagataaatgcattctcttctccaagctaagcaagtttaaatctgatgagcttttaggaaagatacaactttgtcctcagtactataatatttgattctttaattatttccagctgaagtcttttaaaatttacattattgcaataaatgttttacccgaactggtttggtaaatattttatatgcatctgtatataaagaaccatcatatcttattatacctagaaatgaatgcaattatgtttgccattttaagggtctcaagagttaatattaacaaagtgcttgttgacgtattttttttttcacatgaccttctgaagccagcctgcactactgccttttacataagtaaattagggtacatttttaaccttttcatgtttaaactaagacacatagtagctcttcaaaattgcaaaacagtctttagaacatttagtacacaataacccttctaattgcacgtgaaatgaaggactgtaaacttcataagtcacccagaagaacacaatgtaattccctttagagtatcctctttaaaagtggtctcagaatcagactccatgatttcagcaacacagtcaaagatgtactaacagatattacctaggttgccaatgaattgctgtcagttcatgttttatccatgaaaattttaaggaaaatgtaaaaatgatacatttgtttgaacttgtagagaaaattatgaaaaatccaagcttgtagggaatgatggactatctgcagaatattagcatagctctgattttgcaaacacgtggactcagataatcttacccagtggagacataccaatgcaaagtgaactaagatcttggagtactaatggacctatataacacattgagaatgttgaaacaacccgaaacaagctagagaaattggagaagcttaaacctgaggattggtgccctgaaatggaagagaaacaacagtcaactttatatgaacaggatgaaatagcatacaacaggatgatattaacatatctctgagcctgtgagggacagggaacagacttagagcaatccacccttgccgttaagatctattttgaagtgagacaggcgcttgtctcaaaggtcagggactaaatgtgtcttagagaagtcatcgtggttgttttaccttttcatccacctttgaaataaaagattagagataagatgaaatctaactagatccttgctaggagaatgaagttttaaaaggagagccatagtcacagctgtcttcagagtaggtagatgccaagtcttagggaagtacaggattaaccatgttggtaatgacagaacctaaggtatccccagcagtgttctttaagagtgtaaaaaacaaggattaggagagcaggtgattggacgcagctgctgaataatcttcttaacctcatctttactccacagggagaaaaataacaggaaaataaaagcttccaccaagtggttggtggcagtgaaacaaaaggagcatcaaaaagtacacaaggacagatttgtcctgatgctaataattctgaacaaaagggccaggaaattgctgtaaagtgctctgtactagtgtaagataaatacataattagtatacttaaataaagaaaaaaatagagtagaattctaggagtggttcttttttctaggcacttctaaagctgttattcactgagggcctaaataccttgtaatgtctcttcattaagtttttgttcatgaagtagcgagaaatgaatagctctcagtcaatatttaattgatgcttatacattgaatttaatcaggaactatctaaatgactcactaaccaacgaaaatttaagcaaggcaaatgtaacaaaggaaaatggggagcaaagcaggcaaatggtaccagattatgcatgagtaagaaatatgcatgagagaaaactttcatgtttgaagccatttgctacattcctggattactctagcacagcctaaataattctgattaatgcagcctcccaacgcatgatatagtctgcaatgaaaatggcccaaaatatataccttaatttctgtacaatgtactggttccttgttttagtgattctgtatttgtaaaagttcctatattgagtttgcttcaaccgtattgactgctgaagctcaagttctgtttatagcaaaggtcagggtctaaatatgtcttagagaagtcatagttatagttctccataattggagaactatatcgtacaacttctgccatgaatgtgagaccatctaatagtcaaactagaaagagtgaactcatagaacaccataagtaaaatgtaccccagataacatccagaccaaatctcattttatagtgcaggaaacttaggcgcagaaatgtttggttaaaagtggcacagattcacacaaaaccaaagtcttgatgttcagcatgcagaaggagagaacgtagttttccacaatttttttttcttcctcaaagatgggacaagggtgaccttactcgcattaaagaagtggatgatacttagttgtatttgaaagaaaaagagaacagagttctcatgctttgaaaacagaaagtaaatatgtatgatctcacttatccccctttatctgaggtagatacattccccgtggagtaggacagagcgtgatttcttcacgctactcggaatggtgtagaatttaaaacttatgaattctttatttctggaatttcccatttaatatttttggaatgtggttgactgcatcaacaaactccagaaagcaaaccatagataagaggggactactgtttatgaaatctaaaaaaactgaactcacagaagtagtaaaatgatggttactgaggttgggggttgagagggggagggaatgggggattgttggtcaaaaggtacaaagtttcatgtatagacaagaggaataggttttgagatctactgcatagcaaggtgactataatcaataataatgtatatttacctaagagtaaatttcaaatgtctcaccacaaaatagaggtgaggtgatagatatgttaattagctcagtttaatcatttttgatttttacatatatcaaaacatcacattttactcataagtgtatacaattatgatttatcaattcatactaataaaaacaaacaggtctggtgcggttgctcatgcctgtaatcccagcactttgggaggcccaggtgggtggatcatgaggtcaggagattgagaccatcctggctaacaccgtgaaacgccgttgagaggtgacaatgtgctagcagccctcgctcactgtgggcacctcctcaggccaaggcgtccactctggccgcacttgaggaacacttcagcctgccgctgcactgtgggagcccctctctgggctggccgaggccggaaccggctccctctgcttgtggggaggtgtggagggaaaggctcgggtgggaaccagggctgcgcagcgctcgcaggccagctggagttccgggtaggtgcaggctccacgggccccacactcagagtggcaggccggcacagccagcccctggcagcgagaggcttagcacctgggccaacgggcggaggggatgccaggttccccagcagtgccagcccgccagtgctgtgctcaaattctcaccgggcctctgctgcctccccttggtgcagggctcaggacctgcagcccgccaagcccgagctcccccacggtgggctccggcatggctggagcctctccgacaggtgccaccccctgctctgtggcacccagtcccatcaaccgcccaagggctgaggagtgcaggtgcacggtgcgggactggtgggcagcaggggatctactaggcgaagccagctgggctgctgagtttttgatggggacttggagaacttttatgtctagctggaggattgtatatgcaccagtcagcactctgtgtctagctgaaggtttgtaaatgcaccaatcagtgctctgtgtctagctaatctagtggagacttggagaacttttgtgtctagctaaaggattgtgaatgcaccaatcagcactctgtctagctcaaggtttgtaaacgtgccaatcagtgctctgtgtctagctaatctatggggactgggagaacttttatgtctagccggaggattgtatatgtaccaatcagcactgtgtctagctcgggttttgtggatgcaccaatcagcactgtgtatctaggatatctggtggggactgggagaacttttatgtctagctagaggactgtaaatgcaccaatcagcactctgtgtctagctcagggattgtaaacacaccaatcagcaccctatcaaaacagaccaatcaactctctataaaatggaccaatcatcaggatgtgggtggggtcagataagggaataaaagcaggctgcccgatccctgcagtggcaaccgggtctggtccccttccacattgtggaagctttgttcttttgctctttgcaataaatcttgccgctgctcactctttgggtctgcactgcccttaagagctatgtccttaagagctgtaacagtcaccgggaaggtctgcagtttcactcctgaggccagcgagaccacgaacccaccgggaggaatgagcaactctggacgggaggaatgaacaactccggacacaccatcttttaagaactgtaacactcaccgtgagggtctgcagcttcattcttgaagtcagcgagaccaagaacccaccaattctggacacaccgtctctactaaaaacacaaaaacaaaattagccgggtgtggtggcgggcgcctgtggtcccagctactcgggaggctgaggcaggagaatggcgggaacccgggaggcggagcttgcagtgagccaagatggcgccaccgcactccagcctgggcgacagagcgagactccgtctcaaaaaaaacaaaaacaaaacaaacaaacaaaaaaaacataaaggagtcctcacttgatgacaatgatgacagcttatatatttagagcacatatgaaatactaggtactttcctaatccttataaacacattttcttatgacgtaacctaaagtaggttccaacatctcataacatctcttcatcttgttgattaaaaacacgtaagttcagagtggttacataagcttcccaatatctcagtgtaaatctgtagcagagatgggattcccattcagttctatcttgactccagggtcagaattcataatcacttccatattgctacagttgaataagaactgtattttgggctgggcatggtggctcatgcctgtaatcccagcactttgggaggccgaggcaggcggatcacctgaggtcaggagttcaataccaggctggccaatgtggcgaaaccccatctctactaaaagtggaaaaattagccaggtgtggtggcaggtgcctgtaatcccagctactcaggaggctgaggcaggagaatcacttgaacccgggaggcggaggttaccgtgagcccagatcgcaccactgcactgcagcctgggtggcaagagcgagactccatcagaaaagaaaaacctgaatattttgaaccttaagtgaaaggagttacataagtaggcttcaagaaatgcacccaccagagtgataccagagcaactatttgcagtgaagtactaatagggactttgtgtatgagagtctgatattagcagcaggcagttgtgctgtagtgctttcagctggtattgcagaaaaaaaaaatcacacttggctgtaagtaagctgttgattgcttacacgggtttctgtggcatgccagctctccctgccacctactcttccttatcaaacagccaggagttctaagtgaggtgagaatcccacttgacaagcaggcataaaccatttgaggaaaatacaaattaaaaggctccaagacagaaataggagcattagcagcaggaagtgtcttggggatacattgtgtcagattacatccaggagttgggagaataagtgagtcatagcctcccagtggataagccctgttgtgtcagtagctgggcagcctcagaagctgtattagctatttaaagttgccagaactgctgtgaatgcccccaagctagcatctgcttagtaacatccttgaattatgcgcagtatgcctatttctcaagtagcttcagcatttctcctaacttctgacctgtgtcaaagcatagtgatagaattttgttcgtgtttaaggacagtaatacagaatagtaaagaactagagatattttgctcaagatcacctagcgagtcaatcaatgagctaaaattacaatgttgatctcaaggaacttttggtctgtgtaaaaatatggagcataaatataatgtcattgcacacatttgatcaatgtcttggccaagaaatctcagttgtcagaaacagaaaccctcttaatttagtccaaacaagaatttagtttacctgaaggatacagggaatctcatagaacttacagctacgaagtacagctttgttcaggtcaggagcaaaggttacctttctgtatttctgggacctatttcagggaccctgtggcacttagcattctctcttcttccccaatcccctcctgcgccctcctccaacccctgaaggtattttctttcatctttgcagtttcttctttctaccttagtatgtattcagtcgatactggccatcctagctctagactaacatgacccactggattgggtctctgtatcctaaccagagattccacagtgagaaaaatctcctgctccaaacagtttttagtacaaggaaaaaccaggacctcctaagataaagagttgcattcttggcagagaacccaaagatttttaaaatacattcagaaaattgccatcaatgctcaattgtaatctaattcaaattgtagcaggggcagggtttatccctggttagtatataacaacaccgggaagccacttccttcctgccttccagacctcccctcagttgttgcctgggtgctttttaccttgattggctcagtgtttcctgactgctaatcttgtatcaaagagaatccaatacaggtattggtgtttccacttcctgttgcttacgtcatttctagctattggtggggagaacagttgttactggaaaggggtcccaatcaagaccctaagagagagttcttggatctcacataagaatgaattcgagaagagtccataaagtgaaagcaattttattaagaaagtaaaggaataagagaatggctactccataggcagagcagtggcatgtgtagctgggttcccatttttatggttatttcttgattatattttaaacaaggggtggattattcatgagttttccagtaaagggatgggcaattcctggaactgagagttcctcccctttttagaccgtatagggtaacttcctgatgccatggcatctgtaaactgtcatggcgctggtgggagtgtcttttagtatgttaatggtttataattagcgtataatgagcagtgaggacaaccagaggtcactctcttcactatcttggttttggtggatttcagccagcttctttacttcaacctgttttatcagcaaagtctttctgacctgtatcttatgccaacctcctatctcatcctgtgactaagaatgcccaacctcctgggaatgcagcccagtagatcttagccttattttacccagcccctattcaagatggagttgctcttgttcaaacacctctgacacagttgctgtcttttttcagctctggtcaggaacttattacaggcaaagtgctttacagcttaaaaaaggagggataagggaatagatgctgtctttggctttggccttctttggaatatctagcttcttaactaagaataaatttttataagagacatttagatactgttaaagactagcactagacatttttactagaaattccaggattgtcaacacaataagatttatgcagattagatggtatggtgttgtttattattacaacttgataactagaccagtacttctcaaacttaaaagcgcttacagaccacttaggaatcctgttacaaatgcagattctgccctaggaagcctgtatggtacctgagattttgcatttctaaccaagacctaggtgatcctgatgctggtgacccacaaaccgtacttaagtagcaatgacgttaagatactgttttcatatccagaatcactgtacttttcagaatagaaattaatagtctaccttcttatttcagacctgaacaaaatgaacttcagtttaggtgggttacttgcttaaggacaatatagtttgtaacagtgttggaattaaaagctagattctggtgattctgttataccaacttaagggactaatatttattatgtcgattccatgctgttttgttcactttactgaaaatcactgcatacgtagccttaattcactatcgctgtctagttttcagctctagtaggtattgtaaacataaacatacacagaaacagatttatctattttccagccaagcttttgcaaagcaaaatccaggctgcagagagattgttgattgatactaaaattttgacagctgagagtatattttcagcaacaagatgagtaacttgggctaaaggagactgatgagaataaaacttagatttattaaggacctttccagtgagcagtctgtgtcatttctcaatgcaaaaataagtagtgtccaattccaattatatgatcctgcaacacgtaatttagctttgattaattgctataaattgctatcatcttcttaatcctgtatgtatttggtatcaggctttaatgcctgtaaatttaaatactggggtactcaatgaatttccaaaataatactctacagaatacatcctatttcatttagaagtttttaaaataactccagctactgtcttttatgtaatatgtgaattctacacttatcgtttcgttttataaaccgtatgtagcagcatcagtggattgggaacacctgtgtaccccatgtgacattttacttagtgtggacgaggggaagtcaactgcagcaaaatcatttcttttgatttctaacaatttcttctagccttatctgtaggatacttgacaaaaaaaggatacaatatttctatctatttaagatgtatatcacagtccacttaacagtttgaggaatgttttggtagtttctgtgaccttgagtaagctttccatttcgagcctccgtttttgcaactacaacatgcagacagtaacacctacctcgcaggataatatggatgaaatgacagcatatttaaaagcacttaaccagtgcttggcataggaagcactcagcaaatattcttttcttatttcctgaagcatttaatatatttaggattaagcgatagcaaaatgataattctctttacttacctctggcatctagaatgctcttggtgactggaataagttttaattgtaatcaaaactgaacgattaatagtgtaaacttgctgagggagaaataaggaggacatgctttccagaaccaattaaaaatgattttagatgatctgctatttcatattccccacaccattgcttttcctattagcaggtataagtgagaattaatggcaaataatggcaacacaaatcagtactaaagtgcatagtcatttttcatcatgcagctaaaacggtattattaatgtcaatttattggttatatataatgaactactatgctggagttttgtagaaattattttttattccaatatagttacttgatcaaggagactaagttccttttataaaataccagaggatgtcatgaatgaagaaatatggctagtccggtgcaggctgtgtatgcaggagaatgaggttttctctctcacaattacgtgagcctctgcagagtgtactttttcctggcctccagttgtggttaggtgctactggtagatttataaatatgtcatagttatatcaaatattttaatcattctgagccttttcgcctcatccaagtaaaacaattgtcttctccaaatgaagtattgtaaatatttatttgcagattttaatcaacctgtgacagccctctcatatgataaaatggtaactttgtaagattcgatgccccaaagatacatctgcaccatttaattagctggatgtgagtctacagtagagtcaacttagtttttacagatgggcttattttctgattggagagaaccgcatacagctatgtaattattacaacgtataatgtacaacatacattatatatatagtgtataatactccagtgttcacttaggagttcctatctggaattggtcttgtatctgttataaacaattgtagtttctgatagaagttacataaacatggagggatttttattggtatgatttcaaacaaatcattttctaccttaagactgagtcaaatccaaactagcatgtgcttaactgaaatcatgtatatatgattttgttttgttttgtttttgagacagaatctcgctctgtcgcccaggctggagtgcagtggcaggatctaggctcactgcaagccccgcctcccgaattcacgccattctcctgactcagcctccagagtagttgggactacaggcgcccaccaccacgccctgctaattttttgtatttttagtagagacagggtttcatcgtcttagccaggaaggtctctatctcctgacctcgtgatccacccgcctcggcctcccaaagtgctgggattagggtcgagagccacggcacctggccgtatatatgattgtttattcactaattccttcacttgctgaacagatattttggagtttctaccaaattctaagtattgtgcagtatactgttaagcacaaccttgtttcaaaggaagtagtagtcaaagcagagtgaaaaccagatgaacagattattcgtcttaatctacagacttagaaggaaaaaactaccaggcattatctgccagatcttctcataagcactttcacatattttctgtcatatgaacagattatgactatttattgtgattagacctgtgttattttgaagcatgaagtaaatggaaaatgtcacaggagaggtgacattggaacaggatggtaaagagtaggagattgcaagagaaatctattctgtttgagaacttctaaacagaaggtcagtttgagcataaattaatgattaatttttattcccttatttttagcagtaaaaaaaaatattttactgttcagtttaaaaatgtttctggaatccttagggttttccttttgctccccccaccccttaaacaattctatttcatctttcagtgaactggaaatactgaaaaaatataattttgtccgtatttcagtcttctataatatgtttgcccaatgaaatatgaacacaatattgcataatactgaaaactggctgtattagtccattttcatgctgctataaagaacttcccgagactgggtaatttataaaggaaagaggcttaattaactcacagttcaacatggctggggaggcctcaggaaacttaaaatcatgcaggtaggctaaggggaagcaaggaaccttcttcacagggaagcaggaaggagaattcccaagtaaagggggaagagccccttataaaaccattagatctcgtgagaactctctcactatccggagaacagcatggggaaaaccacccccatgattcagctaccttcacctggtctctcccatgacacatggggattatggggattacaattcaagatgagatttaggtggggacacaaatccttaccatatcactgggatttaaaaaatttgtaaatgctcatcatttacctgtctgaaagagtggtgtggggttcaggatttcctctagcgtaatgagtcagaatactgattgttataaatgttcactgtggctcttttgtgggtattgcacaatgtattgttgcttttcttaagcagttcataaagtaagtaaggaagtgacttgtatcatggtcatgatataaattgtattagacaatacatgatgagatgctcaattcttaaaggaggagagattcttctttaatcttaatagcattttctctgtatctccttcctagaacataagttaacgtgtgtacctgtattaacctcacccaccttggtttgcaactcactgagcacaaggaatatttgtattaatacagttgttctaactcagtgcttttcaaccaggggcaattttgtccctcaggagatacttggtagtgtctggagacatttttagttgtcaacactggaggataggtgctattttgtaaccagtgggtagctgccaggtatcctgctaagcatcccacaatgcagaagatggcctgtacaagaaagaatcatctggccaaagatgtcaagtgtcaaggttgagaaaccctgctctgtactataccctggggtcattctgtgactttggcattgttagctcatacattcagcccacactaaaaaggagaaattgatcacctaatgtgtttatccaactgtattggaataagagctgagttattaggctggaaattacatgttctgctgctataaaaaaattttacttttataaaataaaaatattttctacctaaaaaagctgaagaaataacttctcttgtactattgtgtggccgtagcattagtgacttcattcagtgtgtagacattgagcagtgagcttattgataggccctgcgaatctgtgagggagcaggatagacacattgttctcattagctctctaattccacaggatctgagacagatgtgaaacaaataattacttaaatacatattaaaattttaatatagatacatgatttatggtcagcagaaacacagaaactatagaaagacctgagttggaggggtctaggaaaagttccatttaagtagaaaaaaggaggtgtaagagttgaccaggttgattaagcattccagggagtgggaccagcataggcatgaacttggtgcattcaaaaaactgtaaggaaccaagtatgactaagtgcagcagttaaggagagtggcttgagcatgaggcagggcccagatctatcaggggtccctatattccatgtaaaggatttctaactttattctaacaacaagagaaggagtttatcccagctctggcaagatggtggtggccgtggtgctggcagctgggttgtgccctctgcagagccatggcggccccagggctgcgcggcacacatctgaggagctgtaggtgtgactggtgggaatgaaatgaccaaggcccagcgggcaattcctgggggtgtagccccaaccatcttctgtgggatcctggaccatcgcctcccagcctacatcctatatgaggactagcagtgtcttgtgttccctgaggtggctccataggctcctgtgcactttctggtcattcctaagaagcccattcctcggattaaccaggctgaagaagaagacagcagcttcttggacacctactccttgtgtgtaagaagatagcaagggctgagggcctaggagatggataccaacttgagatcaatgatgagaagctgggtgaacaatccgtaaatgacctgcacattcacttacttgggagctgacagctccagtggcctccagctttaacctctgaactgaccaaggaccctagacctgggtgcttggatgggaaagagaaaaagggaagctgtgatgttaataaaactgctctctcccaaaaaacaatcaatcagtcaatacatacataaataatgaaaacaggggaagacttttagggagaacaactattataagattctcacataaagcctaaataaagcaattgaagaacattacagactgttttttttcctttttctttatattttcttatttttcatgtatctgctgagacaatgttccaggtttctacaggaggatcttatgatccattaattggattgaattattgtaggtatctatatctgaaccagtcaaagcctggctgattctcttatgtggtaaaatgtcaaagtatcttcatactgcacctctccattagtaagccatgtttttagcaccttgtggtaaaatatttttcagtgttactaaagaaaataaactagtatttttcaaatgtctcctatgtaatgggagggaagtaacattcattggttgtttaccaagtgctaggactaggctaagcctgtcacctctcttcttcctctaaagcaggtgttttgtttttcataaagattagaaaaccaggtctcagaagttctaaaatgccctagtaggttaagactacaattagtaattggtaaacatgctgttagaactaatctttctgactcccaagactgcaacttttctctctgcaacatggaggagctaggtcatttatatgtctcatttttaagctatataacaaccatgtgaggtagacattattattcacatattttatatgtgtagaatctctatctagggtgtctcagttagtaattcctgggagctgcagtttagatccagatttacctgactctggaaactcttttcttttcactgcactctgatactgtctacaaaaattaccaaagtctaacatctttcctccttttatagactttcacgaagatagagaataactggtcagcatcctcttcaaagtggctttctgtataatttaaagtaatcttcaaggtggtattgatagcaagcttcataaagcatggactgtagtaattctgccaaagactgaaacaataaatagtaaggtaacatataatctatagctttaatgtaggtgatttcctacaaatagaaaataaataatgcctattgcatatttccagttatatgatctcttcttaacaatcattggagaatagaatatttataacagactaggcaactttatgtttcacccatctgagagctagagctttgcctggatatagtgctataatatttcaatatgactccttaaccttgtctagttgggggcttggtttgggggtgggcaacgtggtatatttcaattaaattaactttggaaatcatacagtgctagatttgaactctactgctgaaaccagctggcagtacaactttaaccctctgattcgctgagacattttttattaaatggaaataatatttatctcagagttgttgtctcgatatttataaggtgcctagcagagtattagatagaaattcattaaattggaaagttccaacatagtcatcatcatagttgctgcccttgctgtttttattctattttgttgttaatctttctatttccaaggacccctaagggttggcacagcagggagaaaggggtcctactggaatctttggaagtgttgacaatagaatttcctttaaaaaacctctcaaatgttagctgaggttagatcatttcaaaagaaccttctggcatttgttgacaatagagccattctagatctcttttaatctagttgagtccccggagaacagttaaatagttatagtgcaggccttgcgcatgaagcaaataaagtcaatggatactttattgcactgagttgggaaattacaagtaaaaggaaaaaaattatatcaaatgtggcccaatgaatctagtttcctggtaattgaaagcacttgttagtgattccaacaaagttaagggaaaacattctattgttaaaaagagacacctctctatggtgaatctaggccattgccatgacaatatcaagtcttgtcatttctttattttactttttgttctctctgaaatatgctgttttcatagtccacaagataatattaataatagtgcgatttggctttgtattggagacatttttcaaagcatttatttatccgttggggataaggaagttacaatacaatacttgatatttcgtgtgtatttcacctggtaacttaagtacgtttctaaattttcaattttggaaactcctatggttgttctttggtttaattttttttttatgatgacagaaaagactgtaatgtgatttgaagcccttgtaacgagtacaggtaataatgtatccaggatctcttttcttctcctcaatgccaagttaccttacttggttcagcctgacagtttctttcatctgcactccctgcgtagttcctacgtttaacctgcctgaaacacagctcctcttggtccctcatgtgggcaaaagtcagccccattctctggagtaatgagtttgatcttgacattcagcatgcttcatgatttgtcctcaacttgactttctaatttctgaatgaacatgtttcccattactttccaggcccagtcaaattaatcttaatgatgttgaattacattgaacacaaatttatcttttcaaactctgttctacacagttaataataaaggaacaaggaattgggggaaatgcaaagagagaaaaagtgggagaaagagacaatagaatgtacatatatttctatcttacgttctgctggtgatgcttcttgccaaagtgaggctgagatgagatgtgagattcccttctccaagttgccatctgcctcttttgtgtgaatatcttgcaattctcagtgtgattcttgagtttaaataaaaaaatatatatataccatgttgtccctaaatacaggtcaaaagtcatccacatatagtgctgagtttaaaaacagtgacctatttcaatgctaggaaaaaacaaaacgtaaacacaaaacacagaagtctgtctatgttgggtttgatgaaaagagggtaaaatgttttatttttgttttcggttctgcctcaaatacggttttcctagtctacaaaattatattaacagtggagcaatttaactttgcattgtagacatttttcaaagcatttatttatcctttgggggtgaggaagttacaatacaatattttatccatacccaacatggcaactccataatgaatttgggtaattttattacatgatattttcagcttgttctttgaaccttagctctcaattatactactttctctactggcagcctatcaatgtttggaaagcctcttcatttcttggttatttcagtttccaaaaagtgaatttatacaggtagaaaaaagtacattttcacgttttaattaactgagaatccaggaaactaaattcatcaaataatgttgtcaatttcatataagtaaagtctttttataagtcatccacaaaattttaaacatcaggacctaaattctgggattctgattaaaaacttatgcccatttcattcatgataatacttttctaattacaattttcctctttgttaaaaaataaggctggacgcagtggctcacacctgtaatcccagcactttgggaggccgaggtgggcggatcatgaggtcaggagatcgagaccatcctggctaacatggtgaaaccctgtctccactaaaaatacaaaaaattagccaggcatggtggcgggcgcctgtagtcccagctactcgggaaactgaggcaggagaatcacttgaacccgggaggcggagcttgcagtgagccgagattgcaccactgcgctccagcctgggtgacaaagcgagactctgtctcaaaaaaaaaaaaataataatagtaataataataataaataaataaataaaagggagtggaaaaaaatctaccaaaccttggattcaaagtccatttctttcagagattttattgtaagcattatcttattgactatgttcacataacttttaagagctaaaagaataccacgtttaatatgttgcactctaacaattttaactaaaaatattcatgcttagttacagtgtgtagaaacccaaaatattaaggatatatgtactttgtgggatgatcctctgatttaatatatgtggtctcttgaatctccctatattgaaccttcattttctaatatttattgtgcagttctctctctgtggtgtgtgtatgtgtgtgtatgagtacagaaatggtatataataaaaagcagtttctagcataaacaacaaaatgaataaactacacaaaattacagaaaaaacactaatctacagaagaaaaaaatgctggacctctaaaagtgaactatttattattcttgagaaaagcttatcaaatgagacttgcaatatatataagttgcttttccagattttattttaaaaatacaaaggcaaattactagtgctgtatttgtaagattaaactgcccactccccaatcagatttttggattatttacatgaaacgaaaaacacaaaccacccttgaaaatacgaaaatcttaattatagttacggtgtacagtggataagtgaagttagaatatctttctactgatggaaaaatgtcacttggctttgagatgagtcttttttttatttttattttttgagacagagttttgctcttgttgcccaggctagagtgcaatggcacaatctcagctcactgcaacctcctcctcctggattcaaggtacataccaccacacccggctaatttttgtaattttagtagagacaggggtttcaccatgttgaccaggctggtctcgaactcctgacctcaggcaatccacctgcctgggcctcccaaagtgctgggattacaggcgtgagccattgcacctagcatctttttaacacagggagagaatccattgaaacttttttttctctgtaacccctaacaacgttcggactatttcagcctttaaccatttggccctactgagtgtcattagattggcctcaggatccgtaagtactattatttttctcttgagcttacctctacatttatttaagcatgaaccttctcagtggttcactatagctttacaattcagcactttatccaaatacagctagaaaacttctttttttttttttttttttttgaggtggagtgtcgctctgtcgcccaggctggagtgcagtggcgcgatctcggctcactgcaagctctgcctcctgggttcatgccattctcctgcctcagcctcccgagtagctgggactacagggcccgccaccacgcccagctaatttttttgtatttttaatagagacggggtttcaccatgttagccaggatggtctcgatctcctgacctcatgatccgcccgcctcggcctcccaaagtgctgggattacaggcgtgagccacagagcctggcctctttttttgttttaacctctcatttcgaggcttctgtttgatctgtgttttagttagtctgagtttatatgtggctgtgtctagccatttacgtaggtcaattggactcaaaacccatctttcacttgaacctgcctttctttacctatcctatgtgcaagttctcttgctatttattttgacaccccacaaatttatcgaggttaatagactactaattccaaagcatttctaaatcagattgagtctattctctcagatctgtgaatacctattagggatggtatttgagataaaaatatgaataaaccgtacccttcacattttcttaaataataaaaaaaaactgaacagaagtgcaagactataaaatctctgactgcattaggagatcattattgcagtgttcaagtgtatggttatgactacaaagcaagaaaataagttttcttctctggttaacttacagccacatctcaagcattataaagaagtgaagagggaaatgataacgtaaaattggatggtgaattaaactttcattgtgtgttgagctcatcctaagactaaagcacagaaacatgtccataaaaattgtgattgtttttttgagatggagtctcactctgttgcccaggttggagtgcagtggcaagatctcggctccctgcaacctccgcctcccaggttcaagtgattctcctgcctcagctcccgagtagctgggattacaggcacctgccaccatgcccggctatttttttctatttttagtagagacacagtttaaccatgttggccaggctggtctcgaactcctgacctcgtgatctgctcacctcaacctcccaaagtgctgggattacaggcgtgagccaccacacctggccccaaaattgtgatttttattggttataagacctaggcattgtccctgtttttgagttttggaaagctaacattttaaactcctgttcacaaaacaggtgagagtaggactttcccctctcactgtgctaatcatattactatcgttggtcttgtatcaatttttaaaacatcatagccattattattttgcagtctgtattatttcttctaagtattaaatgacagatattgatatgaagagcaagaggctctccaaggaagcctcatctgtacaaagattagcaagaggttgcagcaattatgaaagttgccagaaatcacaaatgttcctaattttagggagaataggatgccccccatcacacataatggctttatcatcaggatttgagcccatgcagcagaatatccaggttctcttagaaaccagatgcttccttcctcctgcttggaaattggaaatatatttacatcttcaagaatgcgcgaggttcttctctgaagcagagccctgcattgcatctaattgtagaaattacaaaacttgtcagaaagttaaaaaaaataaaagaaatagtaacagttgcattgatttagaaccagctgcctttcttttatccaccctgatagagtagtgctttaattatttctcctaactaaaatgatacttccctcttgagaatgtctgggcctgtttatactgtcaccatcgttttgatacacaattgtccatattgatactctgtttttaccattaattttccaaagagcctctgaactcattgatagtgccggaacacagccttgccaacacagtgcccagccctggtaaactgagtcccgacaccacttttagttccaaaatttggggaaaaaatattattttgctttcacattctctctgctctctttaatacacacaactgaattcacagcctgaggccagcagagagcttagttatccacatctaaaggccccatgtcacaaaatttatctctgatatttaatatctttgaaagcacttaatacaagcccagtgttagctattctgtagtatgcctgaatccattaaaatgaaaaaaacctcagtaatgatattatgttgaagagaaatgttttataactgtcatactttggttttcctgaaatcataaaatggtcatgaaaatgatttacaaaaaaactgggttagagtgtaccagagtaccatagtcaagtataatgacatccaaaagaatgaaatgagcatggatagaggagggagaggtgacagagtaatgaattgccccctactgattttgttcctgtttgatctgacaacattggaatgacagctgctgaatgagacaatttgattcaaatgatttgcatatttttcaccagaaaaagtggtttgtagtttatggaatgagtcccttattctaaatatggtgctaatttcaagtacaggtatcctctgatattttgtgtaagtgaatgtgttacttattgttaaccagtattgatgaatttttattatagatccaaaaaatgatataattttagagatttatcccaatttctatcaaccagaaggtgaatatataccagttttccaaattacatggtgcatccccccacctccctcttttggtggaagattaggcatgcagtttttaagacccaatcaatctattgatagtgttaagtttcactatcctccacctgaaaagcgtgatttaaaagcaccaaactaagtatagcaaagttcttgcattgcttggcaatttcataatttcaggtttatatcgagtgagaattacaatgtgaaggtctttacttgttttgggctataatttgagatggaagtgggagaatgtgtagaatggttgctgatcatatatcccagatgctgcatttgtgggagaatggattgatacccagaggttccttctaacatagttcatcaagccagccagaaatttaagttaaccttgatatcccctgaggttaggttcccactgcacttggagtaaagactagcattctttttgtggctcatacatgccactgtgccattcaactctttcttttgtagcacttattcaaggtacttactgcctttttaaagtttgctcatctgtcacctttcaatacaatttacctttaacaccctatttaaaattacaaaccccaaccccaatgctctggctaacttttgcccttcactttttccttttttcctctagcatttatccttgcatctgtctgtctcagcatcttggaatatgatctcaaagagcacccgattttgtccgtatcgttcaaagatgtaactcaaatgtttataatagtgctttgtacatagtaggttctcagtataacatttgttgaatgagtggttgtttttgtatttcttttattatttaatttttgttcctccgctagattcgtgttcaggattatatccccagtgcctttcacttatttttcatgtaacatatatttttgaatgaatgaatgaatcaagaaaaaggttctggaataattttaatatttacctgtctgttaaaatattctcactagacctgttagaaactcaaagctaaattgaagctgatgtgatttctattcactaatttcctctggcaggcagtgattgggaaacatggtaaataatcagcgcatgtagttgtgctgtttaaaatacagcagttggccaagttctgtaagtatacaaatatattttcagtagatgagttaaaaccagcatctgattactttgtgctgtttggcttaaatagaaacaatttcatctcatttaaataaacaatcatcatatttttcatataaatgatgatataagctctggtaataagggcttatgttattgcttagaataggaaagttgcataaatgtgatcactctcaaaataatcttttgttacatcctggggagggggtaatgacaagcacttgcagtagctctatttatttatttattcatttttattgaggacatatgcttcagaggcttaaaacttaaaagattgaagcagtattataaaggagacataaatggcttttaatgcttgctgaaagcagataaacttaaagacttatgaacatcgtggctaggaatatgtgatagaatgtagaatccaaagggcaataaaatataaatatgtttctaatttgtgtattcttccttgtttaccataggatgtgacacattcagtgctacaagctgactgtctatgtccatatgggaagtatacacattgttctaaaactataaatcagggacatagttgaaatttgacaccaggttccaatccctaatgtcctctgaaaaatgtgagtttataaaggaaagcaatgtttccaagtaaattcattgtcttttggggctggctagctggcttttagagcctgacaggaatgtttttatttcttcagctctagaaaaggaaaagaggaaggaggcagtagaaaaaccaattgagtgagagtcagaagatgtgggatctagtggtaggtgggctgtaataaattgtttgacttaggccaggtgtggtggctcacacctataatttcggcactttgggaggctgaggtgggcggatcactggaggccagtttgagaccagcctggccaacatggtgaaatcccatctctactaaaaatacaaaaattagccaggcatggtggcgtgcacctgtagtcccgttacttgggaggctgaggcacaagaatcacttgaacctgggaggctgaggttgcaatgagccaagatctcaccactgcaccccatcctgggcaacacagtaagactctgtctcaaaaatcataataaaataagataaatagattgacctgaaaagggctttgtttctaatccccctggggttcccaaaactttttaaggtagggaagaaaactggggttagaccaattaatctcaaagtttcatccagtaattacagattcagtgatgactgttgttctttagttaacctcagaaaatctgtgaggtaggccccacgtgggttaagcacagttgcactccttgggcaggaggaggtagtggctgtttaaagacctagagattaatgaaataattactctgcctgcacctcttttctcatccctaaaagggaggactgcttttctgtacttcccaggaatgccgtgaatcgagtacgtacaactgtgttgtttttgaacgctgaaagccaaggtaataattagaaagtgtggatgtcacacttattttataaacactctttaaatggatacatgagttagtgtttgcttgatgttgcgaagcaagctgcagtttttgtctactcttcaccccacctaagaatctagttttcagcattaggcaaatgcttctggtacaagcatgtattaaaatttaaaatctgttaatgggttttaagtaggatcttgatgtttggcagaagtatcaataacatcggcgcctaaaataaatattaagttgtaattttaaagcttctattgtcatatttggacagatagatactgtgcagatacagtatgtggaagcattttaaggaatttcagttctagaaaggctctttaaaggtcaacctaattaaagcaatgtttttgagccagtacaaagtagatgcaattattggaaattcattgcaacagcacggaatggcatttcacttacagtttaaactttttatggttaatttagaaagcaaaaatcatcttttttggggggttcctgatctctgacttaaatgacattttaatcaataataatgatttctttgttaggattaggagaacttttgttctccgggatacatggcaggaatatttagcagctctattttagaacccctaaagaagatggttcttttgtaatgcaagtgctgatctaactcagtaaaggaaatgggcttctcacgtagaaggtgatatgcatggacatttatttaccattgtctgtccatagattgtggaatgaattggcttgtgtggaaaatacagaatgacctatccctggatcccagacagagttttggatactacaggttgtctctgcaaggaaggttacccagctcccttaaaatcattctataggaagttcccctccatgcttcttcatgcagtttaactctaatacctaaaaagaagagttgttctttccccttgatgtcacatcctctgtgtatattaagagtttaacttaaaaatgttacccatttcattagattgcttgagtatgatctgtaactaccccgtatacttcacagactaggtcctcagaagtcctctgcattttcacataaactaaaaacctccagtggtggtgttcacttgtctatgtgtgaagtagggacatcatgcattcctgatggacctcactaatgtggcaaggcttgtttgaaaaaaagaagaaaaaaaggccatgcttctaatgagaaataattattggaagcaataaaatatttatattccattcattaaacacactgaccacgaggaaattaaaaagtattgaattccaaaactatcacaaatacagaaaatatacatgaatgtttaaattttcatttaatgatgaaatgaagatcacattcttcacccttagcaatgctaatcacgtgtcactggttgaaatagtgatcaaataaatgagaaaaagatgaatgactttcccaaaatgttagacctatatttagatataatttaccattttgtaccataacctattacttattttagcaaagtcccaatccactgattattgtcgcattgtgtcatactcttcaaaaaaatgaaaagtccatctgacaatatgatatcttagaaagtcattgtaaaaatctgcttcagtcaaaaaaggttttatgattgcatattaactttgaaattaatcaacaagttgacagtagacagtctctagtgtctctaaatatatggcatgtctttgccataaaatagaaattgctacctacagatattatctgaggcattattttgccttgcggagggtatctgttatgttagagaagtgatttctaaacaaactttggctttgccaaagtgtcatgctgtttgtattttctttggtatgtcacaagtcatcccaacatttccctctcatttctttctttttctttcttctttttctccctaaaactgaaggagatgggtcattttgaagatagaaaagatattacggtggccctattttctaagggactttcaatactccataatatgacagcctaagcttctctagcagaaaaggccgcctgggtgcatcagttaagttacagatcctactctgctttctctggcaatggaggaggcaggtgattgcctaaacacaaagctcctgccaatttctgaaaggcacagtggctggagcaaaaagcaactcatcttcccaggggcctgccctattctgaacatctctaaactaaaatgattcttcttttcttttttcttgatcagtcttcagtcactatttttatatcatgaagtgttaccgggtttatgtgcctgtccacatttcataaagttagaggacatatggtaaaaatctaagaataacatcataaatcatccatgcctctgaattgcttgaaaatgttaaatgccttggttttggtccagatgttcaacttgccccttttataccagcctgacatacatcagttgaaagaagaaaaaaaaaaagagaaaaccctctgctgttctctttcagcttaatggttgatatatttttctttcttctctgactttgccatttattgaagcatagacgggtgccctaccctacatgaaagctatttcctactgcttgtgaaagaaaaaaaatatgaaataaacacttactattctgttacaaggtaacaatagagtgctaattgctgagtaaagtcatgtagccccaggattatgttgagggactccactataaatttgaagacacccataatccatgtatcaggcagaaaatgatttgctgtgctgcacttctcctttaacagtttctatcgaactatttaattaaatggaataataattattattccctgatccaaattagaacactttcttgtttaacgttcctagtaagtgcacaataaatattaatgttaatggtgatgatgatggtgttgatgtgttttatggtaagaaccaagaattatgggagcacagaaggtggatgacttttcccttttgggcaggagcagtcaggaaagaattcacagaggcggtaatatttgaagtggtctttgaagtatcagtatttctatatcactaggtgattcttgagatgaagataagtgtttttgatgcattaagcacagtccacagttgcagttgtcactgtttttaggtctttctaccttgaggatttcccagttctcaattttcatgttctgtttgtttctgtataattttgtggagttgggcacttgtatgttaaaaaaaaaaaaaaaaaggtcaggttaacatataatatgctctgctatttccacttttgatatttgctttcttctctcatgttggttgtgtgctgaccatgcactgactcattatctgtcaatgctcagttcttatacagtgttaaggcaccagctgaattaacacaaaaagaaaatgacagagctcagcagggcgcggtggctcacgcctgtaatcccagcactttgggagactgaggcgggtggatcacgaagtcaaaagatcgagaccatcctggccaacatggtgaaactccgtctctactaaaaatacaaaaattagccaggcatagtggagcacacctgtagtcccagctacttgggaggctgaggcaggagaatcacttgaacccgggaggcagaggttgcagtgagccgagattgcgccactgcactgcagcctggcgatagagcgagattccatctcaaggaaaaaaaaaaaaaaaagaaaatgacagagctcttttcattccaagtttttagataccatatccagttgttgttgaacatgatggcattattagtgttttcagtagctcctctccctaataggaaggaagcaaatgggttgcattgaactctctttaatatgagtgctatcttcagcagtgcttcattatacaaagtattaatagaatgactggccatgcctgcaatcctcagtcattttctctagcttcctcacccacacacaggttgttaagtcaccaagagatgtgttacttctgtgctgtgccctgtgaaagctttcctctctagagatctggtatcttcacaggaaaggtcaaataggtttcattgtctttgcacagtatcacactaatttaagatttgagtttcttttaaaaaacacagctgtgagagagagagagctcctctgaagctgagacagtaaaactgaagatacccggaatatttataacatatgtttgcataaagcaagcttgtccaacctgtgacctgtggaccgcatgtggccaaggatagctttgaatgcagcccagtataaatttgtaaactttcttaaaacatgatttttttgtgattatttttttttaacctcatcagttattgttagtgttagtgtattttatgtgtggcgccagacaattcctcttcgtccagtgcgacccagggaagccaaaagattggacactcctggatgaggcatttttaaaaagcagataaaataccaatgtaaagatttatttttccaaaagagtggattaaaagaaagacaagtgctaacaactgttgttgtcacctcatggttttttcagttgtctgtatgagatggcatcgttactgactcttgcaatatttggaataatataaactaagtaccacagtgtagtttgaggcttgagttctataaatacccatttcattaatttggggaggagaaatagatgcgacaaatgggcccaacatacattggctcaacaaaatagaatttatttctcaagttcataaaaatcctgggtggtttcatgtgcgggggaaggagagagtcctctgatccacagttattcggggatgcaggcactgctgtttcagtatgggccttcccaaattctggacatcaccattccattcctcaggatgggggaaagaacccatagcagcttgtgagaggacagtcctggctgtgctataccttatttccactcacactggttagaagtcagtcccattgcgttttttggccatgcacaggggactggggaatatagtccagcttagtgccctggaaaacgggagaaagtggaccttaatggacaggtagcaatctctgctactctcattcatttattttttattcaacatgttttggaacaacctatttgttagagactgtgctaggtgcttggtttatcatttcattagcccactggcctccccgtagtacttcagggaaacagctaattaatttgtgtctctcatgagataaatgagactccagatctaactaaaacacataggaaacttgacatttcaagcttagctcctttttttttttgaagaaggattacaaataatctggtggtagcattatttttttttctcccttgtgaatcagccataggaagaggagaatttgtgttgtcattcttatttgtattctgtaagaatgcttccctttactactggtattagaggaatgtaataccaataccaatatcactatcaattagaggattataccatagtttcataatcttttcaatgtaaggtagtttaatcagtcaccatccacacttcaacaattttccttttcattgccatgtaggttaaatgaagtcaaatacaatgctcgtgtctcttgtattgcccattcattgcctagcatgtttacctatacaataggcatatgatagtcttttaaatatggaataacaacacaagcagcataaaagattgagacagttttctaataatcacaacatatatcccattttttcttttatttcacttttctttttttcttttcctttcctttttttgaatttctttttcctgcctacctttttccgtttcctttttttttcttctgtttttaagctttaccctgcagatggttaccaatatgattaaaattcttcaagaagcatgcagatctgcctattatagaagggaaaactataaggttacagattctgggtactgatcccactctggccactaacttctgatagtaccttggatagataactttattaattgaggtggttgacctcaatatcctaatgtaaaagatgaagatattgcatccggagtaccacaggcctcttttgtcttttttatataactgctatgttagtataaattgttatttatgagcattagatgagtatttataaaatatgtcagggataggagatatcatttgttgttaaaatcttatttttgaaattagactgcaagaatttgaatctgttgtcatgactttttcaggctatttgatcttgggaacattatataacctctcaaagtgacagtttcctcatttgcttaaactactgtgggttataagaatatcatcatggccgggcgcggtggctcacgcctgtaatcctagcacttttggaggccgaggtgggcggattatctgaggtggggagttcgagaccaacctgacaaacatggagaaaccccatctctaggaaaaatacaaaaaaattagctgggcatggtggcacatgcatgtaatcccagctactcgggaggctgagaccggagaatcgcttgaacccaggagatggaggttgcggtgagctgagatcgcaccattgcattccagcttggtcaacaagagtgaaactccatctcaaaaaaaaaaaaaaaaaatcatagggttttggtgataatttaattagatactgtgtctcttggtataagctctcaataactttgatcatctgaaataaaaatgtcattctctttcctctatccattgtgttttcacagaagttagggaaaatgggatgagaattttccaaagcagcccttcctttttatgtaaaatttagatattggcagcgtatctcagcctcaatggtaacattagggtttgcatctctgttgttagtccaggaatctgtttttctcttttgattctttaagtcatttggataaaatattaaagagcactaagatctgatgttgtagattggaaagaggaaatagttgaagaacatgaaatgtgtctattttacctttatatagctatgcagaacaggtgagatttggtatgaatttgaatagtaacgatgcttaccactcttgaaggatattttgcaaattttaattggtttatctgaacaccacttttaggggctaagtaaatattcccactttacactgagtagatctaacaaaatgatcagtttacccaggtcatttactacattgactattgccaaattcagtatatccagattggacttgctgatcatgcatgcttagtgggtttctttttttttttttccattcttatcctattttacataagaacgaataacttattctctctagagtttgtagcttcatttgcaaaaggggatgcctaagagaggaaagagcaaactaggtgtctttctagcttcaaagattgttattttgtgatttctgtattagttggtttataattgaccagatcaatttgaatcatatgtgtttttctattttctgaattcaacactgttattttctattgtcttgagtactgatgtttccaaatttttaaacctttcccttcttttgttttgttttgtttttttcttccttttttttttggagacagagtcttggtcagtcgcccaggctggagtgcagtggcacaatctcggctcactgcaacctctgccttctgggttcccgccattctcctgcctcagcctcctgagtagctgggactacaggcgcccgccaccacacccggctaatttttttgtatttttagtagagatggggtttcaccatgttagccaggatggtctcgatctcctgacctcgtgatccacccgcctcggcctcccaaagtgctgggattacaggcgtgagccactgcgcctggccttgttttgttttttctagagagaaatgggccccaatatttgccttataatactttgtaccttgtcctacatttcccccttagaacaatgtacagaacagtcaacatgacaatcagatcaagtttcaccttctgcacttaggtctcttacttagctatcactagtctggaggtgttgggaacataacttaaactctttgaactatagtgttctgtaatgtggcattaataaatctgaagtcaaaagatataaaatatgtaaaagcgcttaggagaatatctggcacataatgcatggtagtttttcccttctaagtctgtaggttaagatgaatatttgaagactttcaaactgattttcttccaattaaaatatttgtaaatgatgtataaaaagtctccattctttaacaaaggctgttaaaggctctggtactgttttgattatataaattaaaaaattatgtatttcttataaaatattgcatattttaaaaatgtttttagctcattgaaaatattcagaaaacatatattttaatatcttagcccagaatttgaaatttttctatgaaggtgcaaggttctaagaccaaattgtctctgtagagctgtgtaaaattaaaaaaataaaatttcgaactggccagaaaatgtattgttcttcccaaatcttgagacaaaggcacaaaccctgtttcattcacacacaaaaaataattttgatttgcttagggacataagatttatggctctgtgatgtctgctagagatatgtttaaagtggaccactctatacagctttatataaaaaacatggtatacaccttactgaacattcttttcttacattttcttcctatcgtgattttttttttttttttgagatggagtcttgctctgtcacccaggctggagtgcagtggcgcgatctcagctcactgcaacctctgccccccgggttcaagcgattctcctgcctcagcctcccgagtagctgggattacaggcgcgctgtaatttttgtacttttagtagagactgggtttcaccatcttggccaggctggtcttgaactcctgacctcatgatccacccgcctcggcctcccaaagtgctgggattgcaggcatgagccactgcgtccggccctattgtgatttgttagtctgagtttagattacttacaccaggaggcattttttagcctaaatctgtaatcagttaaacaggaacactttctaaaaaattctagttcctaaaaggcttgacttctacttttattctgctcatttatgtgactggctatttgagtttgaattactggtacattaggaacgaaaataaggaatgcttccttttgcttccagattagacaatataccctgttaggtatgccagtgctgtgagttaaactgagctgtaaagtacaggaagggtagcattgtctgacagaactggaaaatgatggattaaaagtaagataaaggccaggcctggtggctcatgcctgtaaccccagcacttcgggaggccgaggcgggcggatcacctgaggtcaggagttcgagaccagcctggccaacatggtgaaacccccatctctactaaaaatacaaaaattagctgggcatggtggcaggcgcctgtaattccagctactggggaggctgaggcaggagaattgcttgaactcgggaggcggaggttgcagtgagccgagattgtgccactgcactccagcctgggtgacaacagcgaaaatccatctcaaaaaaaaaaaaaagtaagataaatagcttcattgacaattgaggaccttaatatgtctgacattaattttaaaagtccaaggaggcaatatattatgtagtatttcccagacttatatgagcatataacttaactcacagaataatgataatcttatccaattacctatccagcatgtgaatcctttttataatacgcttgccttatatttatccaacctctgtttaaatatctacagtaatgagtaaccatttatagtgatgatgatgatgatgaaagtgagaatgataatggctaagtagtgctttcttcctttatactttctatgcacagttttaactgccttaatcttcccacaaccctttgaagtacgtactatttattttttccatttcacggttgagaaaattgaggcctggagggattaggtaaattgtcccaggtaacacagcacaaatgggtctgggtcctagggaatcttgtcaagaatccataaatgtaacgacagcactattttctctctctctccttctgctccctctccctctctccccctctccctctccgccactctctcttcccccatttccctttgcctcccttcctctccctatccttccctttctttccctccctctccttcttctgtctctccctcttctctcttctccctctcctctcttctccctctcctctcccttccctctccctttctttcctctcttctccctctgtctccctctcctctctccctatctcactccatatatatataaattctgtatacagttactccttgacttgtgttctaataaacccattgtaaagccacaaaattataagtcaaaccattaagttggagaccttctgtgtatgtatatatcacaaccatttgatacctatgactgactgtaataactataattaaaaatgtattcacatctctaattcacccttgaaaaaattatattctctgaagttggcttttctgctgggagaataagattagggcctactttatacggttgttgggtgaatcaaataagctaatgaattgagcttacagcatgtagccgtgtgcatcataaggactcagtaacctttaattgctatcattattattaacatcattaatatgttgttgtacaggaacaagcctaaacgtaggccctggtgtactgatggacctgcttaagttcactacttctgagcacctggagggcaaatgctatgaatcctggcttaagttgctttagtctagccgtggcatgcttccaccaaagttctcatcttaccatcttacctcttccaaagtcgcctaattactcgcagcacataaatccgcctgttagattaaattgtggggaaaaagcaagggaaactgcttagatttaatgttagagaatgccaagaagagacatatttattatgcttattttaatggttttctaacacaatagattgggaaatcatgagtttgtcaaaaacaaatcttaagtcatggtgaattgcaaatgcccagctaaatcaggacttaaaattactccctttgtggaaatctctttttcttctatgacacctgaataggactctcacatctcccatgctcttagcccagctattcaggcagctctcacatgtaaatttgtccctggctcctacaccagtaacaactcaatgtgtgcgtgtgtgtgtgtgtgtgtgtgtgtgtgttcatgttacctctacattatatccttggtttctaagtagaaggactaatttttacctatctttttttaacctatttttgcagatttttcttttttgttagtgcactgccttaagcaatattcttttttaaaacattggtttcatatagccccttctacagtggttgacgttcaaactcatttggcttgaaagtcattgttggttttactgcctccattcagatcctccttttctctcttgcttcgcctcttactcttccttcctaactggtctattctggtattacccagaacaaataaattacattgctgatatcagagtgacctgttaaaagtataaacatatcattttctactttaaaccataatccataactcatatcaacaaggttaatcccaaactctttttaaaaataatctgtctactactcaactttctactcagttttttattttttatttttatttctacactttttatttctacagtaatatcaaatcacttaaaactctcccaacaaacaatacctgtttatagttttgtttatattactcttgttgcactgaataacctattagcatacttaaggcagagtctttgtccttttctccactattacctgagcaatattcctggtgtcttgttcatagcagatgcttgtattagtttcttaggactgccacagcaaagtaccatacacagggtgacttaaaatgacagaagtttattctctcacacttctagaggccagaagtccaaaatcaggtgttggtagggctgtgctccgtctgtaacctctaggggagggtcgcatctctcagcttctgttagccccagttgttctgcagcttgtgggagcataactccaagctcatctctcatcctccatcttcacatgctgcattccctgtatgcctgtgtgttcaaattttttcctcttctcataaggacataagtcttattggatatgacctatcctaatgaactcatcttaacttggttacatttgcaaagaccctgcttccaaataaggtcacattcacacgtaccaggggtcaagacttcaacacatctttttagcgacacaattcaacccataacaatgttccatcaatatttgataaatgaatgaatacatgcattctcactcagcagtcgctcccgagaatccttctttttatgttcagaagagaggttatcaccccaccttcattttataggaattacgtcttactataccttgcacacactacttattaattttcatgtcacagtatatttgttcatatatctatgacattggttagattaggaattcctcaagtaagggcctatatattatttatcttcatatctcattgccttacatggttcccagaagggaaaaatgagtgcttattgaactcaaacattctctgaattcaaactctgaattcaaacatttgcttgaattctgactggattattttccttccccacctcaaaattgcattgctgtctgcttgacctttgtgtgacagtagaatggccaggtggtaaagttgcagtattgagacatacaacccatagtttttctgtctgggcctgttttactgtaatcacttcagacaacaaagaatgctttccccatctggggccagttcccctaactagcaaaatcctagaatgccaatagctgggtttcttggaattagtttaaatcattgtttgcaatatgtgtttacattgcattgaaaatatttgttggaaaagatgttttcatttttagcagtcatttttggagacgtttatgtaagagaagcaaatatcacatgtttgaagctagaaaatttctaaggagtacatgaaaattgcaaagcaatttctgtttgtagcttttagatttaaaaagtgatggctaagggcacattttcctctttagaaacgaaagggaaacatttcaacgaattattaagtattacataagtcttttaaaattatttgagatgagttataactgaaacatatacatagggtagttagtgataaattgagaaatgcaaaaatttaattgagcattggagataattattgcagatatttgagataagatgtagctgcaactaagcgcattcaatttagagattatagaaatcatgcatgtggcaaacccgtgaacctctgtttctctccatctgttggctttgcatctttacttcaggaagactacctaaagggaagaaatagaagttagagttttgaacttgctaaccataagtcgtgtgacttccaatatcagttatagtctactatagtaataaataaatattcattttgtgtgtcatctggaattactcaaatttataaaacttatctgatagtaaatatacaataatttaaatgaatgaaatattgaaaaatatctaaagttacttagatgtgacacagtctattttgctgtatatctcttaaaaatgcttttggtaatgcaagggttctttacaaagtattgtctttgtgaagcagttggcaaatcacttattaaatatttaacctgatgagttagttttattattcttaaggcaaatctttattaagagtaaaaagaacatttaaaaaataagtgtacagcacttgctactactgtgaatttattttttatcaaaagaagtatgattttgtattattttgttttgactatgatgttacataataatggcatccttcttcatttatgcagttggcttttttattgtttaagaaatttgtttatattactatttggttacttaatacatagaagaatatttaataatagagacatttgaaaaatataaaaattataaggaatataatgatcataaacctaaagatagctggatgaaattcactttgattttcatttctaagctcttttccaaaaagccaattttcaaagcaggttttcttgttttattttgctgtttttcctgcaagagttgagacactggttttaagggatacacttccattattcttcattatttcttatgttccacccattatacgtgaactatgtgtatcattagaagacagaaaacaaagagctggtcttcccaagaataaagtgtgaatcaaattgattttaaaattgctctgtgccatgcaagctgtgaagttctagaagagtacagtcagcgtcttggaaaagcctgtgtaaaataatattttggatccattgttttggttttcacacagtgacttaagtgtggcattataatttaagtggaaggcttttattggaaatttagcttagtagagctagattaacaatatatgaaattaaaaaatttatgttttggcagcaatttttgtgttttgtctgcagaaggtccttcaagtggggaagtttcatgctgaaagagccagtacaaactatttctgatgagctgtagatacatttgctaaaaaattttcagttattattgctctaatatgctaaatacatgttaaatctgtttctcataatttaaatgttctggatacaaaaatgcttaagaagtaagtatatcagaactgttttcttctgggatcaatgcattgccattctcagtggatgaagagctgagatttgggataccatgttgcaaatagaggagcccacactggcctcccttcctctactctggccacaccttgctattaattactcgaggataagctaaattatttcattcctttgctttctctcagaataaaatccacactccttgctatggcctgcatagtcttatttagaaatctacctaaccaatggctgggcacagaggcttacgcctgtaatcacagcaatttgggaggccgaggcaggcagatcactggaggtcaggagtttaagaccaaccgggccaatgtgacaaaactctgtctctgctaaaaatatagaaattagcctgggatggtggcatgcatctgcaatcccagctacttgggaggctgaggcaggagaatcgcttcaacctgggaggtagaggttgcagtgaaccgagatctcaccactgcactccagcatgggcaacagagctagattctgtctcaaacaaaaaacaaacaaacaaacgaaaaccaggccaggcgcagtgtctcacgcctgtaatcccagcactttgggaggccggggtgggtagatcacctaaggtcaggagttcgagaccagcctggccaacatggtgaaaccctgtctctgctaaaaatacaaaaaaaattagccaggcgtggtggtgtgtgcctgtaatcccagctactccggaggctgaggcaggagaatctcttgaacctgggagggggaggttgcagtgagctgagatcgcaccactgcactccagcctgggcgacagagtgagactccatctcaaaaaaaaaagccacctaagcaacctaattttaactcttgccactcattcctgcatgttgtgcctccaaagaatacccttttcaccgtgatctatcttcacgtggctgcagccttctcattatgttgttctcggagaaaccttccccgtgatgtatcttcacatggctgcagccttctcattatgttgttctcggagaaaccttccccgtgatgtatcttcacatggctgcagccttctcattatgttgttctcgaagaaaggtgtaactcttcagagaggccttgctttcaactatctttcataaatgatcccagttctactactgatcgccttattttatttttctaatagctcttaccactactgcagtttatcacttgtttgttctttctgttcctccttcattcctctttccttttttcttccttttctttccttttactatggtctatctcccttgagaaaatgaatattccatgagaaaatggatcttatctatctccttcattgatgtatccccattgcctagaaagggaagaacaggaactttacagtgaagaaaaggaacctggcagataccaactgaatcaagtgatcaaaggtagcatgacagtaatgggacagatcattattatgagcttgttgatgggttgcactaagaaaaaaaatttcacggaagtatctaattatgaggaaacatcacacaaagctaaactttacaaaataattgtcctgtaatattgaaaattgtcaagaacataaaagataaagcttgaggaactgttcaagattaaaggagattaaagggacatgtcaagtgtatatgaactatctcagatttgctttggttttaaaggacattactgggacaactggaaaaatatgaatagggtgtttacataataatactatatacatgtttattttcagatgacagttttactgtggttattgaagaaaatttccttgattttaggaaatatacaataaattatttagggttaaataaatgtcatgtctgaaacttactgtcaatgggtttaggaaaaaagagtgtgtgtgtgtgtgtgtgtgtgtgtgtgtgtgtgtacagagggcatagaaattatagaggaaatgtagtaaaatgttaaattttgataatcttggcgaattgaagcatatagtaattatactattattgcaactttctgtaagtctgaaatgatcataaaagttaagaaagatgcacctagttaaagtttctatccattaatatataatcagagggcaaaatagccacacagaagcagcttcaaatactggtgtacattcaatgtgcttactaaaacacatgatatagcattaatgttttacttgtttacaagttgaattgatatgaataccgaagacttgtatttttcctgttgaaataattgtaggtaagctagtagagcttatgggttccacttttagaataacatacaggttaaatattttctatacagctactggttgattaataacctcaataggatttttttccccacctaacttcctttgacgtaaaacaatgtttgcagaattaaagcagttttacaaaagaaataatgttgaccatataaccgagacttcatcaagccactttaatttctaaataatgatgttttatttgtttcttgcacttggaaattttgctcagtgaattgcccgacccaaaccttcaattgaatgtcttttaaatagtttgtactcaaaaatggcattttcttctttcagaaaatattttgttcttcaagtatgtttttgaggttataaaataagagatgcaaagcagaattcataatggttattatctggcataaaattgtaataacaggtgttccttgcagattccaaatagctggactgtaatggggaaccagatttagtttgtaatgggctcagtactgaccttccctgctgcactacctgtgggcatcttgctaacatgataaaatggccagaatccgagaagcacctttgtttatggggttggatacttgccatatcttcaaatataataaccagcatccaatcaaaaatgactgaagcataagagtgaaacagagtgcataataagagtgtgttagagtcatttggtgtgtgctgattttaaactcatttgacatcctgttctctgattaaatccacgcaagccccttttatgactatttttacaactgtactatctcagctctacatggctgagtcattatcaaacaatatatgaagccatgagaaacccagagaaagatggaaaagctttggtattatatgaagaatacaatgaagtagctgtccacagcaataaagtcacagatgaaaaccagatataccagtctagtttattaactcatgttcttctaacatatcccccacacaatatgagtgaactgagccttgtttttttgttgggaagtataataaataaaggatgaaacagacgtgatgtttatatgtaatgccaagttagttagctcaaaatttagattgagaaaaagaactgactacaaaagctttgcattggaaatttacatgacgcagcaagaattctgagctcagagctgcttctcccataaacttttgagaatcaaagactgcccttgatcacaaaaacttaccgtagctagctttttgattttgacccaggaaagctcattgaatgcattctaatgtcccatcagttttggaaaagtggtagtgaagcttcttcgaataggggcttccagtctactctttaaatggggcaaatatggacagcagcataaagcactgagggtgagtttttattcaactcatttcattcaatatgttagaattattgtagctgcttcttatgcatctcagattagaactgaaccatctccaaattgcaccctgctaagcagcgccgagccaagtaaaatgttgctacatgaccccagatcagaaatgctaaatcagatcctgccacactgtctctcagccttcccaaatccacttggctatcttctgtaaggaaaagttagtgtcaagaaagcaaaaacaactttcacgtcatcccctgtgaggctgtctcttcaggaagtctataatcagctgtcctctggtgtagatttggtgattttatgtataaagtcacttagcttgttttctcctggctttagaacctccaacatttcctttgcaatctctgttctccaccttcatatccatcaaattctggtcattaaatgtctctggttggcttcctactcattatgccttgttaccagatgaaaaatatgcacacagtcttcatgttcaaggagaacctctgtagcctctcaatttcttttttttcattttattctattttaaattacacataattgtatatatggggtacagtgtgatcttttgatacatgtgtacattctgaagtgattaaatcaggataattagcatatccacctcctcagatatttatttgcagtgataaaattttaagtcctcttttagctatcttgaaatatacaatgcattattattaactatcgtcagcatgttgtgcaatagaacacaaaagctcattcctcttatttaactaaagctttgtacacttacctgtttctagaactcttgacttacccattctattagtttcctaggactcttgtaacaaagtaccacaaactgggtggcttcaacaataacaatagaacaccaaaactcattcctcctatttaactaaaacttcgtacgtttacctctttctggaactcttgacttcccattatattagtttcttagggctcttgtaacaaagtaccacaaactgagtggcttaaacaacagaaatttatcgtcttacatttctggatgttagaaggccaaaatccaagttggcaggttgattacttctgagagctgtgagccactgttccatcctattcttctaccttcttgtggtttgcctgcgatctttggaatttccttgggttacagcttgttgccttcattttcacatggtgttctgcctgagtgagtacatgtgtctgtctccgcatttcctatttttatgagaataccagtcataatggattagggcacaccctatgaccatatcttaatttaactagttatacctgtaatgaccctatttttaaataggtcacattctgagctgctgaagatttaggatttcatcatttgaattatgagagacacaatttaatgcgtgacactcatcttgccacagtgtcttgaggccttccaccttttaatagcatatggcagatagtaatcagtcattcctttttagtacatttctgttttttacagatgtatatatttctgtctattctactatacttagagaaatattatgtatctttattctagggagatatgcacttaacaaaaatattaatatgtgtgtacgggcctaacaatgtgtgagattatataaagtataataatgaacatttcaaatcatattaccttcttttttaaattatcatccttacataaatcttatgatgttttcaagtatttctgtcttcatcattgaagctatgagaagataagttatatacctaaagagatcaaggaaagataggaaagaatcattgtaagtccactatgctcttcaaataatataatgaccagtatgaactgagataacctttagacagggtagtaggaatcactattgctactacccccatcattgtcactgctcttggtgggtctagatatgttttatatcaattatctgttttaatcctcctaaccctaagagacagctattagttgggtgcaaaagtaattgtggtttttactattacttttaatattattctcatcttacaaataagaaaagtaagactccaatgttggtcagggttatccacgtaaaatcaaacaccagtctattttaatccaaagctcatcaatgaaagctaaattttaggcatattaatgaacatgaatttgcagagtgtgtcgtttaaaaaggaagttgttttttttttaatattgagaatgaaaaaaaggcataatagcatcaatccagagtaaaggaagcccctagaggctgagtaggcagattctagggtttccatgttaacaggaacagtatctgatcagagggacagggctagacctaactgggtgagaagatggaatttcatagatgcactggttcaaagataattgagacttatgtggaaaatctccttttgatctactgctaacccaaagtctcctttattaacagttaatgaaaactgagccctataccacataccaatgtacacatgaaaaaagtgctcacatctttagttacaagagaaatgaagattgaaaccatatggaatgccaatatatatccactgaaatggctgatatgaaagaggctgacagtaacaaatactggcaaggatgtggagcaactagaactctcatgtgttataagtcagggtataaattggtgcaattactttggaaaagggtttgacaggtttataaaaggcttaaacacatctatgctatgactcagccattatgtttattatgtttgtacacaaaggagtttttccaagagaattgaaaacatgtctacaacaaaccttatattagttttttttttttttttttttttgagacaatctcgctctgtcacccagactggagtacagtggcgcaatctcgactgactgcaacctctgcctcctgggttcaagtgattctcctgcctcagcctcccaagtagcttaggttacagacccccaccaccacacccagctaacttttgtattttcggtagacacgggattttaccatgttggccaggctggtcttgaagtgctggcctcaagtcatctgcctgccttggcctcccaaagtgctgggattacaggcatgagccactgcacccagccagaatgttaatagctttattcaaagtagcaaaaatggaaagagcctaggtgttcatcagtaggagaatacataaactgttgtttattcatacagtagaatatgatgcagtggttaaaaatagcaacatgaatgaatcttaatacatggtgagtacaggaagccatacacaaggaaatgcatactgtttgtattcacatacaacaccaggataggggaacataatctatagtgtaataaatgaggtaagccattcttttgggggcaggattttacaaggaaagaatataaggaaactttctagagtgataaaagtattttatatattaataggattatggattgaactatatactttccttttaaatttcaacttttaggatcacatggtacactgtgcaggtttgtcacatgggaatatttcgtgatgctgaggtttgtgttatgatcgatctcatcacccacgcagtgagcatagtactgaataggcagtttttcagtccttgccccactcttttcctctcctctctagtagttccagtgtccattgttcccgtctttatgtccatgtgcacccagcgtctagctcccagttataagtgagtacatgtggtatttggtttttctgttcctgagttaatttgcttagagtaatggcctccaactgtatccatgaatgacatgatgtcattcctttttatggctgtatagtattctatagcagaactataccctttagattgttgcggtttaccatatgtgaagtattgttcaataaaaataatctttaagattatcaagctgtatggcttataggtagctcttgtgttgaagaaactactacatgtgaattcttgtgcttacccacatgctcgtgtaggaatgagcgcaaacacacaggaacaccatataacacatgcatgggaacatattccttatggggctgtttgttgttgttattttttttttttttagacaaagcctcagtgtcgtacaatgacatgatcatggctcactgcagccttgacttcccgagctcaggtgcttctcccacctcagccttctaattagctgggaccacaagcatgcaccatcatgccctgctaattttttgtatttttgtagagattaagttttgtaacgtggcccaggcttgtctcaaactcctgggctcgagccatctgccctccttggccttccaaagtgctgggattacaggcatgagccaaagcgcccagcctagcctgtttttaagtatgaaggataatgagacataaggtagattggacctataatgtcttctcagaaatcatgttaaagacccaccgtatgaaaacagttgggggaatctgcccttttttgcccaaagcagtcctcacattggctttactaccccctccccagcctcccacattttgtactttgctctggacatcctcacgagccagatcctcattgaaaatgagcccctttgaattagctgcttaaaaagatggagctaccatgatgccacaagaaacccagcttgtgcaaaggcagcactaattttaaaactcaagtgttatgtctgggttttttttttttttattaacctctcctagaactcttctgtgctgtcatacataaatcagaagattatgaaagaactagtcaaagtggctgtttccttctaaggctgtaatttggttccatgaattattaattattagactgatatggcatcagctcctcagaacccaatataaatgcaaaagcctcaccttatcagttataatctaaggagctgcagtaatgtcattcttcccatttagtggtgtgttatggggtttaggatattcaacccaacaaacttctgaaataaaatacaaagtaaaggatatttttgtgtgtgacgagatttgaaattcagtataaggaagcagatgtggattgcttcaagggttttgattgttttgaaggatggagttgtttcatagatgctaaagcaaataacagggcatgtaaaagactgtggttgaagaaaactgcctgaaagtaaagctttggaacatcttgcatctctgctgctgttagggaggaaataaataatgcaccatggattgaagttgtgctaaagatacattcagtatatgttgaaagcaaacatctgatatagtaagtatatttttcttatgcgaattacagctcttatattctttgaagcaagaactaaaaacgtattaattttttgtttgtttgttttgctggagtacttagctttaatacttgatgatgcctcccagttttctttggttctgtctttaatatgtaatgtcatgttattttaaaatgttctgaagaaaaaaatttataagcttaaattctgttccgttttgtgagcacaagattagtctccttttaggtgcaagtttttttttttagcagtttctggatattttagaagtgtgctcctcacatatacatacatctgattgtatcaaatacagactacagtatgcagctaatgttgcaaacgccacactgctcagcattgcagtataaagaaggaagtaacacctaagctgtaatgtagccaatggattgggggttctatgaatggaaattctaaccaagtagaaatatatgttggagttagctatgctaaagtaaatgtgttctgtttcactaacttagccattctaagagattatttagaaataattagtttgctaaatctctgcaaactttcatattattcatagaaatttcagtagctttgttactctgagcacactacagcaaccccagtgctctttgacttaaatagattacattttttaacaaattattttatggggttgaatttggtctaagaaaatgaagagtgtattcattctattaaaaaatggctaaatatgaaaatggcttgagtgataaaagtaccttgactatgctctactgtttctatatagtcagttttaagaaactgacaaattaaaaattttctcgaactctctgtaaagttaaaatattaaaagtcgagacagttttcttcattaggcctgagaggcaaaggtgtgatatattagcatttgaaaaataaataacagtgcatcaaaaattatgaaaacttttaagtatgcttaaagaataggatttatatccaaaaagtttcctgaaataaatagattgtgccacataatttatgactcattaaaacaaaaacaaaagatgatatttcttctttagtgtgaaataactcattttctattttaaattaattgctttctataggcaaattaggggcaaatattcatcagaatggcaattacttgaaattttttcatgtttaatatggtactgttttcagttcattaatactattgaccaacagctactataaaaaattaatacttttccaaatttactttctgtatgagagattgattcattatattgccattgaggggaaaaagctatgtagaagtaagtttactatggacaggtttagtcaatactgtgttgagtagactgtgcatgagatatagggtagatttagacctgaattaacagtgcatcagactatgaaattttgttcagtattaaaacaaaattatcttgataagcatctccaaaatcacatttctggcccatcattgttggggtgtataccacggaactgagagttccctgaaacacttggaaatgatcactgatctggacttgatcccaaatgatggggctcattctcctttcaattttgctaacttattttgatctcctgccttcagttttaccagagatttgaattatgtatttggatttgcaataaactatagaatatggaggctcaggcgtttccatatattgatttattacatacatcttaagttttaaattggccaaatcaaaggtagtaggtttaaaacccatatggtaacttaggaatcagacagcatttggggagaagcaacatacagaaaatatcctttggtccaacccagtcattaaaacaagaaagagctattgaactggggaaaaaaagaaagaaaagagaaaaaaataatatcctttaggttagagtgctggctttccccacccaatatctgtgtcagtttctctggggtccctttctgttctggtttgcccttactctgggttagtttagattccttatcaccagccatggtaagccatagtaagcatgttcagcttcctcacttctgtaccctatctagtgtcttatgttatttttgcccctgtaagtttgagccattgtaacttctgtggccatagtttcaagactatgcttatgatgtggatgaaggtgtttttgtttttgttgttgtttgtttctttttctgtgggataccttaggattcattcatttgtgatttcagaatggagtgagagagagctgtttttgaaaataagttatgctaacttactagctgttactagttacataagttctctgagtctctgtttttttctctatttgtaaatgaaaatgttaatattaactatcttatttgattattgtgagaattgaatgagataacacatgtaagatacttggaattcaccctccatatactaaatgctcaataaatctactatgttcgagtatgatatgaggaaggtttatgcttctctaaaaatcactgcaattaattctagtttgggttaataatggatttggtctgttatatggattctaagtggaataactatgaatgttatttaaatgtatatttatatcaatgaagagtgaaaatcaaatggtttcatcattaccagcttaccacataatcatgctgtggtggaaatctacttgtaaagagtaacctctgcatttttcttcagatacaatcaataaatgtgagtgatttcattacttatgaaataattcaggaagaaatataattgtgtgcatcatgtaatataattgaatgtggacagacaaaccaagactaattacgggcttgggttttcccaggaaatatttatgtaagtaacttctataggtggatatcagtcctgtaaggattttgacattcttctgccttcagtaatgcagcactttctcatcttcaagagctagctcatttgtgaagctttcctgtgtaaccctaccacgaaataatatttttctactttaaacaattctagtatcacaaaaccagaagcttgtttctgtgctattttgaaattttctccatttttccataatatatatgtacacacacaaacatacacacacatatgtaaaagaaatatatatatatatgtgggtgggtgtatgtgtgtgtatatgtgtgtggtgtgtgtatgtgtgtgaatatatatatatatatatatatacatatatatatatatatatatatctctttttttccttcttcttaaattttattacaagatattggaatcacatgcttaccatccacccttcctcctgccacttggtggatatttgtatttctgtagatacttaagtaaacaatatagctcagcttcaaaagtcttagttcaacaaatcaaataaaaagatgcaaaatgtaggtttagtaacaagttaatgttctcatgtatgagtaatggtgcaaaagccatgactattataattttttaaatatttgaagtgttgtacctataagcaaagaaactaactttgtggtggcttttatttcaagttttccaatccttactttaaagacatttggattatgctgtgcataataggagaaatactgccctatgttccaactttcaatttctaaatttatttatatattactatatataagtatattattcaaaccccatcacaggtttgaaattaaccctcttggggaacatcataatagttttcttcttagacttcttataggataggtgtgtattgggaaattagcacattacttatttttacacataaataatcacttcattttaattttctgctctgatttccacctttcaggtatgtataccagatactgaaatggctgatcccactttgatcacctgtattacagaattaggttattttccaaatttgacaaaattgcaattaagaattgcttcttagtagactttgcagagtatctgagttacgttctttggatctcatgattttagaaatgtttagagaacattttgttcattccactaatgggaagatagaccccaagaggtttctcaaggtcagagagcctgctagggaaggagtcagacccagaaatcaggtctcctgacttcttgtataatgtcctttttagtgtaccatatttcctcagtcagatcgatctactcgtccctgctgacattcagaaatctcccaggtatttgtagataatgtagctagtggctattttggagcatcagtctagaagttaagataataaaatagagttttcactttattatgtttttgtgtgtaaattatttcacaacttaaagctttatttttttctgtaaaataatcataggtttctaatattttggcttttctagttttctcaaatgacttgattgaagacaatctgagtaattcaagactagagaggcaaacaagaaagaaggaagaattatttcattcttattaggagtgaacagtgcacatggtttgaagttttcatcagggattccgaatctgttgtttctatagctaataatagattgctcttcagataggctgctaaactttgtagaggttaaaactttcaccacacgagtgtggctgtttgttcaccgcagtgcattgccaggtaaactttaaccgaaagctcaagagatttgatattttaatcctacaaaagcaattttgtttgccagcaaagtaatacctggatttttagtttctcagaggagctaggcatagaatttaaaatgtattagagctgcccttggggctaagaacatctgctggactgtagtctaataaaacagaatctgacaaagatgaggtctatgacatgtactctgctacaaccatacttgagtagatcaaacgggttggtttgacaaactgatcaagacaacaggcttatggaaactgcctcactaggacagctatcctcttccttcagggttctgccccaaatctcccttgcagctgaatttaatgggattttatcatatccccaacatgcagtctaagagctgaactcccacctcttttctgtttgacagaatctctcttatgagcttagggataaatattgggacttagaccaaacaaaaattggtgaaatttttggaaaggagatgtagatttaaacttagaattgtcaggttcaagtcttttcctcctccatctctgattttttattttagatttttaagtattatgaattcatagtagtcgtacatattaaaggggtacatgggatattttgaaacaaacatacaatgtgtaattattaaatcagggtaattgggatattcatcacctcaatttcctgtccctccatttatctgtattaggaacatttgaattccactctttcagttattttgaaatatacaataaattattgttaactagtgaccctacttgtgctactgaacactagatctttttccttctatctgtattttcgtactcgtttgccatccctctttatcccaactctgattttatctaagcctctcaatgtgtcttatatctactagtttcttataaaatatagtaatagcaattcccaccttctttatggtacaatgtttttctagggaatttaatatacctaaagtatatgaaagttctttaagcaggttataccttacgcagtacaaattgctgtgattgcaatagttccttgtgtatctcatcttttgaagagaggagtgtattaacttcctggagctgccacaaactgggtggcttaaataacataaatttattgtcttatcgttctggaggctagaagtcagagatcaaggtgtcggcagggttcgtttcttttgaggtctgtgagaatctgtcccatgcctttcttctagctttgggtggtttgatagcaatccttggccttctttgtcttgtatcacgccgagctctgcttaaaccttctctctatatactagtctatgtccaaatttcctccttctaaaggatgccagccatatttgattaggggcctgctctactccagtatgacctcatcccttacactagatataacctcagaattatatctgcagtgaccctatttccaaaaaaggtcacatcctaaggtactgagagttaggacttcaatatattaatgtgaagggggacacagttcaacacataacaaggaacataacattttttttgtctcactgttcttaacttactgctgcttttactcaaaaaatttgggatgaccatgatgtttctggatcttcccgtccctctgtccctgctcttcctgtaaatctcaacctactttctaatatatttcttgtataatctcaaagtacaagaatatgcataccataagataagcactgaataattgtaaatcactcttagtaaattagtagtctaggctaatctgattgtcagctgttaattttgtggtttctgagaatcatcaaataatgtactcaaacctgctgattgtttatatttttttgaactacaaagaactttcatttacagtattacatctaaaccaacatagttaatatttatattcttatcaaagatgtcaaacttcaggtgtagaggtgatgaaatgccaaaagtcacctggctagtaattaatacagcctgaattagattttaagagtttttaatttcaaacctagaattctttctgctctatcattatgctgctctttagaaaatgggtatagtaaggtttgtgacctctgtttgaaacccatggaactacatagtggaccctatgagtacagattgtccatataatactttctcaatttcttcacatcagacatttgtgatttctattatctatccacagtggttattgtgcatgaggctctatagttgacataaatagtgaaaagaattgtttcatttctctgaattgttgttctgcagaaacctcatgtatttgttttctagtgctgctctaatgaattaccacaaatttagtggcttaaaacaacacccatttattagcttacaatatttatggatcagaagtgtaaacacagcatggatctctgcttagggtctcacaaggcctacagcaaggtcgtgacaggcctttccccttcctggagctggaggagaaaatttgttttcagtctcattcaagctgttggcagaatccagcaggatgtgattgtatgattgaggccctcatattttgctggtttttggctggaggtcattctcagctcctagcatctgctcgcataccctggctgctggccctcttcaaagccagaaatgatggtagagttcttctcacattctctctgctctccctttctacctcatctgtcctgcctcaccttctcctccacatatttctgaaggaggctcttctgtcttccccttctgcttttaaggactcatatgattacattgggccaactgattatctagggtaatctccctgttgtaaagtcagctaattaatcaccttaattccatctgcaaagtcccttcacagtaatacttagatcggtatttgatagaataatcagtaaatgggaacctttgagggacagctctagaattcggcctataacatctcagtattttttttctttttgcattaagcattttcaaatcagttctttacccccaaaatcatgttgtttagaatgtactaggtgctttcaacttatgttattcttatggcatctgaatgggatggagacagtcatccccatttcttcgataagaaagtaaaggcaacaagtttaaaaggttttatcagatacacagggagtataatttaaagtatatcagagttcttctcagtgtaaagtacgtctgctagtttttaacataataaaagataacaagcccttattttattctttctgttttaatcatttatgtaattgacttgttctttccatatttcttcccaatgtatgaatcctatgagattatcatccagtttcagagcaggggcaggaattgtttgggggagtaaaaatacatggattaaatgcctagctcttggtcagtatggtacatatatttccaagctttgtttggtgagagagcttgaaattaatgacaacccagtagcaatgagcacacctaggactcatatcttggtatttaaatatcagttcttcaaatgctctttgaagtagctgatttcaaatctggggtagctatagtacaagatgagcctggagcaactttggcactaaaaagttagaaagtcctcaaaaagtaagagtgcatgtcaaaggacataggcactgacatgaaagaacccccaatgaccaaagctgcaaaattggagcaacccaattaataactatagttatttatttaacccatagaataaaatagatatatgcgaacccatactgttatagataggtagatagatagatagatagatagatagatagatagatagataggagtcaaggatcagctcttccttccagaagaattataattaataaatgaattatagaaggaataaaagaaattgaacaccatcatcaaaacactatgttaatggctgggcatggtggcacatgcctctaatcccagtactttgagaggctgaggtgggtgaatcactcgagcttgagagatcaagaccagcctgggcaacatggcaaaatctcatctctacctacaagaaatacacaaattatctgggtgtggtggtgcatgcctgtagtcctagctactcaggaggctgaggtgggaggactgctagagtccgggaggtcaaggttgtagtgagtggagatcacgtcactgaactccagcctagatgacagagtaagagcttatcttaaaaaaaagaaaaaaaacagggaaagagaaaaaaaaaactatggtaataattgttgcagatgagatacactggcatgctaaatcttgtggatgaaagttcaaaaaaaacatttcttactctcaaagtatatcctcccaaaatttattaattataaaggggaaatgttaaatttcacattggaaaaacccagcagataccaccttaatcaagtgatcatgtttaatatcaatggtaagacattttgacatcatgtacccctgacatgacacagtgagaagggcacatcagttctgtggtttcttgtgaaaaatatataacttcaatctcatcatgaggctgcaccaggcaaacctaacatgaaggacactctataaattaacttagcatcattcttcatcgtatcttcatatcacaatacaagaagaggatgttagtgaaaccattggtaaaatccaagtaaagtttatagtttgttccctgttttgataattgcactgtggttatgtaaggtatgaaccttggagaagctgggtgaagagtgtatgggaattctctgtactatttttgtaattttttaaaatataaagtaattttttttaagtctggctctctcattaaatagctttgtaatattgtacaacatacctcttttgagtctcacattgtccatctgtaaagtttgcctaacaatacagagcctgttacaaagtatgtgaaatctaacagagagacaatgtagcctcatagttaaaagcaattgctttgaagtgatataagtgtggttttaccagttaaaactgtggaggaatgcaaaacttacctaactttattaagcctcagtttccccatttttagtactcagatgcacttactgtgaatcttaaatatgatatagcaggtaaacatttaacccttcttagtaggagatgaactgagaatgaggaactacaaatttgaatccaaagtcttaaattccagttgcacttattaggatttttttacatgaagcagatattaaaattaagcatgcaagatatctttcttcgtctaactcacatattgaagtgaacaacttttatttagggagtttttatacaacagcggacaagggaaaatttagctcgtgttattttgaaagtggcaggaataaatgtttgattaataagattacaggcatatttgcatctggagagaaggttcataaaagagttatttttacttgtaatttatttagcttgaaacagagggaaaaaattgagattaatcagttgtcaaataccttctgagaaacccaaatatacttaaagaatcatgctgagatctgacatacttctaggtttttaaaggaattttttttttctttttgtttttgttttggctaatcagtttatgaaccactttgtctatgggtaaaccaagatctgataactctcagaacagaactttcataaatctgtctgtggaaaaatgcctcaaaacatataaaaatcataaaataaagggaacaaatataaagaacactggagagggatttgggtgttgtgtctgtatttttgcagtcttagcttcatgtgctgcctgaccacatacttcgtacttgcttcctcctctgtcatttgagatgttatttggttgtgagaaggtggaaatagcactgtatgttaaaattgattcccaaatgcgtcaaaatgtcgtatctgtggtctgatggacaacaaacaaatgcaatcatgaaaagttattcccatcctgacaagactttaagaaaatccactattttgagaatgggtaagttaaaaaattactacataaaataaatcttcccttcatgtaatattccctatgtgatgagtctaaattgttggcagccatactcctaataatacacgtatgtacatatctgtgtgtgtctatgcacattttaaatacttgtgacatatttatttaaagtttatttatgagcagtatggtagtttaaaaggattatgaaggtcattctgtgtgtcaaacgttgttttaagaagaaagtatctgaaataaagtagcacttatttgttgctttgtttttattctgattgcagacaactgtgtcatacagtatatgaccaagtagatatttttctgtacatcctaagagagggcttggactaggccatttctgtattgatatcctgagacctacatatccctggagaccaattacaaaggttcacaaggttgtttttattttgttttctcttgattcctttttaatgaggtctcccagtaaacagcaagcatgatgctttcctgttggaggcctgtctgccgccttcaaccatttattactaattcatctgggaaatgatttataaattaaatattaggaaaatgtacttgaggaaaaaagtggtaagaggtacaatttataattctcatttaggagaaagtcatgccagcagtttgctaatggaaggatgctgagagtcactcatagaaatacagttgtggtttatgtaataaatagagatgtacatgaagagaatcttcaatgtatatttttgggcatgtgattcattttaataaattgtgaagacagaagttcccaatttttctcttcaagtgaacccttggaaaattgggaaataataaagagcagaagtgacctatcaatatgtgctatctcataactcctcctcatgacaaaaatatagtatttatcaatactaggtgaaaatagcttcatcatagaataaaatgtggtgttagtagatgtcagtgtcatcatagatttgtgcaagaagggattccagatgctattttagaacaatcttctcattgtacagatgatgaaactgaggtcatccctgtttatgacttacctaaggtctcataacttttaagatattaaatttttgagattatttataaagcttcaagatttatttttgcacttgtaggcagtttttgtatgaaagaaatctgcttttcagctaatcagtcagattaggattgtgtcttatgagaatatcttttacatttgcgttgttgaaggaagatgaacaatagctgtgtctctacacccagaattaaagaggaacaaaattatagctttggaatcatcttctaaaattttattaattccagggaattaaagcacactcatcttgcaggttttatttaataaaaacgtttgttactttttttaaagttctgagtaatttctaggtatcttttcttttcttttttttttttttttgagatagtgtctcgctctgtcgcccaggctggagtgcagtggcatgatcttgactcactgcaagctccgcctcccgggttcaggccattctcctgcctcagcctcacgagtagctgggactacaggcgcccgccaccacggctggctagttttttgtatttttagtagagagaaggtttcactgtgttagccaggagggtctcgaattcctgaccttgtgatctgcacgcctcagcctcccaaagtgctgagattacaggcgtgagccactgtgctcggcctctagatatcttttcaatactgctatagtggttgcattatagcaatcattaatctcaaagatataagcagtgaattcataactgtgaaatcataactttgtggttaatatttttttctgatcccattttaatctttttaaaatttcatttctgtttgaatatttagactgtacttgaatataaatttcaaacataattaagcacatgttatctttatttaaaagatgaggcatatgtatattatctatgtatacactatttaaatatgtccatgtatacataaaattatatgttatatgtaattttctaaattatatatatatactgaaacagacagatacagtttatggctgatattttctggtgaaaataatttaccagtatgggtttgttggtgtctggctgtcaccactaagaaaagattctactgggtcattataaaaatttcagtttgggggaatgttaatagaaattagccatattatagtttggacagcacctatatgcagtttcatttaccgatattaacttagcacatgctggtttatgaggggaaacagaattcagtggtgcacatttaatcatttttctttatctaatttaaatcatattcttcttgataaagtgttatcttggccaatgtaagaagatggaggaccctcccatgaactttgtgggacagacactgaaaatctgtgttgacagcatgtctctaactcatccttctcacaacatttgctgttggaatagaacagagaattctgtaagagtcatagtttttagataaagattgttacagaggcataataattccagaagatttccatcttctaacaatctcttgaaatcaataataaagacaatggctttctattcgtccactttaccacatcaggcagtggaaatagaaaatgatataaaattaatcccttctcttgacaattgtaaaatggtaatcctccattttatcctctcagaggatatttgaagataacttttttattatcctattttcatattctgtctcataacctcatatattgtatagcccatttcattgctggtggtcaaataagactgcggtagaaagccacaggtaggttactagggttctgaagaatgtatcagcacagaaaaccaatttcagatatattttcaatgttattgctttagaatacatctcctttactgagacatcaaaaatcaaagactagatgagctcattcatgtgaataagcttggggataaattacctctttctagtttcatattaaaagagcagtagcatagtcagcctgactgtgggatcttggtcaagcaaagctaaatgttcttttcctaatttttcatattatttaagtgtagtgtcagaactattccttagtgtctttgttagttttgctcttaactgtagtctcatgtgttcagaatgagcaccagccaacaaatacagacaaatgcaatatttcaactgtactttacatataaaaagatggtgttaatacactctcttctgtggttattatgtagtttacttacaaactgacatgcatttttctcacttataagtgggagcacgtatgagaacacacagacacagggcaacacacactagggcctatcggggtcaggggcaggatgagggagcacatcaggataaatagctaatgcatgcagggcttaatacttaggtgatggattgataggtgcagcaaaccaccatgatacacatttacttatgtaacaaacctgcacaccctgcacatgtatcccagaacttaatagaaattaagctaaaaagaagaaaaactgatatgcatgatgcatgcttatttcttcagaaatattgagatgtttatttaatagatgccataaagctacctgaaatctaactaagagaatcctagtttactgcatttgttggcaaaaaagtagactattgatataaaatattttgaagttgcagccttacatgattgccctgtttagttttttggaatgtcttttcataaggaagtttgattctttaaacttggaattccaaaattcccagtactttcaatcaatggactaatcgcttccctgcctgctgcctgcctgcctgccttcctccctcctgctctttctttcttcctttcctttataataaaaaatcaagttattggaaaaagtattgagtcactttattctttgtgtcttactatgtaagtttcaaatttttgtgcctttttgcttttattctgtcgttgctgtatttcgaagcatcgttttccccttttccattgagatgtagtatacataatgtaaaaaaccccttaaatattacgtttcatctattgctccatatatgtactcatgtaaccactaccttgatcaagatagagaatatttccattaactttaaaagttctcttttactccttgtctgtcaatacctcttctatcctgaggtaatttgtcttctgacttctatcaccgtagattaattttgcttgttcttggacttcatataggtggaatccaaaagtacgtactgttttatgtctggcttattttgctcaacatactattttttgagattcttttgtattccatgtatcaggagtgtgttcttttcattgctgtatattatgtcattatatgaatatatcgcaatctcttcatcctcctcctagtgatgaatataactgaagcaaatttacaaatactttttttttttttggaggcggagtttcactcttgttgcccaggctggagtgcagtggcgctatctcggctcactgcagcctcctcctcccgggttcaagtgattctcctgcttcagcctcccgagtagctgggattacaggtccccaccaccatgcccagctgattttttgtattgttattggagacggggtttcactatgtcggtcaggctggtctcaaactcctgacctcaggtgatttgccctcctcagcctcccaaagtgctgggattacaggcatgagccaccacacccggcccagtcaacagttctcgtgtcagatgggtgtacccacgtggggttgtggtttgctcttctaattcttatgcaatagtaatgagtctttaaaacaaaatcctgtgtttgaatgttcttgaaatctcagaaattatctagcaaataacagggcttttttttttcactgcatgtgtgcatcatacgtatatacctttgtaactgaaaacaaaaggtagaatcgtatagtagttaggatagaaagctgtagaatcagattgcctgaatttgaattacagatattctacttgatattgtgtgagttgaggcaatttatttatattagctgtatcttgctttttaaaaaataaaaaaggatattagaaccttcctcatagaattgttttggtgattaagttagactttaccttcagagtagacagtaagcactcaataaatgttaactgttattgttccaagtatgtacattatttttattcaaaaatgtgtgcaggattccatatgattctacaggattccatatgattctacatacatatgcatcgttaaaatgtactatgtagattaggttgatctaatgactgtcttctctaaccaaaattgtcagagggctaactcttctcactcattttggctcttgtatctctactttagtggaaccaaagtgaatgataacaaccagagagagattgcttcttgactacaaataatgagatactccagtttaaattagttcaacaatgttcttgatcaaatcattctcaatcacttattttcagaatccagatattactgctgtgaataacaaaagaaaactcaaatttctgttcttgaagcattaagcctcttgatattgggaaaatggtgttaagtgtgaaagaaagacagccatctaatttgttggacatctaggtgtgtcatgctaaattctttagatttgaaaaataaatttttcatagtatttttctattctgaaaatatttttatataaaccatgatttctttttttttttgagacggagtctccctttgttgcccaggctgaagggcagtggcgtgatctcggctcactacaacctccacctctcaggttcaagtgattctcctgcctcagcctcccaagtagctgggattacaggcacacaccacaacacacagctaatttttgtatttttagtagagacggggtttcaccatgttggccaggctttggaactcctgacctcaagtgatccacctgcctcggcctcccaaagtgctgggattacaggcatgagccactgcgcccggcccatgatttttaaaataacaaatttaaattatttttctgactacctaccatttatagctgtaagtgtggattctttcagttaaatatttaacgtgtttggtgccaacaactcagtatttagcctaatccctatttcagaatccagagtctatattggtgccattcgttgaataccgaggatggcacagagctaaacctccatcaccccatagacagtggggacagtgcctccagcatacgaatgatataggtagagatatggctgcaaaatggtagatgtgactttctgacttgagggatttcagggttttctaacaatgtaggatggtgggtagataccaaaggtccatggctttcatagaccagtgatgatacttgaattatttatgtaagtgtttcatccctcctattaaactgcaccttctttgggagtaaattttaggtattaatttgtttcttctacaccatttagcatattgcgtgcgcttagtagatcccacataaaaatttctcattaaatgaagtaagcatataagcctaaaaagtacagtgaaattttttaaaaatgccattttaaaagaatatgacaacaaaaatggcatatgtatgcattaaataaatatgtaaaatgactctcaataaaatgttaattgtgtagttatttttggctgggaattcaagtgattaaaacttctcttttttgtaattatatcacttgttaatagtaattgatattatttatattatcagaaacaaatgaatatgatcatagtagattataaaggaaaacataaacaaaccattaactgtagaaaaatcaaaattttcaaagctacttttcccaaaattatcatacctagacattcaaggagttgattttgttttgtatttaaatttttctatagtatggagaaagaaggaatattcaaaattatttttataaagccaccattacattaatacaaagatctgccaaacacagcccaaaagaatatttcagatcaattatacttaagaatatatgttcaagaatcctaatttaattcatcagattatttgtacattaaaggaaaagcacatagaaagaaaataaacattgagtgagcctcgttgcaaaactcttctgatatttcaaaattgggaagcagtttcctttccatgtaaatcattatttccaatatattaagtataatacaagtgtaggtttaatcaatttctattttggtaactcatttaagagcatcactattttttatactgtggatgaggtattctgacttctcagttgccttaaaagagtgccagggagtcatactgcagtgttaaatgtgctcttctgccttgcattcatgctaagaaaaccagtgtctattatgtggctcctcgctttagccttctcagcatgaatgaccattcaaggagcaacagtattttataaaagtattgattgtgttggtttgtaaagggccccataatgttcttcccacatcaaacctgtgctctctgtgtaagagaaccataatagctacagcctcctggtaatgtatatgaattgtacagaatttcagtttatggatcagctttgtaatagtgcagagtttcacttggcttaaccaggtgtgggcaattgttgggtgcctttaaaaagtcataacatttccagggacagggatgtaatgggtcattttataagaaagaagaaaatgtattaaacgtaccacattatttttagttcaatggtaggtgtaagacagaaagtacgtttgcttggtatacatttctgtgggacccagtgtttggctttggtctgctaatttcctttgccttttcctatttaagtttttttcttttattcttctattaataatatgatttctataagtttcagaaactttctaaacaataaagtactccatttctgcactattgaggttgatgttggccttatttattctcaccttttttttaaatttggtttttgatttgggatttggggtggcgctggcttattagcgttcttggttgcagcacattttcctccttcagtaacaactctagaagcttaataaccaaagttataacctacatttgttttactgtgctctaatactcttaactaccgggcagatttcagtataaggtgaattggcatgagaattgtttagtcaatcaatagccatttaataagcatttggttacatgttttggaatttttaagagacatataagatactagtgtgccatgttctcacagagtgaacaatctagggaagcaagaaatatatatatatatatgacaatggttttaggtaataaaatagaacttttaaaataagttataagcttatttcctcatagtgatcattccatatcacaggccacctgcatcctccataaaagaataggattcttaaatttgatgtttaatagattgtgtcactttacattagccctaattaactttttcctagtaattttgtgaccttcaaaatttacttaatttatcaatgccattagtttttcatttttaaattggagatagtaggaatatctgcgttatataacatatgtaaaatgtaatttaaatatacagaaatgaaaattgggaggtaatctaaccatcttgtgttacatatgaggaaatcaacacactgaagtaggaggcttccccaaaatggaatattgagcttcattagtggatattacatttgttgactcttcatgtttcctcattggagtttccagatgccactcttgcttctgaaaatcgtgtatgacttgtgatgtaacaaaaatcagagggctttccagtgtcgcaactttcttttttttaggacggagtctctgtctgtcgcccaggctggagtgcagtggtgtgatctcagctcactgcaagctctgcctctcgggttcccgccattctcctgcctcagcctcccgagtagctgggactacaggcgcctgcaacctcgcccggctaatttttttgtatttttagtagagacggggtttcaccatgttagccaggatggcctcgagctcctgaccttgtgatccacctgcctcagcctcccaaagtgctgggattacacgcgtgagccaccgcgcccggcccagtgtcgcaactttctatggtataagagttactttgtttagcagaagtctcacagtttgagaattaaccttctcagtggagagctggcagactggttataaataagggcttcagctcccttagtgtgggacatgctgcccgctcccttcaggtacttatctgtcctggaccagacagaagcacatctgcttttcatttagcttacttccatttctccacttcctctcttttgtcagtgttaaagcttaaaatgatgaaacaatccagcagttatccaactacagataaataactgctggactgtatcatcgtagacagttggtgaaaaattctagaccagaatccagtcccttcagtcttgtattctttctaatgtattgagaacaagacaggaacattgattacctatttttagctggtttcaaaaacagtaacctcaattccacaatcaagatttggattcagaaatactgagtttgcactgagctctttcctgcttcactttggggtcatgagaaaggctgtgaatttctgcttcattccgattccctcattttaataacctgccaggagacctctaggggagtgattgtaataaactagctaataaaatgagattagaaccttcaaaactaaacatcctcttatgatacaatccagcaatcacactccttgagatttacccgaaggaggtgaaaacttatgtttacataaagacctgcacactgatgtttctagcagctttattcacaattgccaaaacttggaagcaaccaagatgtccttcagtagatgaatggttaagtaaactgtggtacacctagagaatggaataatatttggcactaaaaagaaatgagctatcaagccatgaaaagacatagaagaaacttaaatgtgtattactaagtgaaaaagccaatctgggaaaaaagctatatactttattattccaactatatgacattctggaaaaggtagaatgactatgggaagagtaaaaagatccgtggttgccagggatttggggtgatggagagattaatagagcacagaggatttttacggcagtgaaactaatctatatgatactataatgatagatacagatacatgttattacaaatttttccaaaaccatagagtgtaaaacataagagtaaaccctaatgtaaactccggactctgggtgataatgatatgtcaatgtgggttcactgatgataataaatataccgctggtgaggtatattgatagttcagagaggctgtgtgtataggagggcaggcatatatggaaaatctctgcaccttcccctcaattttgctgtgaacctaaagctgcctagaaaaaataaagtctgttaaaaaatcaccacagaggcaaaatgtgagattagaacaacctcttcaaaataatacacagaaagtatttacaaatgctaactaagacatagggttcaaaacgtaaaactgctcacagcccaggtactaaaattagatcaatctaatcattagatactcaatcattagatacaatagaatttgccccagtagcaaatgtttacttttgattctgttatacactacttaacatggtccagtgtcagcataaggctgtaatttggcgattgcatttctttatttaataactgctgataaagctgaaataaagaatcagtaaaaaggtttcacttttgtaaagcacatccagggtttataggaaaggaaatatttcagcatttctgatatataaaagaacaaaggtgttatattaagaaaaaataatacataaaacaatatcagggacattgaattgatgaaagtaatcagtaacattttaaatccatgttggcttgcattgtgaaagaagggaataatttacagttcatgatatttgtatttagatgtttgtatttttattgtgtttagagaatcccaggaaaggaaagaatcctacaacccgtaggatgaaaaaagctttggatctcatgccaggacaagggcactgatgcccaaaaagataaaggccttcctcagaatcttatgggaaaagtcaaattatttaaaattagctccagggttcatgagtaagattaattggtagaagttaaatggctatatggttcacgtttaaaaataatttctaaaaattggataccccttatgagagaaaatataagtggctttgagtaatagtttatattccaattattgcaagtaatcaatcatataccaggtaatttcctgacatgagttacataccaaaaattatattggatgaaaagctcgaatgaatataggtaacattccactctaatgtagctttctgtatcttagaacattcaactttattaagactttatagtttttaggaatagagttaataaagaacttggaatcttctatcaagaaataaagaggtgggagtggggagatctacctctggagattctcatgtgttcaggatatattcaacgtttatttgttcctaggcagggtacagaataaactgatacccgtaagtccattctagcccaatgtttcaaaaaatgctggcattttagtgaaatgtaatatggataacataaggtaacattgcgaatagtgaagtctgcaactaaaagataaagcatttaaatgtcaaatagcattgtgtaaataaatctaaaatgaaattttcaaccagtttttaaaacttacttccactaacaaacataacatagtgtcatgcagaagatgatgaggaagcaaagaatatgttaaggaaacctgtagaaaaccaaatgccttcttgtattaaatgagtttaccatgtctttcaaggaataatcatgtttatacaaatgtgtgtggtttccaggacccatttttcttttccttccctatacatgcaaacatatacaaatatatcagctcacatacttatttccctgtggtttcagactattaaatgtttataattactctgcttgatgactgtaatttttagttacagatcgaattgtcccaggtgtggatgctgccaaaagccacggtcattggcaacatgacatctggaagacagtctggcatgtagagtcagggaatttgctagaagttgttcctcatacagtgcaatagtacaagcaagcattgtgactccctgcagctggtgctgtcagtgccctatccatatgcctcagacctttaattgtgtttctgaggaatgcttctaactcctagtatctgcaggtttgttcctcagcactttttccaaaaactgtgggaaattgcactgcttatatgcacaagtgagcttcatataaggagaaagaaaaccctctaggaatagttcttaattaatgactctcaagaggtgctgtataaataccaacttctctcacctctctggtgggataactctgtgaggtgtgctttatgtcatgtcagagtttctctgcaggattgcctgctatattcactgcttgaatagaaaattcttttttttttttcctttgagacagagtctcactctgtcccccaggctggagtccagtggcacaatctcgggtcactgcaacctctgcctcccaggttcaagcaattcttgggcctcagtctaccgagtagctgggactacagacatgcactaccatgcccacctattttttgtatttttagtagagacacggattcaccatgttggccagactggtcttgaactcctggcctcaagtaatctgcctgcctctgcctcccaaagtgcattgcagctgtgggccaccgcgcctggccaaatgttctttactggacgccttcaatccccttgtcatttcctcattttctttctggcctgcacttcttaaactagttacactgtaatacttgttttagagtctgcttctgtgattaacgtttctgatcagtaaaatggcatagcactgcttacctcaagagatggccgtattttgtcagagaaagaatgtacttcacgttttgcctaataaagtaaacgttcaggacccagcagttgcattttaaatgatcccagtgtttgccctgtttttgaagtacacatgtgcttctgggaaaactcaaactaagacacaccccacacccaactggcaaacacatgccctgttgaaagagtctgcagaagagtccttgcttcaggtacatttttcacattccagtcccagtttagccctcccccatcaccttaatgaccaccattgcataacaagcaatgccttcttgtgaggcattagaggtgactaggagtgagctttagggtgggtacccttcagggggtttctttttttttttttttccttgactaggagtctggctctgttgcccaggctggagtgcagtggcgtgatctcagctcagtgcaacctctactcacgggttcaagcaattttcctgcctcagcctcccgagtagctgggattataggcacttgccaccatgcccagctaatttttgtatttttagtagagacatggtttcaccatgttggccaggctgatctcaaactcctgacttcaagtgatctgcccaccttggtcttccaaagagctgggattacagatgttagccaccgctcccagccccagccttcatattgtttatcttgatttcttttttcttctctgttgtagtggatagcaccagacaatcagtagttgaagcccttttcacatcttcactgggcattctattaaatgacatatgtgttctccccaaactctaacatctgttcattgaaaatagggcaaacaccaagaccatttgtaatacaattgctgactattgaatatttactttgttagaaaaaatgctaagtactttacaatatttctctgcaataaaactcatcttttgagctaacaatgctattctcattctactaaggagaaactttagtcacagagagattaaataatttgctcaacaacacacaaggaagtaagagtctgggagagaatttgtacttttcccttccttttagatgtcattcataaaaaaaaaaaattagtgtacctgattttgtactcctagccactatttaatcctgcctctgtaattagcttttatggataagtttatctttccgtactcagaaaataaaatagtaaaataaaaaggcagcacaaggtgtcactaagtggctttcaccagaggtgaagttgtacagaattagagaggggttttaaccacatctagagcactgcccatagaggaatgcagaccaatttctgaagtcaatttgtgttatcccctgctccttaacctgggttccaataccagttacatttaaggaactctccttccccctctttccagacatttccatggtagaaacacagtagtagttcaggagttaggagacctgggctttagagctttttataaaatgggatgtctgaatttgatagtgtgcaatgttccttccaactccaaacagatgttgtcattttcacagcctctagaagccacaggtaccttctcaattagaagttctaaatgatttgtaatagtgagcactatttggattcctgacagcctatatcaggaaaataagcaaagttttggatcaagtgcttatatctaaagccattgctttataagctggtcttcactgccaattccttcttccctatagattgttggtatttctggtctggatgggttacaagaatttattttattgatttcctgaatctctgtacatccttaaaataattcagaattggaaagaaatacatttagctctttgtcacatagtgtagagatcttttgacataaagagagagctgctgatattctgtttcccctaatgcctgagtgtggcatggtttcaaagggttgctttatcacatgtagacatggagggaccatcaggtaatgagatataacatttcctggaaattaattagtggtgtgttgtccaggaactaaatttcttttactcctgtttgccacctgtcctggatgtctagtgccgaatttgaatttccatgccaaactgaaaaagcagcattggctttagttgccctctttttcacattaacttagggttttagcatgtaaagcgactgcgttgttttagtggaatgaacttagaatgaacttcaacagtgatgaactgataaccaattaaataaataattgattcatctgagaacagtctgactcctagaagtggtgttcctaagaagcttttgtgtaactgccctctggaaagcctcacaagttgttgcctttctttctttattttttccaaatggacaatttttgacaaacaaacttctaagagcagtcaagtgtcaaatacaaagttatggctggtgcagctgcctttgggatcacacgctccatttattcattatagaaagctcagatgcacaaacatgtggtgccattttgtgtacctgtcagtttagtgcgtttaatgaacattgatcatgctcatccagacacacttctcgatgctgcaagcaggaagtcagtggtttctgaaagacagggtgaaaacttgttttttttttttttttcaaatgtgcctctgtggaatcctttttgcccaaaatagatgcattaataaacatgactaaaatgtaccttaaattcactacaaaagagaaaagatgttgatgaaaaatttgctctggttttgctaatattaagtccagtatttgtctacttaaagtagaagttttgatgacttggataatcattagattgctatctagctatttgtagttttgtagcatcatctgttccaaaactgattttttgctctcttttaataccctgttaattacaaaacctcctactgggtagttttaccatacataaattctgtcaagtactgctgaattaattggtgccgaacatcgttccggtctatggtgggagtaatagttcttattttcttgccttttaatgtttggacacaggaaaaggaatatcacacaccagggcctgctgtggggtggagggagggggttttttttgattaggcaacatacctaatgtaaatgacgagttaatgggtgtagcacaccaacatggctgtcaaaattcctttcaaaattctcataaaagaggtagtttagcttctttttttaaattgtattatactttgagttctagggtacatgtgcacaacgtgcagggttgttacatacgtatacatctgccatgttggtgtgctacacccattaactcgtcatttacattaggtatgtttcctaatgctatccctcccccctccctccaccctacagcaggccctggtgtgtgatgttccttttcctgtgtccaactgttctcactgttcaattcccacctatgagtgagaacatgtgatgtttgtttttttgtccttgtgatagtttgctgacaatgatggtttccagcttcatccatgttcctacaaaggacatgaactcatccttttttatggccgcatagtattccatggtatatatgtgccacattttcttaagccagtctatcattgatggagatttgggttggttccaagtctttgctattgtgaacagtgccgcactaaacatatgtgtgcatgtatctttatagcagcatgatttataatcctttgggtatatacccagtaatgggatgactggatcaaatggtatttctagttctagatccttgaggaatggccacactgtcttccacaatggttgagctagtttacagtcccaccaacagtgtaaaagtgttcctatttctccacatcctctccagtacctgttgtttcctgactctttaatgatcgccattctaactggtgtgagatggcgtctcattgcggttttgatttgcatttctctgatggccagtgatggtgagcattttttcatgtgtctgttggctgcataaatgtctttcttcttttgagaagtgtctgttcatatcctttgcccacttgttgatggggttgtttgacttattcttgtaaatttgttagagttctttgtagattctggatattacccatttgtcagatgggtagattgcaaaaattttctcccattctgtaggttgcctgttcactctgatggtagtttcttttgctgtgcagaagctctttggtttaattagatctcatttgtccattttggcttttgttgccatttcttttggtattttagacatgaagtgcttgcccattcctatgtcctgaatcgtattgcctaggttttcttctagggttcttatggttttagatctaacatttaagtctttaatccatcttgaattaatttttgtataaggtgtaaggaagggatccagtttcagctttcaacatatggctagccagttttcccagcaccatttattaaatagggaatcctttccctatttcttgtttttgtcaggtttgtcaaagatcagatggttgtagatgtgtggtgttatttctgagggctctgttctgttccattggtcttcatctctgttttggtaccagtaccatgctgttttggttactgtagccttgtagtatagtttgaagtcaggtagcgtgatgcctccagctttgttcttttggtttaggattgtcttggcaatgtgggctcttttttggttccatatgaactttaaagtagttttttccaagtctgtgaagaaagtcattggtagcttgatggggatggcattgaatctataaattaccttgggcagtatggccattttcacgatattgactcttcctatccatgagcatggaatgttcttccatttctgtcctcttttatttcattgagcagtgctttgtagttctccttgaagagctccttcacaacccttgtgagttggattcctaggtattttattctctttgaagcaattgtgaatgggagttcactcatgatttggctctctgtttgtctcttattggtgtataagaatgctagtgatttttgcacattgattttgtatcctgagactttgctgaagttgcttatcagcttagggagattttgggctgagacaatgggattttctaaatatacaatcatgtcttctgcaagcaggggcaatttgacttcctcttttcctaattgaatgccctttatttccttctcctgcctgattgccctggccagaacttccaacactatgttgaataggagtggtgagagagggcatccctgtcttgtgccagtttgcaaacgaaatggttccagtttttgcccattcagtatgatgttagctgtgggtttgtcataaatagctcttattattttgagatacgtcccatcaatacctaatttgttgagagtttttagcatgaacggctgttgaattttgttgaagtccttttctgcatctattgagataatcatgtggtttttgtccttgtttctttttatgtgatggattacgtttattgattttcgttatgttgaagcagccttgcatcccagggatgaaacccacttgatcatggtggataagctttttgatgtgctgctggattcggtttgccagtattttaatgagtatttttgcatcgatgtttatcatggatattggtctgaaattctcttttttttgttgtgtctctgccaagctttggtatcaggatgatgctggcctcataaaatgagttagggaggattccttctttttctattgattggaatagtttcagaaggaatggtaccagcccctctttgtacctctggtagaattcagctgtgaatctgtctggtcctggactttttttggttggtaggctcttaattattgcctcaatttcagtggctgttattggtctattcagggattcaacttcttcctggtttagtcttcggagggtgtatgtgtccagaaatttatccatttcttctagattttctagtttatttgaatagaagtgtttgtagtattctctgatggtagttaatatttctgtgggatcattaatgatatcccctttatctttttttattacgtctatttgattcttctctcttttcttctttattagtcttgctagcggtctatcacttctgttgatcttttcaaaaaaccagctcctggattcattgatttttttgaagggttttttgtgtctctatctccttcagttctactctgatcttagttatttcttgccttctgctagcttttgaatgtgttttctcttgcttctctagttcttttaattgtgatgttagggtgtcaattttagatctttcctgctttctcttgtgggcatttagtgctataaatttccctctacacactgctttaaatgggtgccagagattctggtatgttgtgtctttgttctcattggtttcaaagaacatctttatttctgccttcatttcgttatgtacccagtagtcattcaggagcaggttgctcagtttccatgtagttgagcagttttgagtgagtttcttaatcctgagttctagtttgattgcactgtggtctgagagacagtttgttatacttcctgttcttttacatttgctgaggagttctttacttccaactttgtggtcaattttggaataagtgtgatgtggtgctgagaagaatgtatattctgttgatttggggtggagagttctgtagatgtctattaggtccgcttggtgcagagccgagttcaattcctggatatccttgttaattttctgcctcatggatctgtctaatattgacagtggggtgttaaagtctcccattattattgtgtggatgtctaagtctctttgtaggtctttaaggacttgctttatgaatctgggtgctcctgtattgggtgcacatatatttaggatagttagctcttcttgttgaattgatccctttaccatatgtaatggccttctttgtcgcttctgatctttgttggtttaaagtctgttttatcagagactaagattgcaacccctgcctttttttgttttccatttgcttggcagatcttcctccatccctttattttgagcctatgtgtgtctcttcacgtgagatgggtgtcctaaatacagcacactgacaggtcttgactctttatccaatttgccagtctgtgtcttttaattggagcatttagcccatttacatttaaggttaatattgttatgtgtgaatttgatcctgtcattatgatgttagctggttattttgctgagtagttgatgcagtttcttcctagcctcgatggtctttacaatttggcatgtttttgcagtggctggtaccggttgttgctttccatgtttagtgctttcttcaggagctcttgtaaggcaggcctggtggtgagaaaatctctcagcatttgcttgtctgtaaaggattttatttctccttcacttatgaagcttagtttggctggatatgaaattctggattgaaaattctttgctttaagaatgttgaatattggcccccaactctcttctggcttgtagagtttctgccgagagatcagctgttagtctgatgggcttctcttagcgggtaacccaacctttctctctggctgcccttaacattttttccttcatttcaactttggtgaatctgacaattatgagtcttggagttgctcttctcgaggagtatctttgttgcattctctgtatttcctgaatttgaatgttggcttgccttgctagttggggaagttctcccagataatatcctgcagagtggttttccaacttggttccattctccccgtcactttcaggtacaccaatcagacgtggatttggtcttttcacatagtcccatattccttggaggctttgttcgtttctttttactcttttttctctaaacttctcttcttgcttcatttcattcatctgatcttcagttactgataccctgtcttccagttgatcgaatcggctactgaagcttatgcatgcatcaggtagtactcgtgccatggttttcagctccatcaggtcatttaaggacttctctgcgctgttgattctagttagccattcatctaatcttttttcaaggtttttagcttctttgtgatgggttcggacatccttcttttgctcagagaggtttgttattaccgatcgtctgaagccttcttctctcaacttgtcaaagtaattctccatccaggtttgttccattgctggcgaggagctgcattcctttgaaggcaaagaggccctctgatttttagaattttcaggttttctgctctgctttctccccatctttgtggttttatctacctttggtctttgatgatggtgacctacagatgggattttgttgtggatgtcctttctgtttgttagttttccttcaaacagtcaggaccctcagctgcaggtctgttggagtttgctggaggtccactccagaccctgtttgcctgagtgtcagcagcagaggctgcggaacagcaaatactgcagaacagcaaatgttgctgcctgatcgttcctctggaagcttcgtctcagatgggcacccggccatatgaggtgtcagtcggcccctactgggaggtgcctcccagttaggctacttggaggtcagggacccacttgaggcggcagtctgtccgttctcagatctcaaactccgtgctgggagaaccactactctcttcaaagctgtcagacagggacgtttaagtctgcagtagtttctgctgccttttgttcagctgtgccatgccccgaagagttggagtctacagaggcaggcaggcctccttgagctgcagtgggctccacccagtttgagcttccttgctgctttgtttacctactcaagcctcagcaatggtgggtgcccctcccccagccttgctgccaccttgcagttccatctcagactgctgtgctaacaataagtgaggctccgtgggcatgggaccctccaagccacgcgcgggatataattttgctaaaaccattggaaaagtgcagtattaggatgggagtcacccaattttccaggtgccatctgtcacggcttcccttggtgaggaaagggaattcccggaccccttgcgcttcccgggtgaggtgatgcctcgctctgcttcagctcatggtccatgggctgcacctactgtcctgtacccgctgtccgacaatccccagtgagatgaacctggtacctcagttagaaatgcagaaattggccgggctcagtggctcacacctgtaatcccagcactttgggaggccgaggcgggtggatcacgaggtcaggagattgagaccatcctggctaacacggtgaaaccccatcaccctaaaaatacaaaaaattagccgggcgtggtggcgggcgcctgtagtcccagctacttgggaggctgaggcaggagaatggcatgaacctgggaggcggagcttgcagtgagccaagattgggccactgcactccagcctgggtgacagagcaagactcttgtctcaaaaaaaaaaaaaaaaaaaggaaatgcagaaatcacctgtcttctgcattgcttacactgggagctgtaggctggagctgttcctagtcggccatcttagaacctcccctagtttagcttattataattagaaggtgccattttttaataaattttttgtttgctgtgtcagtttttattgggagcaaattaccaaaaaaaaaaaaaaaaaaaaattctgtgttcaattagtttaccccagctagaggtgcattatatttagcaatgatttacttataactgttgtgtgggagaatatcctaatcagtttttggaaaaggctaagtatacctatattattctacatgtgttgttattttagcatttatatttcttttgattgagattttgtttcatcaccctggggcacaagatagctcaagaagacagatgtgctcaaattatgcaacagacttatctaaacagctcatgggtcttccaagttcctgatgaaaattagaattgaatcataatgctaagtgtctcacatatccaccctttagacttgatcatcttgtgaaataaatggagcattgcatccagtatgtggtacacttcaagaaaaaaaaatattcacctagcctttttgtggtctaagactctatcatttaaaaactttaaacaagtatataatgaagtgtattcagagatattcattgtagctttgtttgtaatatgaaaaaatcatgaataatctaatattctatcagtagaggaaaggttctaaaaggtatgggccgcacctgtactagaatattataaccccattaaaaataagataggccagtatattctgttatgaagagatgtgtgtgtccgtgagaaaagcagcatatagaacaatatgcatattgtgattattttcatttcataaatgcattgaaaaaatgtacttcttttttatatgtacgtgtatgtaggtaaatgcaaagaataagttttgaagcaaaattatcttcctttatggaggagaatgggatagggcacattgaaaaggtgcttttgatacaaacatctccacttttcagttttgcaaaagtgatgcattagactgaattttgtctaattgtgtgtaattgactttttttaaagaagaaattccgtggaatagataagaggaaccataattaatccaatcaactcagagggactgaacacgtgttatgtgtcagtcactatgcttgccgctgaggacacagtagagagcaaagaaacatgctggccctgacctcagggatatagaaactataggaaattgtataagtgtgcaaatttattattatgtaggaaaagtacaggaaattagaaaatcttacagttttctggtcagtgaagttttcctgaggaaggaatttttgcaccaacaactggagcctgaatcaaggttaactatacaaggaggttatttatgaagtcaaaacaattgaaacactaaagagagagttgggtgaataaacatatagagtatacctgagttaagtggaaattttaagaaataggccagattatctcatctatcttattgaattcaactaatctgtaatgccctgcaaatcgcaaaccatccaaaaagatgggtcactgtaactctcactgcacaaacaatgagccaggtaatattgaagccagaatatttttgtttcttcatttttgatttacttacgtagaagtggcccaagtgagtttcaactcaccatcacccacattatttgagtaactaaacatctgccattgcccaagccatacccaaatatcacctgaactaactctccctttctcccttccatcactgtgcttatgcattcatgtgtccaataaaatatttatggaacgttttgtatatgctagatgttggggaaagcaaacatggtccttactctataaatgtgtattctgttggaagaaacagacaaaaattaatagtcacaaaaagtgattaatgttatgaattaaatgattgaggtgccaagatagagaataaagaagagggcttattttagttgtttttttcagtgaaggtctctgaggaagtagcactgagctgagacttcagcattagaaagagccagatatgacagcatttctccccctttttaaagccaaatagtattccaccctgtgtgtgtgtgtatgtgtgtgtgtgcgtgtgtgtatgtgtgtatatatatgtgtgtgtatgtatgtgtatatatatgtgtgtgtatatatatgtgtgtgtatgtatatatataccacattttctttatccatttatgtgataatggacaccaagattgctttcatattttagctcttgtgaataatgctgctgcagtgaacgtggtagtgcagatatgtctggcacactaactgcttttttttttttttgatacggtctcactctgtcacctaggctggagtgcagtggtgagctcttggttcactgcagcatccacagctcaggcttgagtgatctcacctcagcttcccaagtagctggattacaggtgcacaccaccacacccagctcatttgtttttttgtttgtttgtttgtttgtttagttaagatggggttttgccgtgttgctcaagttggtctggaactcctgggctcaagcaatccacccacctcagccacataaagtgctggattataggcatgagccacagtgcccagcaaaacacactaatttcaattactttggacatatacccagaagtgaaattattagaatcatatagtaattctatttttagttttctaaggaactgccatactgttttctgtattggcttactaatctacattcccatgaatagtgcacaatggtttccctttctccacacctttgccaacacttcctttgtctcttccataattgttctaacagatatcaggtgatagctcattgtggttttaatttgtgtttccctgattatcggtgatgatgagcatgtttgcataaacctattggccatttgtatgtctactttagagaagtgtctatttaggtggctcatttttttattaggttatttgtgggtttttttgctgttgagtttcatatatattttggatattagccctttattagatgtatggcttacaaatattttcccccaatctgtggttgtctctttattagttgtttctttggctgtacagaagctttttagtttgatgcagtcccatttctttatttttggttttgttgcctgcgcttttggggtcatatctaagaaatctttgcccagaccaatgttgcggagcatttcctgtatgttttcttctagtagttttgtagttttcggtgttatattcaagtctttaatccattttgagttgatctaggtttacgatgtgaggtaagtttccaatttcattctacttgcgagtgtcttgccagttgccacaacatggatgaacttggaggacattatgccaattgaaataagccaggcgcagaaggacaaataccatatgatttgacttgcatgtggaattttacaaagttgaactcatagaagtagagagtgatggttaccagaggctgggggagggattggatagggaaaggggaaatgttgatcaaagggtgcaaagtttaatttagacaggaggaataagctttggtgatctattgcacaaagtgatgactataataaataataatgcattacatacttcaaaattgctgagtaaattttaaatgttttgccataaaaaattaaaagtatgtgaagtgatgaatttgttcattagcctgatttaatcatttcatattgtaaacatatttgataacttcacattgtaccccacaaacatgtataattattagttgtcagttacaaataaaatttaaaagaattgaacaaataaaatgtaaaaatatatctgtttaaaaacaaaaaagaaagaaagactctacaagaagagtaaagggaagggcatgtgcaaaagtcttgagctaggaaagaatttgggacattcagccactgaaacaaggagaatgtaaatggagaagcatagcttcagttgaacaaagattgtagtcccagattggtgcagcatctgaggggaaaacaatgaaggcacagcccttattgagacagtgaaagattagagtttgttttgtaatttccggggctggcactgtttttcttggaatcattgaatcttaggtgtggaagactctaaaaggtgatgtaattaggtcattttctctgttgcaggcactttatattggaggtgtgagtagctaaagttctctatgactacaatttttttccacaccttggagccgtttttgtgacagactcaaagacctatcatccatttcttccacgaaggcaatattgaatatatttggagcatcactcctgcctcttcctatatgctgttaattcatgtcgccagcgtcctaaatgaaagtcttcttcatatccaaagaatcttggcaataggaagcatttaaagtcgtcattattttaagtgaagctctcttaaactctgagacagaggagaataattctcttataccacaagaagggctttttcaaatggtcccccatgaaatctatttctgtgtctttccaaaatatgtgaagcagagagttgagccaattatctaaatcatttaagtcaaagagcttaatactaaagtgaatatcctgaattattcccatgattgtgtgtattattaaacaccattaattctaccaattaattaccaattcataaacttctaaaaaacttaaatataaatacagtcatccctcagtgtctgcgaggaattgcttccaggacctcccttatataccaacatccatggatgctcaagtcccttatataaaatggcatagtatttggacataaccaatgcacattctcctgtataccttaaatcacctctggattacttataatacctaatacagtgtaattctatgtaaatagttgttgtaccatttagggaataatgatgagggggaaatgtctgtacatgttcagtacagacacaaccatccaactttttccaaatatttttgatctgcagttggttattagggagaggccaactgtataagctgtatacaatctgtaatagtgaccctggcagcctgtttcagcaaggcttctcagttgacctgcagaacacaggaaattattttagttactcatcttcttagttctcccaaaaaatgctaatgctgttctgttagtattttaggtgcataagagaagcagataatctattacatacaagggatgttcctctatttagaaagcccacttaagaaaggctggtaggttatttaaaaataaaacctagacataaatacatgcctacatgcaatctgtacaaattctacagaaatcattttatatctatttactcttattttcttcccacagaacgtggagcactactatgatttctattcccttgtaattaatttctggttgtcgacttaaactgtgcctttattggcaaagtaaagtgttaaggcaattgaagagacaatgcaggtcaaaaaactgtttatatctctattagaggcaaaagctagacccttagtaaatgtctgttgagtgaagttgaattgaattagtttgagttgaattgaattgaattgctttgagagagcagtagctggagccaattatgactttatcctttggccagtattttcagctgaatgtttcaacaattattcattcaaccaacatttttattgagtgcatacctattatgagccaggcaaaaatgtggttcagggttgtagattcaaagattaaataaacaaggtccctagcttattattactcaagatgtacaaaggaagataatgccatccatgtgtaaaagtaaagagttgtaggcatctctcacaagcataagtaaatgagacaggaaaggcagtgagtgctataggagaaggcattctgaaggactcagcaactgattagagtctcaaggtatgaccttcctaatcagatgaggaaggacgtataattgccatttagtaggcaagagataatgttagtattttctcttaggtgttttttaagcttttaattattttattgaatctttctggaatcactctcttttggcctttggtgttgtggatgtggaaatagggtgttagaaaggaatcctttgtgattttaatgtttggttgggatgttaactgcaaattatgccatcaactctgacagctattttatatatattcattctcactacagtttttaatctctgatctgcagtttaatgtctcttatatcttttattttaagcaacttcatatatttccttcaaatatatatgaaatatatgtatatattttcttcaaatatatatgaaatatatgtatatattttcttcaaatatatatgaaatatatgtatatattttataaatagatatggaggtaaattggtagattgaaaataaaatatatgtattaagttgagaatataccttagaactatactttccttcttttgggaattggctagttgatttttctgatcggtttttttctttagagtatagaatggtggacttggagtttataggtccttagataaaatgtttactttgtgtatagattgcttgagacagattgtgttaagtgtttcttcatcttgaactttttttctgctttctacccatttttatgccagtggatcctgttcattgccaaagtgctcagacacatttaagaactgtatattcctcagtctcaattctagcgagtaaagggaagactctaataattaagtctgtttagttgacactttcataggtttttccctctcttggaatgctttagaagaaaagtttttataaagaaacctactccattagtgtcccttaaaatactgtataataaaataatatctattaagagactcagttatcttaattttcttcttgccatgtgatgaatgacagatttttactgccgtaaatgtgcattttatgtaaagccctttatattgtgaaatttaaaacatataatttcaaataatcaaaccccatatttctaaattcctatattttattccagaaaactagctacttaaaagcaattgaaaaaagaaaaaccctagcataagttctaaaaattttaacatgcaaaagtatcctttctatattgattaaaagatagatatacaaactcactctcaaccattctgatggaaaaaccctggcctgggctctgaagccattttttaaatggaaatcatgaatgattatgattcaggtggcttctagtacacactttgaaaaactctgaagcgtgaagcgtaatcgccaatatctttgaagattcatgacatttatattggcaaggaggaaaggggcacatggtgagctgagggagagttcgtgtagatgtctgggggtaatggcttgcctactttaccagttaaggcatacatcttgaaaataaatcagcattcaatggggtctttgcagtctttgatgtctcagtattaatagatccattcccagcatcaaaattggtactgcattatattttaagcctatgaggggatgccctgcctccagccagagtggttttgcctaccttaccttctaattttttaattccacttcttttcacttatgtttctattgacctccgcaaggtcatagactttctactctttcttaacagtttgttccctttcgccctttatttctttcaccagttctttaaaagcgttcagcattgtagaattttcaggatattcctttattttaaaactgtgttatttggctgggcacggttgctcacgctagtaatcccagccctttgggaggccgaggcaggcggatcacctgaggtgtcaggagatgaagaccaggctggccaacgtggtgaaaccccatctctactgaaaatacaaaaattagccaggcatggcggtgcgtgcctgtaatcccagctacttgggtggctgaggcagaagaattgcttgaacccgggaagtggaggttgcagtgagccaggatcaagccactttactccagcccaggtgaaagagtgagactctgtctcaaaacaacccccccaaaaaaaacctgttttgtttattcatttacttatttgtttgtttactttgtagcaggcccaaacaatgtcttttactcacacttcctattcagaattgtttgccaagataagaaataacaggcagaaagtcatgactcagtacagttaatgatattccaaaagatgctcagctcacatatggtggtggatctcccactggcttggcaggtgcggtaatagcaggctaaagaatgtggaccacggtctggagtctggttctcaagtgggcaatgagttttaaacaggatatgaagccatttctgattgactgatctgattaacatctgcagcagtgtttctccaggtatgattcacagagacgataaagatatactgtatcttcaattctactttttagagagaaaggggccactagctggatgaacactgggacagcaagtgcaaactaggatagtccaggctagactgtggccatggtcaccctgcttctcaactaccatacctagaatcatgggaaatgtttgttaaaattggagatccttaaggattactttaagatgtctgaaattcaaatgggaatctgcagtgcttcctgtttctgggaaattaaaacaaagataacttttatattagagcattaggacattagatgtttcaaagtgtgggctcctgaccaacaaatccacaccacctgataacttgtaagaaatgcagatccctaggcctcaccccagacctactgaactagaagctgggatggggccaggatatctgttttaagactttccaatttattattttgatgcatactgaagtttgagaaccattgttctgttggatctggcaaaccagtgtctttttactttattttatttttttttacttggtatcataataatatgatttttaaaaatctggatgttcttcccactagcatttcctcatgtcagtgatgatcgaattttaaccatcattgaaagaactatagagagatagctataaggagatatgaagatatgaatgttccaccttagcttgaattgtggtcatctgaagtatctgtgttcctctctctttctgtctctgtatgtgtgtgtgtgcgcgcgtgcttgtgtgtgtgtctgtatctgattctaaaatggaggaagaagacaagtctagtggcttggatagctaagggaaaggagtgaaaggaattatggagaagagaagagcaataaaacagagacaaacattgaagcagttgtcttcttagagggcctggttgtgatcctccatttccagtgcccgaggcattcagctctgcagtgaacaccaagatggtcaagttcaccagatctttagctcaacactctgaccattttaaaagcagtgccttttgaaaaaaaatctttgggagtaaattttttagttttagccttaggagtgtcaaaactagtgctagcaaaagcctctggcaataagtaaatgagattaacaaagccaagggaactgcacagaagtgttacaaacctgaagagcagttttctttttcttccataaatattatatttgtaaagatatgcttggcattcagtcatttgtccactgtccagatcactttttttaaaaaattattattatactttaagttttagggtacatgtgcacaacgtgcaggttagttacatatgtataccatgaaactggaaatcatcattctcagtaaactatcgcaaggacaaaaaaaccagatcactttttagtttcataccggcaaaggtacgagctgatggattaagtcacactgacctcagatccattaactgacacaacttgaaaatccctcatatgtctttaaattccaaatgtatgaatgaaattttgtgttgtcatttgtcattgtgtgtctttgtttagatatgaccttaatacatattgtgagcagataatttgtgaattgctcataattctcaagagttccagttcctctcttcacttttaatatgtgcgtgttgtgctaaagcttccaactgatgtcgtgtgagtgtatttgagaatagagacatgtgtttgtctttgaatgatggggtatctatacgttgcaaagctaaacattctgaattttttaatttactcatccattcaacagatgtatatattcacacatatacgtatatatatgtatatacacacgtatgtatatacacacatatttgtgtatgaatgaatatatgtgtgaatatatatacacacatatttgtacatatatattcatacatatataacaaatatattcatacatatataactatatatattttatatatacatatatacatatatctaacatatatgtatatatgtatatatatatacatgtatataacaaaaatatatacatatataaaaagattatatatgtgtttatattttcacacacatatatatttctatatacatatgtgtgtatatgtatatgtgtgtatatatatataaaggttaaatgagtattccatggccctgtatttgattaatggttaattcaggattggaattgatgcattatggtgaggtatatctactgtacattttgggcaccattcacttatatggtcatcagttcatttataaagtgtcactaaagacaaaatgagttgctgcattttaccttcagtaattacaaaataaaagaagtgaaaacatttggaaaaatccgagggagctcctaagaactccattattgggatgagtggactatgatatgcagtaataagcacatgtattaatatgtgattcaaaagtaacattttctatgaaggacaggtatcttatttaagcctcctgcctgtatgatctgattgaatcagcattgcttaccataggacccaagagaaataaaactatatttcccaatattatctgtccccgaaagagactcttgttcatggagaaatattctaacaaagctgaagataaagtataacctttgggggcctcttcttcaacatattctattctgcagagtagcaggtaataaataaggtattagggtagcttttcagttcaaatttaattttgattcctgcagtggattcgactgtggcattcaaacatagatttgcaggtgcagagagagagtgttacttagccctgcagtgtgactaattgctggtaattgtctataggaagggcgttagaaaggcctgtctccagattttcatcatattttacccaaggacactggcaacgtgaggaggcagtctggagcactgtagccattaagctgttggcagtgtgcagtatacaaaatgttggatctaagtttaaagacaagcctgtgtaaaatgaatttttatataaatagaaaactgtgaaaatgtaatcattgaaaaaatgctgtattttcatttctgattaaccttcatttgaaattggctcttagcaacatatacttccttctcatgtcttgcttttttcctctttccagtaactaatattctataactagtatttaatatgctggttagaaaaccaccaggggatttaactggatatgaaacaaaattgatttataatgaaaatatgtgttgaagtaagctttataaaatgggaatttagtatatccttaagtcagatatttctgtaaccttgtgaaaaagcacagttcctatgtcattttggtcacattgtttttctttcctttccctcctgtttctattatgcttttgttaaatcgaggaaggaattcaagtaattagcattttacaattgtctggaactgccaaaaaaatacctaacaaaaaatacacattattatgggaactgtaaagatttaagcagatataactcaagagataaaatgagttattccaaagtgtgaaatgaagaaagtccagatcttggcaaatgagaaaattatcttgctatctgcaaagcattctactaaattttaagatttttttttaatagaatcagaactgcaaggcttgtttgtctttatttattttatcctatgttccttaaatattgaactattgtaatcttgtcgttaacccccatccctaacacacacacattttttttttaattgggagttttgtggatttgtctaaaaaaggaaacactgtgatttaggattttggtaatattcagcataatgattagttttattctattatgtggaccttaagctacttgggtagtttaaatagtgatagatccactagtactatttctttgacagataagatccagaggcttacttctaaatgtgaatcctaaattaccaaacatttttgaaatggttaatgagagtgcatctgtttctttattccaagtttaattttcaactggatatctgcactttgtctctgaagaagtatttcctagaggaggaaaaagccttttgatcctttttaataatttacttatgagaagtaatttacataaaatagtagcttatttatgaaaaatagggagggtgtaaggagggagaggagaagaaaaggtaactattggttactgggcttaatatctgggttatgaagtaatgtatacaacaaacgcccatgacgtgtgtttacctgtgtaacaaaccttcacatgtacctcgaaacctcaaataaaagttaaaaaaaaaaaaaaagaagaaaagtaacttagaattcagagggataagttttaaaggaagccctgtggaagccttgcaggaaaaagttttctttgacaaacctgtcctttcaacataattgatgagttggttccagcctggttccttgtgacccatccagcactgagtaggaaatgacacagaaaatgaatgttgtggtctcatttgtcagccagggccactagtttcttgcaggatacctgaattttcttctgtgcttttctcacatgtgcccatccctccttttctttcagtgcctttctctccctttaaccaccagggcgactgcccttttattagtttcttagcgttagttctaaagagtctgatggcctcttgtaacgtacatattgagcttccatagcaaagaatacaaatcatcacaaatcacaatagtccaataagaaagaatattgatctttccaaagtaatttcagtcatatatgactgagctcaattttaaatatgtatttcagtgtcgacttacccaacacactgaacctgcttctctgatctggtattagacttgtactctgcctacagaccagtgcctaggttagttcatccataaagggaccaaaagcagtgaccactcctcctggggtgaagttcagtgtttctttttttcccatttacttagttaagcagtcagttttaactttactatccagctgattttgtgtataaatggattcatttgtagtttatcttgtttttgctaggctgtgggctaggaaggaccaaatggatttacgtagtttatcggataaaccaattttgagtatcattttgtcaggaaaccctttttaacctcttcctggatagccccagccaccttaatttacactcctctgggagcatttatctttccttcatggcaatgtaattttgtatatatttacatgttctttttaaggcttttcattcagtcttttttgaacaactactttataccaagtcccgttacttcaatgaatataaatggataaaaatctctgccttatgaagcttgtattctagtaaaaaaaaaaaaaaaaagcagaagttaataacatgtaatagaacatcaggtaatgaaaagtgctatgaagataaaacgaggcagagtagaaatagagaatcacctaggagaagaggcagtggcgacattaggtatgctgttccggagagtcctctctgaggaagggatgcagagccaggaactaaatacaaggagatgcttgtcctgggaagatgggcgagaactcttcaggcagaaggggcagccttcttggaagctcatttaccgtattcgagaaagagaaaggcaaccagtgacgctaagagtggtgaatgagggaaagtggcagaaatggcgagtgtagaggctgacagggatcagatcacatagagccttgttgggtgacataagaaattcatatttttttctaatttaagtggaagatcaaagtaggattttaaattgtagctcacctgttagaccatgcctgccatatgaggacagagtctgccattaccactgcagcctagtactgaataaatattggctggctggctggctggctggctggctggtcagacagatgaactaatgtccttccaaccctgttgcttttacttatgtggttttattaaaaacaaagcattttgttggtttgctttgttgctatcagagttacacatattgttattggtattgcatttgtaccccttgacaaaaggaagtttactatttattatcactagataattagaatttcctacctcacatgcctgaaatgccgcatccccccaccccacttcttactatgtaaaaaaaaaaaaaatctatctctctatctatctatctatctatctgattggctcgacagcttgaacgtgattgagtgtccatttaagcctacttgtattttcatctgattactaatcctgaaggataatgttaagccagattctgcagcacagaggtcagaggatcagacatcagctctcctaaaatgatgggatgggatagaaagaatgatgataacccgattaatctccctttagggggactctggagtcaggagatgtgtttgtggccttggtaacagccttcctgctggttagaggaggacctgcatattcttgggattcctctctcataatgggtcacaccacatccaggtattaccacctgggagaagaaaggtgacagctatttttaattctttgataaatctcgaagatagaggtggaaccaaggatgtcatggaacatcatgcaagtgttaactaagtagtcctctttgaaaatatttagatctatagactatcttgccgcttgaaaaacattttatattgctaagtaggaactgtcttcttaattttcttataattctctttgcttgaattatccctaaaaattaaccatagattttcaaataagctcaaagaaaacatggatgttaatgctagattcatcatgtaataattattattatattaatagtaattcacctttgcattttttcatgtcttagtatttaacttctgtttcatgatcctgttcatcctaaagttagcacctttttcttgccatgtatttgccaggcgacatatttgatcggagcttccagaacccatctctctccaccacatcctcttttactgacactccgggatgctgctaatatcaatttgaggttttgcagagatgggggaagcctacattgtctgcatgttctgcccttgtctaggttgtatgattcttgagggtagtgactacatcctattcttttttctgtttcctgtagcacctagcagaaactctactgtatagaaggtattcagctagctgttcaatgactagatggacagatgaatgagtgaatattttatttcctgttctgattttggtaggattcttaagtccataattccctaatctgcccactttgctcagagatacaaatttcaaaattccccttaaccttggagagaccctagggaagggcagcattagcttaagcagtgggagacattttttcagtgtaggatcttttttcctgtgtgttttaacctcttagagagaacgtgggttctttattcctgctgtggcacggtcctgtttttattagcgtacccaactagactgcagcacatatgttacaatgagccatgccacatgcaaagataaacaaatgtgatgttaatgagatttgagtgtagaatctgtttttctcttctatagcctccagagttttagagaattttgtcactgtcccatttaactggcatctttcttaaagggctggctttattcataccaattattttctcattctctccctgattcctttcactcaaattcagtaaactctcatcttccagtacattatcctgcagctcatttataccttcaccctcactccttgaaatgaattcagaatctgatttggagcttgtctctctaagtgtaaaacacctcctgctataaataaacacactcggtttacttaggtttgatacttagatgagttgcatcagcatatgttctacttcacgttatcagcgtcttctgagttgaattctcatcatttttttgccttaaaaatgacagtgctaaatatgtcctgagggactaaggcaggttgagaaaacctctctgcagtattggagaaagccaagttaaatccagcctgctagcctaatgtaaacaatataatcgttcttcccttatttactttatttgtgaggatcatatactagtaaactggggtagagtagatgagcaaaaaataactaggggaagaacaacatgaacggcaaagttgcttatgcaacaaaagacatgtcatattttatctttcaatttaagaaaaaattatgggagtttcatatgcttgacactatcattattcctctactaactgccttctattataatgagtcttctttttttctcccagtcaacacattacatatacctctatttaacatttatttcttgattagttgttcataggtgtatcttttcccagtaccccacctccctccatacaaggagcctaagcatattgccatgaatgtaacagattccaagtacatgcctgttgtgttgaaacattgctcaccaatcacaaattttggcacattctaattatctaatgtctttaagagttagtgttgtaataaagacttaataattatttgtctatcaatcattaagttgatatcagtgtaccaggaatagtaactcctcaaaaaaagccagtgtttatgattaacttctaacatttaaatatgctatgtctatatttataatatattttatgtgcttgtttattctctgtatccactattataatgttcataagagcaatttctttttctacgtagcaagacctgtaagaatataggagagatactgtatttatatatgtatgtatatattcaataaatttattcaaaaatatgtgttgagtacagatatatgtacatattctgaatgaatatattaaaaatgtatataccttatatgttcatatactcagtatgaatattcaatacattatacatatctatactcaatacatatttttgagtgaattaattgagtacttcttatgtgttgggttctgttaataagtacttcaaatgcattatctctttcaatccctcaagattccagttaagtgtagatactattattatcctaattttaaggatgaggaaatgtaggtttggcattggtaagtggttttctgaaagatattcaattcataaaaaagatagaatcaagccttaggtccaggcctgtctaacacaaaagcaaatgcccttagctactgtgatatacttctcctacagtaattaactgagagaaaattttgtgtgaaaatatggaaataattgtgcctggtgggatcatggacactaacaggataagatcatcaaatagtcctgtggtcccctatgatgaggtgagcgtagccaagcccagagcaggcagcgaagcctggtgggggaaaagctgtggggcacgcaagagaaagaggtcacaagcctggggcagagaatgtagtgtccagttggaagcatcatgaatcagaatctgggtgatctgtgattctggaactagagtgttgccttaaaagcaagtatattcacctctcaagaagaaaaaagcaaatgagaataaagatggaatggaagatctatcaagtcattgggacactattctcgactgttggagtgatagggagttgtgtgcagtgattgggcttctcaaatgcaagtggtgaaaactcaactcaaatgaacttgagaattgtcctctttctccccaggatctaaattgaacactcgaaagctatcggaaggttggtcgagggcatgaagtagtactctgccaaggcttttttattaacagctcccttttctgcatattcccatggagccagaggaagtgattctctgaatggatatattctgctagtaacatatcgtggcagctgtatccgttatccatttaacaattattactgagtacaggacaatatagagaatatgttacttcctctgttaactctgccctggttgtccagcagcccaggtgtcctcacctgttaactgagagtgagcaagtctaatttgtgtttggtaggcagattaagtaaaaatgtataggaaagcatcgtgtgaatgatgaggtaccatatcaatatgaggtactattttatcatcagtaccaagccatgtaaggctacctttctatctccagaggcttttactttaaatctccaacctagcccatgtaacttttttttattattacactaatttccacttccataaaaaaggtcacagttttcagagagtgcatattacttatataactgtttaatcaaaggatcatgctaagatataaggaaaacctagaatctttatacattttcccaagctagggtgatgtttggagcatgttggatttaaaagacagaaaaataatagagaaaagctttgctattttcgagatcattatttgaaagatagtttcatcaaccactgataggtaagtcatctattaatgggcatttgggttgttttcagctattgactattgtgaataatactgcaataaacttaagaatgcagacagatagggctgggcgtggtgactcacacctgtaatcccagcactttgggaggctgaggtgggtgcgtcacctgaagtcaggagttcgataccagcctggccaacatggcaaaaccccgtctctactaaaaatacaaaaattagccgggcgtggtgatgcacccctgttatcccagctactagggaggttgaggcaagtgaactgcttgaacccaggaggcggaggttgcagtgatctgagatcatgccactgcactccagcctgggtgacagagcaagactccatctcaaaaaaaaaaaaaaaaaaaatgcagactgctagctctttgagatcctgatttcaattcttttggacatatatccagaagtggtattgctggatcaaatggtagcttttaaaaatgtggtatatttatgcaatggaatatcgttctgtcttaaaaaataatgaaatcttgctatttatgacaacatggatgaacttggaggacattatgctaagtaaaataagccagacacaggagtccaaatactatatgatttcacttatttgtgttatctaaaatagttacactcacagaagcagggaatgggatgcagttgctagagaatggagggaggaggaaatgggaattgttgttcaatgggtatagactgtcagtcaggcaagatgaaaaaattccacagatctgttgtacaacatagtgcttatagttaacagtactgtattgtcactttattttttgttaagagggtagaagctgggtgtggtggcttacacctataatcccagcactttggaaggccaagatgggtggatcacttgagcccaggaatttgagaccctcctggcaatatgacaaaaatccaatctctacaaaaaatacagaaattagctggtcatgctggcacatacctgtagtcccagctacttgggaggctgaggcaggaggatcacttgagcctgggaggtcaaggctgcagtgagctgagatcacaccactgcactccagcctgggtgaaggagtgagactctgtctcaaaataaataaataaataaataaataaataaaataaaaaagatgccagtcaggtgtgtgtataggagctaggagatagaagagatgtgtttgtatgttttcttgtttaaagatttttgaaggctatgatgattctcaatattgcactttgcaatggtagtttggtgacaggtttagcatagctatttggcagtgggattccttggaggtgtaaaggttttatcagtgtcactttgtctcctgtccaggtttttaccggttaaaaaaaaagaactaaggagccaaatgccactcaaggttttattaatagagactgaataactcccaatacaggctccttgctaaaatgcaactagtgaatttggcttggaccaaagcccccactttgaattaagataacttgtccccaagaagagtcaacctgactcaaccaaacaagttacaggcaaataaattggaataaagaaagaaaatacctggctgggcctgaaaaggcagaccctgtcctctctgcttaccataggcaggcaagaaccaagctgagctcaccactcacattgttaaaggaaaagatcacagcagatattacagagaccttcctttccctagggaacaagtgaggaagggtgaaggggggccaagagtggtattaactttgccccctgaggtgggaagactactcaattacttttctatgacctaaaagaagaatgtagagatagaagggaaggtatttggttttctccttcatgattaatcaattttatttatgagaatagagaagaaatattcctaagtaaggaagtaagagtgaccttgaaactaggtatattattatccagatatggttatagtctgaatttaatttttattaatgtaataatagcttacatgggccttatggcgacattactagcactctaaaatttaattagatttttagagcttctattaatgtcttttgtaggattatacaatctggggcatcaccagcaagcttcatacattttattttcattatgatttgaaatgagaggaatatggtattttgtgaattaaaatagtttagactggggaggtcttaaaaaaaaaaaaagaaaagacaaccccagagggttgaaatcagttttttttgtactaaactggttatatgtatttttatatagatcttaaatatatttattcaccaatattaaggaattaccagttttttatttttatcaaatttttaataaatattagttgactgtaaccatataaatgtagttatcctcacgatagtttaaaaataatcattttcatgcaacatattttctttagtgtgtatatttcttgagttttttgcgctgatgaagtaagtattccattttcatggtcccttcattattgtatcctgattatatatgtaatatgccttcccaggttcagtaaatcctttaaattaatagaaaaatctgttcagccttgttgagagtcactgcatcaatgtactggttacttttgtaaattttaacccatttatctctttccctcacattccaaaaacaagaactcagggcacacattaaatctctattttacataaagcgtgctcttgaaaaggagatagatactatagattcttagtgacattctttgagttttcaccattcaaactcttaatttagagtagcctgcaaatcaggtacatgcctaggtgacattcacagagaatggaaaagaataaccctatccagaattgacataaagtgttagcattgtatacagagcaggaaaaatgggaacaggaatcagaagctcatttatagactctgctatctactgctatttgatccagaaaagtcattttacttgccctggcctgagttttcttctctgcaaaattaggccgttgggaaggaaggtctctgcatcccatctgagccccagcaatatataaagttgattactgcaggagcaccaagtgttagttgctttgtgcatgcatcatgcgaattcaccgaggctttgtgcagccatgctctgctgcagtagttctgtccttacatgccttctggtggctttagagagagattctatttgggaagggacttagtctggcatgattagagcctagtaattacaaaagtgccaagtgatcctcatctataattacagtgctagtttgttactcattgtccccgaggccataacattaggtggaggagggcatgcgcacggttcctgaaacttaaatgcatccatacttttagtgctgtattttttgctgaattggtatttatctttaatgaatgccaggcttctaccctttcggaatcaatcacttctgtttatgagttggaaaaagacagggaccagagcatgtaggagtatatgagagacagtgtcttattactcagcttatttcctaatcctcgtatgaagataagatcataaaaaatacaaaacaatgtcagggaaagggaatatcaaagcccagcttgttaaagagtcatgaccccagagaagcctagacccctcttctccatgaactctaaaaaatcacctttttttgtgtttttgttgtaatactggccttcattattgcaaatcttcctggttgtactttacaatgattttaattttgtttcctgattagatctttgcaattattcgtaatgttcatctgagtgaaataaaatgatatacactgaagcagtgttaacagattgtaagatttgatatgttttgaaaagaaatggtaatgataaatgacagtgacctaatttgtggaacaatcttcttgtacaaaataatctagtggttggtaattatgtgattaactcaccaagaaaaaaaaaagtcaatcaagtcagaatcatcaagttatagaatcaaaaaaaatgtctggaatgttcccagttaattcattacctacagtgaacttttcatgtgaatgccaaaacataaatactattttaaaaacatttaggggaaagatgtacatttattaaccctaaaactcaaaagacaatcaagaaggaaaaacagcgaaaatctcgaaaagcagtaatgatagctgcttgttgttagtacttatgaggcactttcaccaacataaaacctcatctcaaaataaatgagtgaaggagtaaggcacaatataaccaagtccattttcaacatgaggaacttgaggctcagtgggattcaatgccgtgttcatgatcatgtagcttttcagaggcacggcttcaaaatttgttacctacttcatgctcttttaactatgtgctgttaagaaaataaaagtgaaatatctatgggatatcaattctgaaaaaatattagcacatttgattaggaactgcatcattgagaattcagttaagactttatttataatgcacaaaagcaatagatatgtataacttgaaggtcagtgttataaacatagcccaaactacaagtcaacagagtgaattatagtttggttaatatgcaaaatcattaagatggtttgacttgaaaccagcaaatcatatgaaactgtatttataaaactacaattacaatttagaagttattttgaaaagaaaatcacactttcatgatgggaatatgaaaaatattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaacggctgaatacctgaatgtgtgaatatttttaaaaactttttcgatcacatttatcctggagtgagatgaaaatatagctgttgcatttaagaatgtaagtagtgggtgagtaatttagagatatcataataagcgttttggaagtagagctaaaagataaaagagtctttgattataaataactaaaaggagcagccaaatcactaaataccaggcatacttcatctgttagtggccttagggacaaaaataaaaccagtaaatatggtgtggaagcaactaatcatcgctggattgctcaagagaggatatgtgtgagacccacataaaggtagggatggacttatgagttcttccagtaaagggctgccattgaacacagcaagggctgtggcagacagatatgcaggaagcaataggcaaatttaatatcagtaaggaagaatcatcaagctgtgtttggcttaataataaccattattcttcatttggggttattgattgttctgaaggctacgacaagtgtaatgaactgttaccaccactttgggtgaatgttggccctcaaatgatcattatccagagaggacaatataaataaagtgctgaaagtacagcaaaaagaagagagttagaaaagggagaaagtgggtcttgcttccttccctagtcttttttcttttttttaaggggagacacctttgcttctatactttacttcccattaccggaaatctcttcagcgatccgttttaactgccctggtagtggatcagaagaaggaggacatttttactgttaaggttttactgttttgtcagtgatggaggaagggcgcctccaaaaaatatgcaaagttaaattcagtgtttcaataaattgtttgtttagccagacgtgtctgagtttcttgcctcttcgggtagtcattcctgaagtgtgtcttattgagcagagataacattattgtgtagtccctgaaagagaattggaaccaagttttgggggaaagcttttgtgcacaggtcagcaaagttaactgttgtattagtggagactaaacctggacactagatattcaaaacttgcctctcttctctctgtcagttctctcaaaatcagggttaatattcaaatatattaaattcaaattgaatttgttcctagtaagcacttactatgtgggaatattttgctaggcacagtagattatttaatccatactgtagacaggtcacataggcatttataatctctgttgtactatcatgaattgaggtgaagagagattgggtcacctgctatctgcacagctaagagcaggtagagctgggaactgagttcaagccttcctgaatctgaatctcatgatcttttaccatacaaacttgcctgaatgtgaattgactggccttatgagggagtaatttccccatcactgtgataagagtagcagtcttcctcctcctctcccttcttttcctactcctaataaagcaacacctgcctctattattatgaatgttatctcaaattgtatatatttatttctattgagttgaaattcacataacatagaactagccattttaaaataaacaattcagtggcatttagtacgcttacaccgatgtgcagccatcatctctattagtcctaaaatattttcatcaccttcaaataaaaccccattcccgttaaggagttactcagcattcctcttcctcactccacttccaaccctagcaaacaccaatctgctttccgtctctttggatttacctattctggatatttcgtataaatagaaccatacaatatgtaaccttctgtgtctagcttttttcatttagcatgatatgtctgagactcatccacatcgtagcacctgtcagtatttccttcttttttatgtacaaataatattccactgtgtatatataccgcattttgtttatccattcgtctatctatggacgcttgagttgtttccaccttttggctattgtgaaaagtgctgctgtgaacattcatacacaagtatttgcttgaggaactgttttccattctttgggagctacatctgtttttggcatttactttgtgctagtcaatgaactgagtgctttgtaccaggaactctttagattctcagaaccctatgaggtgaatactattattatctctgttttacgaatgaggaaatggattcacagagaggttaaagtacctcatattgggtcacgctgagattaaacccaatgagccaggttcctgagtctgtactctatactctttctttcttttgttgcgtcagcttcagacttgacacctagagctgcttctgctgttccctccccaataccaagcttgcctgcttttcccgggcatactttcaattgttgtgtttcctcttaaaattcagaatccaatgttgcatacaatattccaaaagtaatttttataattattaccatcattgccattgttgatattttgataacatttgaaaggcactttgatgtttttcaaaacaatatgtattagttttcttccttaataatgaaaattatataacaaacaacaaaaaacaagccccaagcttcatagcacagagtatgcctgttggcattaaaaaataaagtcacggtatatatacagggttaaaaatccaaacagtaaagaaatatgtaaaatgtttattaggatttttttctggaaaagtaaattatgaatattcccaaatgcttgttccagatgtgttctgacaatggttgggcgcagattcccatttatgtcctcaatcagctcattttaagctcattcagcaggtgtataacaaaccaggggagactaaaactcccaggtccttttctcgtgatctgctactgagtcatagcccctgtctgccatattgggcttatgcagttgattttctcaacctaaatgcagaaatttccatgtccctgtgtaattcattaagcatgttttagcccaatgcccttctcaaggtacgtttacatcccaagtgtgagatcctgtctgttaactgtctttctcagttgagaaagcacagataactctgccacttggccatgctgagggctcatgaattacattattagtagaaatgagattttgaccacctcaggattcacttagaagcgtgttggaaagattcctgctcagaccaaacatctcccaccttccattttcagagtaatgtgttccgtctgtggaaccacagcttcatttgcatggaagtgatagggagccattctctacagcattgcaaactatggagactgtatacaagtctcagttgcagtactgaattgcacactctcctgctcagtataatttattagctggagatgtgcctacattaatagtatttgaccacattttaatttaactgtgctacaatgaattaaaccaaatagtaaagttacaatgtatgagtccatttttataccattagaagttaatattaacctataaagtgaattgtgtttaaaaaatgaacgatgttttatctaaccctgacatacatatctttcttgtgtataacagtcctatagggtaagttgagctaagcttttacttgtatctttttaaataaactatctttgttagaatggaaatctctaatgatcagatatgtataattgagttttcatatcttcattaagtttaaagatattaattaagcattatctatctatttattccctcttatgagatgttgatagagatcatttgggagcggacaatacttgttaaaactatgtgcagttttctaatgagcctttcaagaatgtgcgatttttttttccccacgaagttagtacccatgaattttgtgatttcttttcttaaggataaagacaagccaaatggttgtcttgcttttttaaggttgttttatataactagagattcttcttggcttcctttttaaatggattttttgataggaagaaaatgcaaatgaagtaacagtggagctcataaatttctagcctggtgactataatgcagggtattggctttgctatcaaacttccccaagcacatttgctttgtattagtgacttatgcaatattggatctttcgtctgtacattagactgtacaattcttcctttccgcctagcatgctttgcattccactctttagacagatgtgtgtgaatgtagcattctttctcagctgaagctaacaagtgtcagcatcagatttcccctatatattccaaatctgataaaaggataccctgtggttatgaaaattatagacacttaatacctaaggcaagtggcttgcagtctcagcagattcctaaatgatgatctgccccatggtgatgcaaaagtgatgttaacactttcctaggaagatcttcaatggggaatgttcctttggcaatttgaatgcatcactatacttttccagccttttttcttcacctcacctaattttatgagttgtatgcatatctaaaataaaatgtgcatttagaattggccacatgtggacacatgccatgatatctcagaagacagtaaaaacgaacttgaaaaccagaaaaatgcacaggtcatatagggatcacttataattgcccctgcttttcccatggcattttcagtcccatcattattccatctacagcgcatctccaaagcaaaatatattatgaaaaagtcatgtatggtatttcaaattaaacaataacattttctaggtgcagagcaactctcgtgatatggccagttagacttttcatcttggtcttgccctttagatatactttgtgatgctggtggccaggtggcaagcagagaaggaggggcattctagaggcggtactaaagacagctcaaagctctagaaagtgtttaagtcttttattagaccactatggctgcaacaaaaggctaacctggttcctgtcctttctagctaaataagcccaaccaatgtgtccacagggcaaccagtgatataagaggatgatctgatttttatggtattacttccatttctgagccaagcatagcaaatatatagtttaactgttgtcagtcttcttcccttgtatttatggaagttatcattaattttatattgtagtcttttctgctaaacccaggcattgcttcataatctttcacaagatagcgcatgagagagctattgctgctgggtcagagttgttacatgagttgcatcttatctggccatctatctctgggctgagttacggtcacatttccctctgatagatctctaatatagcaggtgtagagttaaaggtctttcactttttctgggaggtcaccctgacaatagaagaacctggatttcttatcctatgtatagtttatcaccacggttgctcggcatgctcttttctggtatccctagctcaaccctaactttggtcatcattgtttttcaggttttcaatcaccttaaagttgccactgttccaaaagtcatttggtgagccattctgactgtttccactttgagaatctcgtgccaggtcactagagataaatatgcttattctggaactcccagacattaatctcagggtcaattcatggttctgtgaatgcttgataccaccatcagcactgtgaggcctggaactttgccatgactgctacctcctttgggctcaaatattaaggagataggggcagatactgggcctttgattaatatttctcctctgacgtacatgacccctttatcctcttcacttccttgatgttcctgggtgttgacatagatgaagatgatggttttccctatcttaagtgaaaaacaattcatgtttcgctttgggtagactgaatggcctttaaggattacagttgaagatagttttatccaaaaggtctcaacgcaaatcttttcttatagattagtctattaaatgtgaggggcatctctaccagagattctggcagggatggcaactttggttttaaatttgttagtcaataaatatttgagtaactactgtgtgtgtggtgccatgataatcactggaaatagtagcagtagctgaaagagtgagagttctcatgtagcttccagttatggaagacgataagctaagctgagaattctgctcctttatggccccttactaggaaataaattcgtgtgatctaggaagcccctgtccttctgggtgatgagtggaattcatctacacagtcttaccagtcttacaaatgtctgtcctaaaagactagtaacccaccttacccatattccaaggaaccttgaggcccatatttattatacatggccattatttgtatccatgattatataaacacagatgaattggtcatttcccctgtctgtgttctctactcttaaataacttagttctcctcccttgtacagatatgtgtatttttaaatctagaaatgttagtagttatagaaaaagctactaactgttttcactcttcttcccttttatttatggaagttatcattaattattaattattaattaattagttaacattaattaatgagataatctacattatctcagtgaattttcacactaaccctgtggagttatggttttaatatccaggtattatggtttcagaaaacaaagttatgcaagctcagtgatctctcccaggctggccagctactaagcggtagatccagggctcccacccacgtggtctgattctagaacctgagctcttaaccgctgtaccgacttgtatcactagccaacatctgggctgctctctgctttatcaatgagtaaactgaagcccaggctcttaagtgacttgtcaagttaacagactattcagcaacagatttgaattttcgtattaatatagtgtaaataacaacagttaaatcatttatagtgcttattatatgccagccactcttctaagtgctttttatattggctcatttacttaataactactggttattgtccccatttcacttagaggcaaactgatgctttctgagaccaagttgcttagggtcacacagctgccaagctaagcagctaagattctaactcagcctgtctagtgccagactttgtgttcggatttggtgattctcaaagagaagaagctttcttctcccactccaggagcatgtgcaatgcctggagacatttttggttatcacaactttgggggaggggagacctttatataatctagtggacagaggccaggtatgctgctgaccatcctcaagtacacaagatagacccttacaataaataattatttgtcctcaagtgtcaacagtgttataaccacctttctatggttataacacaccatcagtggcatccagcaaaagatttccaaatcaggaaagcagagagtagcctccagtgtccatgcttagtttagtgtgtcttttatcatgactgcaattctgggctggaatgttactgtttagtatgtacctcataaggataaagactagcattgtgcccagcaagagccaatgggggctcattaattattacaatggaagcacaaattggtgtgtttagatataggatgaaagaatgggaactcagttggagaaaatcataaaagtagcactctgatgactagtggtgatgattttggcttcagtaaagagaagtggccacattgttattcaaaaacatgatattttggataggaagaaagctgatgtttcaggcgttttctttttgtttaaacaaacctattttgcagattttgtatgccttttatcagtcatgcagctcaattacagtctgggcagcaagtttggacaaaaataaaaagaggaataaaaatatttttatacctacattgtatatttctcacaagagtttccaagtataattatccatgaatttcatccaaaaatcttcaactgtgtgaatcttacatttggttacttactggctaatcaggattgggcctaaatccagtgtatacattacataaagaggtgaggacagataatccaagcaaaagaaatttccttataaaattcctaaaatagtatcatttcagtatgggaccgatataaaaattattaatgggatattttacattttttctttgctgtctttgaacttggtatgtatttcacacttccagcacatctcattttggaaaagctataacaatgtttctgagacttaccatatttgagaaccatttccttagtctgtgcttttaaggaatgaagttgttggacgcggtgtctttttacctttatttgttgtcatagatgatgatgactaaaagtgtcttgtccaaatacaaatgtgaaaaggctgaagaccaagatataaatgaaatagaaggctgttatctactaaatgggctttttaaaaaaaaaaaacacttgactttaagactactaataaaactgtaaaataagagcatacttttgaaataagaacacatcaaacaaagtaaaactaaagtttagctcctttgtgtcccaggctgaaataaaagcatgtgggaggacctaccaatttatattatcaaagttaaatggacacaggtcatctttagcatacaggataaggttttagcatgaggaacactttatataaaaatatactgttttttggttcatgtgaaagatattattggccaggtgcggtggcccacgcctgtaatcccagcactttgggaggctgaggcggatggatcacctgaggtcaggagttcgagaccagcctgggcaacatggtgaaaccccatctctactaaaatacaaaaatcagctgggtgtggtggcgagcacctataatcccagctacttgggaagctgaggcaggagaattggttgaaccttggggatgaaggttgcagtgagccaagatcgtgcgaattcactccagcctgtgcaacagagcaaaactccgtctcaaaaaaaataaataaaataaaaataaggaaacgtattattaaaataggaatgacttactttttgtctcaccctgcttctttgtgtctggtactacggtatgatatgtcatgcatcttactagaggaagatgctgcctttatatgtgaagtggattcttatgacctagaaccagaacaagtgtgttaggcttcattttccaagcctcataatgaaatgccttgaagtattcattttcctgtccaatcttctttaaaaacaatatttgcacccctaaccgtaggcagtaattttgtacttctcagaccattgcaccaagtttgatttctacatgaagtttactattgtttgtgtatatggaatggcttatgacaacttcatttgtcctctgctctatctatcctaggtactagaatacctagggtcctagcagtccaatatgcctggattatgccaaacataacacactactggagatatgtatttgatgaacattccgtattcttttttggccagcttggcaagcaggagaatccgcagttagctcttcctttgaccagttatttctaagtgttgttgcaggaagtggcgcattaggaactagtctttttggtttgttgtgcaactagcacttgtgtaactccctctacctgaaccattgcctctcccatcagccagggtagcttaaaggaatgttgaggaaataaaaagtaggcataaaggtattgtgcatagtagtggggatatagatggggaaacagagggaggaagaggagtgactaaagagaaagctacatgtagtcaagtgttgtttatcagactctggtgtggatcacaatcgcctggggacgaattaaaatgatacattattgggattttacattcttcccaaagaggctttgatttactgggtttcaggttggaacaaaatgcattttatcaaggactacagttgagacactctgctgtagaggaaaggcaaactctgccctagaggaaaatgaggtatcctaaattccattttctggttcttcttcaaggcagaaggccaggactgaggttattttgtggcaaccacatttattgaatctccttccctggcatgtagctcatctggaaatgactttcctgtggaggctttgataaccttataggctcttaatttggattctggaacaggttgggataagaagaaaaatttctttcttgtgtttctagaaatgtataaactatatactaagcacagagtttctgttgggaatgatgaaaaaggtctgaagatggatggtggtgatggttgcacagcagtgtgaatgtacttatgccactgtattgtacatttgaaaagtaaatggtatttatgtatattttactgctatattatatattctatgtatactacaataataactttattaactcactacaacttttgagattattttagtaatctgtgggcatgattcctgatgaggacttcagtgaggcagacaaccatgaagactaactaactgttcatcaatttagaaaaaataagtttttgcagttgatttctctcttttaaaacttttaaatttcagcaaagatctgaaaaatgtgagtgatgccttcttcggtctcttaaaaaataaaaataatgtccgggcgtggtggctcacgcctgtaatcccagcactttgggaggccgagatagacggattgcctgagctcaggagttcgtgaccagcctgggcaacacggtgaaaccccgtctctcctaaaatataaaaaattaaccgggtgtggcagcgtgcgcctgtagtcccagctactcaggaggctgaggcaggagaattgcttgaacccgggaggcagaggttgcagtgagccgagattgcgccacttcactccagcctaggcgacacagcgagactccatctcaaaaaaataaaaaattcaaataaaaaaataaaataaaaataattaggatagcaaagcaggtgttcaacttgaaacctctctgtgttttcttgaagcttgaaacctctcagtttctgccttggatcagatgatatctttgttggtccttttctgacatgaggtgctataggtctacagtttactgagataatttacataacattttgatatggaatattttacctaaaatggagtgtgcaattcataattggaaggtatagggaggagtgtttaattgacttgatgcattcatgtgtcatgctcaaggtcaaaagcctcaagtatgtgagtactttgtaactggctgtctgtcaaagataccagggaattcaatctattacatgcacttcactgcactaaaccaacactacatgaagccatcagaacataggatggcctcactaatctcgctgcaataattactgcaggtgtctcctgatcatttaaaacaggcatttatattaggatgcattattctgttcaaatattagggccattagaattttaagagaatttcactttgaatatttgatacaaaagatgaaatgcttgtcaaactaatatatcctgcacgttctcagcccctaaacctaagactgttttcttggtacgaaagtatgcatatgtgaaacaaaacgtaagtgtttgtcgctgctcttaacttgtatctttcaccaacatctacaggagttgtgtagaataataagattagaacccttcaaagctttaaaaaccaaatctgggatttcaaaataaaagaaattttcatgggagagaggggagggcagtaattttgtaaagtacatttttaaaaggactggaatgattcattctttcagcgtgtgattgtgagtttgctggtgtggcagaaagactcttgttgctatggtatccctggacaatgttttgggcattggctgtcatagctgtaactggtcattttaagggggtgtcatacatgcattttgactattgttttcatgatgaagctggattgttttgatatatattctatttcaaattaaattatttaatacaaaaccctcttaaaaatgagcataataagtgaacaaaatagctcttttatggtaatggtaattttttaataacaggaagtgttaactattttcattccaactgttatttaatcattgtagaaagtagagaaagtagagggtcctttgttcttttagcaagaccttaatcttcatttcttcgttaaattagtttttttctttctttctttctttctttctttttttttttttttttgcatttccagctgccaaagtgctgtcactgatctaattttagtattcacacatatggagtagatgccagtcttgccttatttaaaaaaagtcttccagtatcgctaatacatatttttcccattggatgatatgcaaaattatgggtttttttttttttttttgagaagagaaatcctggtcaggacctggcttcccaaaatacccaagggtatgaatattgatgagattcctaaattggtgcacttttgctaatacatttactttctgaattctaaatttagtttctagctagagtccccattagtcctttctatagtttggcctctcagtgcaaggactgggaaactgtaaatgttaattatatttgcccttggacagttattaactctacttcccaactatcttcaacatattttttggtaagtcacagcaaaattgagttacatgtgtgaaatgcatcttaacataatagcaagagaatggttttcattgtagaatagacatgagcctgtatctcagcctttctccttatgtttgtatgacaattgggaatttatttaatgtctctgagccactgttccctcaaatgcgaatagtaatatctgccttgtgatgattacataaaacaatatatgtaaaggtccaggtagaatgccctataaacagtagttatgcactaattaataacttattattatcagtaattaattaattaaaaatctcttagatataggtgtaaattacaacagaagataataatcttttaaaatcaagaccaaatgtgacagagacagacctgaacttggccttgcagtgtcctggtccctcctgagtgcagagactattcctgctaatgcgaattccacctttcttttgccattcatgcagcattcacacatcacctcatacttttcaaaagagtttgatgaagtgggtatctttatctatattttatagccgacaaacctgaagcccaaagagaacttcgtcattctataagtggggacaaagttatacccagacccaggctctcctgattcctagtttagtgatattttactcgaccatgctgctcctagtgaattgagtcccttctttgttaagaaaccagagcacaaagagtcctattcataagactgaatttgacatttaaatttttggacatttttggcattttaattttcttattaaatgtaattaaccaaaatagaaaaactaagaataaagaaataacaaacaattttaatgcaagatggtcccctctgaagaccatatagggtgttcatggaggattttcaggaatttcctcgagacccatgaaattgcgtgttccatgttgtatgctaccagtgtatttctagggcagtgggcatatcagattttgggtctgtgactgcttctctaaacatataacaagaaaagataccatcaagcatatgagataagcagattgttagaacaagatactaagttgtcattttaagggtatcatatattattacatttcagaaatgcagagtcttacggtaggctgttgtgtctgggatctacagagaagactacatcagtcagaatgtgttaggctgcagaatacctaccttaaataatattttatgctatattactattacagtttttaattggaggcctgtagattaggtagttctaggactatctcagaggttcattcatgtcagcagtgacctaggttaattttttttttctttcttctctatgcttctaagtatcttcgcctttagttctcatgcatctcaaggtatggtctcaaaatgccatcattctatcagaatcacatcagggttgaaagtaaggaaaaatgggggaaagggatgcaccattaggcttctcttattcctgacacttttataaagaagggaaagttttcccagaaatcctcttccatgtaagactttccttgtagctcattggtcattcctagctttaaggtgtcaaagtacataagcatctggcaaggagaaataagattgctataattggcctagtccagtcaaaatccgtcactgtggtcgagctcattgctacttagatgagaagtggtgttctgttgtctcagaaaaaggagaaactggtagttagctaaccactatctctctttactgtgataattttgcacaaaccaagatgaattgactaagtttcgctctttactagattgagaaatacgtttcattcctaaaatatccaaatgtactaagacataaccatttacttaattctttgcctcttaagtatggcaattatttctaatattctacttttaaagttgaagctattcagactaagaaaacagtgagagattcattaagtaagtaacaaagttaaacctgcaactgatcatttgattttctagcaggtgctcattctgtcccatgttaattctaacagaggtcatagctgaacatgatgccttatttcttctttaatctatatacagttttatggactttgagtcttttatagccctaaatttttagaataactcttaaaaggaaaaatgcgccagattttcagatgtaggtttctcatacaattagaggaatattctaacactgggtcaacttaaagcctcattttgggatttatcagaatatgcaatctgctgtttggagggaatggccattttgcaaccagtttttcacctagtttatagaagctagaggtacattgtgtcagtacaaaaacaggccttccattctcttgatccattgtttcatatatatgggtgatgggctcagtataaaaatctaatgtttgaatttctgacatgtgttattagaatctactccctaaggtcttagtgaaaaacgtaaataacttttcactgtctaatttaactcatctgaagtctgcttatgaattttgcaggaggaggcacaagactgtattagtgtttatatgtgagataaaattgttgactaaaaatcttttaaagaaatggttttttacattaatttgctaatataagtatataccatgggactgacattgcttttcaaggttctataacatttctttgatgactaggtatatgttgctttcttttttttttttggagacagggtctcgctctctcgcccaggctggagtgcagtggcagaatctcagctcactgcaacctctgcctcccaggttcaagcgaggttcaagcaattcttctgcctcagcatcctgagtagctgagattacaggcacatgccaccacgcctggctaattttttgtatttttagtagagacggggtttcaccgtgttagcccagtggtctcgatctcctgacctcatgattcacccatgttggcctcccaaagtgctgggattacgggtgtgagccaccgcgcctggccatgttgcttatttttataaaacagggttattggatagttttacgcttctcaacagtgtaatttttctattgataaaattgtacaacttactctttttttgcttccttatcgcatcttgagactcttgtgcattctggagcaaggttgtagatgtatctcttaacttcacatatagtctcatttctgctcctgtcttaatattgtgacctttttcccacagtcttgtctgccaccatgagaggccaacagacacttacacccccacaatgtatttctctctcatattcttttgaaagactctaatagtctctaacccataagaacgaatgttacttcttacccacttgagatagtgataaaattagacctggcctgcctctcgttttaggaatatagcatacttagagttatgcctgtttgcacagcctctgaagctgaactgaggaaagtttaataaatccaatggtcaatcaatagacaactatgtttgagacgtctggtatatgtaaggtttgggactggatgcttcgagagatgaaaaaaggacaaaatacagcctttacccttaagatgctgtcacatttccaagggaaaagatggcacatgttcatgaaaaattaactgttacataagactctgtatacattattggttgaattaattttgttgaatgaatacagctccagtaagaacacctataggaattcataggagggaccaatcattgtgagtcaaagaaactaaaaaaatcacagcacatttgatttggaagaggttatcgagttccccatcacccagatatgtaaagagacttctcaaactaagtcccagagagtgactgtgattttcaaagagctacaagcttttattgacagaaccagtatttatttggagagactgatagacttgatttattcaggaaggaatggagaaaaatcctaggtggaaaagaatatgtttatttgacagatgtatttggaaaaaaataagcatttatctatggaaaggagagagttaaaaaatatggttaagggctagccttctgcttcttgccttttattttccctaaaatgatagcatgttctagaactaatggaataattttttttccttagaagtgagtggcatctgtgttttctctttttaatggggaaaaattattatttcccttccgaaatagttaattcaaggaatagtgcccttttaatcttatgattgtcctccataaatgttaaacttgtaaatcatctggctttgttgaattggaggccatctgtccctccagaggtgcattggttcacagtattccaaaatgaggtgatcatggcatgtgccaacgggaaattaaaaaagctctcctctaaatgttctaagcatcaggttatggtgtcaaaatcatttgccaatgaacttttcattaaccttgcctgaatcttgtattagaatcatgggtcttagcttctgagcacatttataaatgccttattttcgtcaaagctgtatacaatacacattgtaaaacctagataaaatgctcagatgtggcacaaaatgtgatctgagtaattttgacatcaagaatcccatagatgtgaagtatttctcaagctacctagaattgtaaacaagagaaggactcttgagtttaaaaatgttctccccgaaaccccatctctactaaaaatacaaaattagccgggggtggtggtgcacgcctgtaatcccagctactcagaaggctgaggcaggagaattgcaacaagagcgaaattccatctcaaaaaaaaaaaaaaaaaagttctccccagctctccacctgataaatcaaagacaagtgcttttcttttgttgttgttgttgttgtttgttcattcatttgtttttgagacagagtcttgttctgccacccaggctgtagtgcaatggccccatcttggctcactgcaacttccacctcccgggttcaagcgattgtcctccttcagcttcccgagtaactggattacatgcatgcatcactgcacccagctaagttttgtatttttagtagatatgggttttgtcaagttggccaggctggtctcaaatttctggcctcatgtgatccacctgcctcggcgtcccaaagtgctgggattactggcatgagtcactgcacctggcctcaaggacaaattttacttacatggtaagcaagattattttggaaatgatagaatgcaataaaggtgatagataaccttagagaaaaagttgaaaaaggaaagaggcagaggcaatgtagggccttgacaatagaagcaataaataaactagaaatgaatccttaagcaggctccattgcagaagaaatgcaagatttctcccagaaaaacatttgacattagattcctctaattccaacataaggaagaagttgtagagagaaccatagaattttataggtgaactaaaagtataagattgtctatttttattctttcagcttctcctgatttttcttgtaatgtgtgcatgaggggtaggagtgtggtgagtcaataagtgattaaattgaattgaaagactagcatagtcggcagggcgtggtggctcatgcctgtaatcccagtactttgggaggccgaagcaggtggatcacctgaggtcaggagtttgagaccagcctggccaacctggtgaaattccatctctactaaacaaaaaattagctgggcgtggtggtggacacctgtaatcccaggtactcaggaggctgaggcaggagaatcgcttgaacccaaaaggtggaggttgcagtgagccaaaatcgtgccactgtgctccagcctgggcaacaagagcaaaactccatctcaaaaaaaaaaaaaaaaaaaaacacctgccagcattactctcctgctgtactacgatagcatcttcactagtctccctgtctctaactggcttcctcaattccacctggactctacctcactccttgccactttccttcttctctactattccataccttttatactagccattgtaaagttaatttatttgccccaaagcagtgtactccaataatgtagctgctagccacctgtgtctgtttacatttaaattaattaaaatcagataaaattaaaatttcagttcgtaaattatactacccttatttcagattctcaatggccacttgtagctgatggttaacatattgaattgcaccaattttagaacatacctatcaacatgcctgtcattgcagaaagttcagctgggcagtgatgcttcaaagattagtggtctcccttgcattcttctcataagccagaaagttactggggtaacagtatacaacatttgccggccaggcgcggtggctcatgactgtaatcccagcactttgggaggccgaggtgggcggatcacttgaggtctggagttccagagcagcctgaccaatacggagaaaccctgtctctactaaaaatacaaaattagccaggtgtggtggtgcatgcctgtaatctcagctactcgggaggctgaggcaggagaatcacttgaactcgggggaggcgaaggttgtggtgagccaagatcacgccactgcactccagcctgggcgacaaaagcaaaactcggtctcaaaaaaaaaaaaaatattgccaagtcttcctcatttcccttctggtttcatatgctaaggttccttctgggactgtctgccggggtgtcatctcctttttcttgccacctcactagcctgccttaactttgtttagataccctttctatgctgttctttttacatagggcttcccttagcacagcatttcatcacatatatcgtaattgtttggtttttagtctctaccctccaccaaactctaaagcagtatttcttgctcttgctcttgctcacgttcatgcttggggcatgcagcttaatgcctagcacttcttgaacactcaataaacttttgattaattagtgaattacttaaaatgtttattcagaataaacaggcacacctaatagaattaatgcatttataatttatatgaacttaagccttttaaaacatttcgctttcattataaaactagaaattaatttcttcagacattgcccttaagaaaattactctaaggaatgtgtaagttatgtaaaatatatttaaccctaaaccacacaatgatgatgaaggtggtggttgtagtagtaataatgataataggaaatgtaaggaaaaataaggcagtctcacaccctattaagaaggaaacaacatttagaataagcctactttgtgtcaagccatgttagaaacccattatttaatataattagtacaaatcaactgttttcttttttctatgttgcctccaacccttgagtacatgaatgcataattttccacttgaatccatatctcaggtagtttatatttgtagttttagaattaatatttcattgtaggtatccaacatagtataattatttttaatgactgcatgatattctttctgtgaagacagtatcatttacttagaaactctctgattaccttttagacagctaaattgtttttaatctttcatattttaaatagcaatgcattcaatattttcatgtaaacagtttttcttaatgagaaggaggtattttaccttaagctgaattgctttggtttaaaaatatgtgagtttattgaaacattttgccaaatatttcttcatactgttgtaggcattgtcatcattttaaattctttgttaatttgacaggtacgaaatggacaaaaaggattttaaagttgtatctggggtgggaaatatgtctcaaaacacttggagataactgctatcatgttgaggaagaagtccgttcaaagaagaaaaggatgccatttgttttacttagttctttaaactaaagcactaacctcttttacaccaaagttaatatcccctttataaactctgagttcttaggtgttcttactcaagagggtaaggatatgacattagtgtcacatcactctatgtggagtaggatccagtgagcttaggaacccagaagaaacatgtattcacagcttggctttgatagaagcaatagactgattttcatttgctctaagggtgttttacaatatgtttcatttcaaaatgtaacaaatgatagtgcacagatgtttaaatcttcctgtatacattcccttctgccaatctcccatgtcagttcctttttattgatgcttatttttgtttgactgtttaattgccatgatttaagctattggtggttcaggatgcacttgcctgccctatattaacaacagtaatgcaaaaataacaacaataataataatgcctgtttattgagttttctcaaagatgagaaaactgagtcacagatgaagtaacttgtccaaaattgcactgctattcaaacataggcagtctagtctgaatttccagctcttaactcatatgctctacacagtggatcagggttcttttgtttagtatttcaggtagttataggtgaaattctgaaatactgtctgcaaaatgtataaaaggtgttcttgaggactggtttgtagttgtagtttgggaatacttgccaaatgctcacaaaatctgggtttgaaaagcatatggtctgagaagcagtctaaattcactccaaataagtcacaaaaaattaatatccctttttgttcatgactggtgggccagaggactcctttagggtgggactgctggccttcagcaagatatgcagcagcaactttaatggtatccttgtggaaattgtggatgacaatgagtagttcaggtgattttgtgggcttgcactttctgatgaaaccagaggcagagtaggttaagtacatggaagtggagtgagccaatgtcagttaagattttggcgtttccactgcaggatcttgagtacatttttgtttctctaaaagtttcacattcttcctctctgctctagggatgctaatgtgcagcattcaccacctgatagctgtaaacataaaaatggggtcatgtatgtactatgtttgcatggcacatccatacaatgttatactgttcagcaataaaaggaacaaagcactgctacctcttacggcaagagtgaactcagaaacattttgctaagtcaatgaaaccagatgcgttgtatgattccatttatatatgtccaggaaaggccaatatagagagacaggaagtagaatagtagttgcctgggactatagatgtgcgtggaggattgactgcagagggtcctgagggatctccttggggtaatagaaatattctaaaattggattgtgattatgattgtgctattctttaaatattctaaaaactccttgaattatacacttataacaggtgaatttttatactctgtaaagtataccttagcaaacataaaaaaagtagtcaataattgttggtatcattttattttttattattagtctttattgttcatataactgagagattctggggatgtgctataggaccctgtatttgaacttcatcaggattttagctactttttggatgacaacatgctttcacatttgagaatgacacagctggaagggataactaatggcttagaacccctaaccaagattggaattgttttgacagcctaaaaagctggttgaagcccataagatgaaattgaacaaaaataaatgtaaaatctggcacaggctgggttcctcaggcaagcaaaagaggtttaagcagctggcttctaaagtagctcttgttcttataagaaatgtttgtgcctctcagaaagggagtggcagaaaacctgggacaggattcaggccaaaactgaaggctccaactataaatgacatctgaggtttttgttagatgctggaagagttacttagttggacattccatgttttatgttcatatactaataatagtaattattattatatttataatgataaaactccatgcttcccatgacataagctctgtggtaaatgctttatatacattatctcattcaacaattataacaaccttacaaacagaatatttttatcctatttacatatgcagaactgagtcttagtgagcctttagtcaaacagctagtgaatggcagcccagttagaaagcacctagtcaggattgagggcccatattttcaactcttaagctctatcttctacccttagaatttcttattcacagaatatagttcttgaaatctagcaaagtgaaaattcaaaagcaaagaagtacatagtctatgcattttgcggggagaacacagatgattttaccaataccaagattggtttattttcgctctaatcctttgggagggactaatttccatcactgagttctaaactgctacgtctaatgagctgtgcgaaaatgctgaggtattgcaggctgtggccattcaagcaagaaggcagtaagctcagtaggaacagctgcttaataaaaggctattagtaggccagaaaacaaacaggagattttgctgaaacatataatctatttttaaattactttgaaatagtcacttgggcattgatacagaggaggattatcaacagtcggatggtttatagaaaataccttgaaatagacttttagatatttcctattttatcttcaataatctaaggagggggaaagggcagtcaccatgtatttatgaaaaataaaatagatgatgcgttgacttgaaaccttttcattttaaagaaggaaaatgcattctacaaagtcagaaaagtacatttttgatgttttcttatttcagagtgtcgcataatgcatatctttgtctgagatgtgctatagatccaaggatcgagggctagaagtctaccttctggctcttttatagtgtgtatgaataccatagaaatgctctttaattactttttaaaataataaatgaaatatgtgagttccgtgatacatagttgtcttttctttatctgtttgttttttttttttatttccaacttttattttaagttcagaggtacatgtgtgggatgtgtaggtttgttacataggtaaacatgtgccatgatggtttactgcacagatcatctcattacccagatactaagcccggcatcagttagctattcttcctgatcctctccctccgcccacacccgtccctctgacaggctccagtttgtgttgttccccaccatgtgtccctttgttctcatcatttagctcccacttataagtgagaacatgcactatttggttttctgttcctgcgttagtttgctaaggataatggtctccagctccatccatgtccctgcaaaggacatgatctcattcttttttatggctgaatagtattccatggtgtatatataccacattttctttctctagtctgtcactgatggacatttaggttgattccatgtccttgctattgtgaatagtgctgcaatgaacatatttagccctaattatattatatttatactttaatttttactatataatatcttgatcacagctttggcaaaaggctttttttccttttcacaccaatgagagaagcttatcttaactgcatattctcttatttaagctttttccttttcccagcaggactttcatctttgctcattctttccatctttctgtcactttggcacagtctatgactagaaagcatcaaccatttcaataatatttgttttgtttctccctttaaatatcaaaaaacctatataggtttgcttttttaagagaaaaaaataataactttatctgttgttaccatttctatagccttttatctttttgacccaggaaacaagttacttgtaaaccttttttcacttaactaaacaaatgaacatttttaaaatttaaatttagctcctactgtgagaaaaccttttaaatggcttattttcaaggcataagtctaagccctggcagccagcctgcgaatgtaacaaaccacacaactcatgcgccttgaaggtcaccataagtgaacagaatgtagaggaagggtcagcccataaaagggaagaaagtttcgttattgggaaattgaaacttaagcggggaagggaaccagggtataaccttataagggggataatgaaacttacgcgatgcccgggaagattgtaaccccatagtactcaaccagtgaggaactgggggagggacttgcatgctaggagataaattacctgctgtagcttccctgggtgtgcctgtctatcagacaccagatcttgcaatactgccattaaaagtcttgcttccgctgttcttcatggctctgagtccattctttggatttggacgggtgagcgtgtttctcacactaccaaaattagacaaacacattacaagaaaataaaactacaaacagaaatttctcatgaatgtagaagcaaaatcctctacaaaatcttagcaaattgaatcaataatgtataaaaataattatacaccaccaccaccaagtgggattcacatcaggtatccaagggtggttcaacattcaaatatcaattaatgtaattcatcacatcagtaggctaaagaagaaaaattagacagttatatcactagatgcagaaaagcatttgacagattcaacactcattcatgataagaactctctgcaaactaagaatagagaagcgcttcctcaactttgataaagaatatctaaaaaaaaccctacagttaacatcatacttaatggtgagaatctcaaagttttcctaccaggatcagaaacaaagcaaggataacttctaccactgcttttcagcatcatactagatgtttttagctaatgcaacaagacaagaaaaagtaaaagtatacagattggaaaggaagaaattaaactgccttttcttgtagatgacatgactacctatgtagaaaattccagaaaatcaacataaaatctcctggatgtaataaataattgtaaccgagatgcaggatatcattgttaacatagaccagtaaatgactgactttcctgtatatcaacaatgaccaactggaacttgaaaataaaaacataataccatttatgttagcacgccaaaaatgatatactttgatataaatttcacaaaatatgtacgaggtctatgtgaagaaaactagaaaactctgataaaagaactaaataagtggaaatatatttcatgtttatacataggaagactccatattgtgaggaggtcagtttttcccaacttgatctatagattcgatgcagtcccaatcaaaatcccagaaaggtattttgtggatatgtacttattgagtctaaagtttatatgatccaaaatagccaattcagtatggaaggagaagaacaaagtagtcaattgaatgactctactcaacttcaagaaatgctgtatagctacagaaatcaagacagtgtggtattgttgaaagaacagacaaatagatcagaacagagagcccagaaatatatccacatcaatatagttagctaatctttgacaaaggagtaaaggcaataaaatgaagaaaagatagtttttttaattctttctttctttcttttctttttcttttctttctttctttctttctttctttctctctttctctctttctctctttctctctttctttctttctttctctctttctctctttctccctctttctttctctctttctttctttgtttttttgaaacagagtctcgctctgtcacccaggctggagtgcagtggggcgatcttggctcactgcaacctccacctcccaggttcaaatgattttcctacctcagcctcctgagcagctaggattacaggtgcacgccaccatgtccagctaatttttgtatttttagtagagatgtggtttcaccatgtttgccagactgatctcaaacttctgacctcaagtgatccacccgcctcgacctcccaaagtgctgggattacaggtgtgagccactgtgcccagccaagatagtcttttcaataaatggtcctggaacaactgaacatcaacatgtaagacaaaaacaaatcaaaaaaagaatctagtcactgacttaaaccccgcgcaaaaaaattaacccaaaatggatcaaagaccgacatgtaaaatttaaaactgtaaaacctcttgaagataacaaggagaaaatctatgatatggtttggctgtatccctacccaaatctcatcttgaattgtaatcacataatccctatgtgttgtgggggggaccttgtgggaggtaattaaatcatgggggtggttctcctatgctgttctcatgttagtgagttctcaaaagatctgatggttttataagcaactggcatttcccctagagagaatgctagcactcattctctctcctgccgccctgtgaagaggggcctccatgcctcatgccatgattgtaagtttcatgagatctcccctgccatgtggaactgtgagtcaattaaacttcttttctttataaaatactcagtctctgcatagcagtgtgagaacagactaatacagtaaattggtactgcagagagtggggtgctgctataaagatagacgaaaatgtgaaagcgattttgtaagtgggtaacagaggttgaaacagtttggagggctcagaagacaggaagatacgagaaaatttggaacttcctagagacttgttgaatggttttgaccaaaatgctgatagtgatatggacaatgaagtccagtctgaggtcatctcagatggagatgaagaacttcttgggaactggagcagaggtgacttgctatgatttagcaaagagactggcagcattttgcccctgccctagagatctgtggaactttgaactttagagagctgatttagggtacctgacagaagcaatttctaagtaacaaagggttcaagagaaagcagatcataaaagtttggaaaatttgcagcctgatgatgtgatagaaaaaaaaaaaccattttctggggagaaattcaagccagctgcagaaaattccataagtaataaggagctgaatatatcaccatgacaatggggaaactgtccccagggtatgtcacagaccttcaggacaggccctcccatgacaggcccagaggcctagaagggaaatatggtttccttgaatgggcccagggaacccctgctttatgcagcttagggacatggtgccctgcatcccagccactccggccgtggctaaaaggggccaaggtacacacagggcatggcttcagagggtgcaagcctcaagcctaggcagcttccacatggtgttggtcctctgtatacacagaagtcaagaattgaggtttgagaacctccacttagatttcagagggtatatggaaatgcctggatgttcaggcaaaagtttgctgcagggacaaagccctcatggagaacctttgctagggtagtgtgaaagggaaatgtggggttggaggccccacactgagtccccactgtggcactgcctagtggagctatgagaagaaggccaccatcctccagaccccagaatggtagatccacctacagcttgtactgtgcacctggaaaagccacagacactcaatgccagcctgtgaaagcagccaggaggggtgctataccctgcaaagccataggggtagagctgcccaaggctgtgggagcccacctgttgcatcagtttgacctggatgtgagacatgggagttaaaggagatcattttggagctttaaggtttactgactgtcctattacattttagacttgcctggggcctgcagccgctttgttttggccaatgtcttccatttggaatgggcgtatttacccaatatctgtacccccattgtatctaggaagtaactaacttgctttcgattttaccacctcataggcagaagggacttgtcttctctcagatgacattttggacttggatttttgggttaatgctggaatgagctaagactaggggctattggaaaggtatgattgtgttttgaaacaagatttgggaggggtcaggggcagaatgatatggttttgctgtgtttccacccaaacttcatcttgagttgtaatcccataattcccatgtgttgtggaagggaccccttgggaggtaattgattcatgggggccatttccccaatgctgttctcatgatagtgagtgagttctcatgagatctgatggttttataagtggcatttcccctgctggcatgcattttctctcctgccaccctgtgaagaggtgccttctaccatgattgtaagtttcctgaggcctccccaaccatgtggaactgtaagtcaattaaactttttttctttataaaatacccagtctcaggtatttcttcatagcagcgtgagaacagactaatactgtctagatgactttggatttggctatgatattttggatatgacatcaaaggcaagatctatgaaagaaagaattgataggctggacattattaaaattaaaaatattttatctgcaaaaagatactgtcaagagaatgaaaagaacaaccacaaactgggagaaaacattggcaaagacatacctgataaaggactgttagcaaaatctacaaagaactttcttaaaactcaacaatcaggaaacaaacaacaaattttaaaaatctgttacattaacagatattttattgaaaaaaatacacagacagcaaataattatatgaaaagatgctacacaccatatgtcatcagagaaatgaaaataactatgagatactactacatgcttattagaacaataagccaatcttggaacacagacaacctgctaacctgataagacagtaagtccaattctattgctagacaacattgctcaatgtaaaaataactcatggtttgttaattgcatcggcatgaagaggaactgcaaatggcctatgaatactagattgtgatgtgatgctttgggcttccctggcatgcagtgactcttataactgtgtattccatgtgaggaccctggaagcaatttatatggaattgctaaaggaaatactggctcctataggggatgaggcttgtaaaccagggtgacttcagcacaggaccaatgtgactcttgtctccttgtatctgaactgtcacccagaaggctgtgtcaacggctacaaggacatccacagtgaggaactgctgctatcctgctgacatgctgtgctcttgaactgtatttttctgtgtatcctgagcctattgagaggtgacagcgtgctggcagccctcacagcccttgctcgctctccgcacctcctcagcctctgcgcccactctggccatgctcgaggagcccttcagcctgccactgtgctgtgggggcccctctctgggctggccgaggctgagccagctccctctgcttgcgggaaggtgtgcgagaggcacgggcgggagccagggctgcaccctgcgctcaccggccagcgcgagttccaggtggccgtgggctcggcggcccgcactcagagcagcgggctggtgccactggccccgggcagtgagtggcttagcaccctggccagcagctgcagagggtgcgccgggtcccccagcagtgccggccggccagtgctgcgctcgaattcccgccaggcctcagctgcctccccgtggggcagggcttgggacctgcagcctgccatgcagagcctctccccctgtggctgtgggctccagcgcggccggagcctccgcagacagcacctccccctgctccgcggtgcccggtcccatcgactgcccaagggctgaggagggcgggcacgcggtggcacgggactggtggccaactccgcctgtggccccagtgcaggatccactaggtgaagccagctgggctcctgagtctagtggggacttggagaacctttatgtctagctaagggattgtaaatacaccaagcagcactctgtgtctagctcaaggtttgtaaatgcaccaattagcattctgtatctagctgatctggtggggacttggagaatctttttgtctagcttagggattgtaaatacacccatcggcactctgtgtctagttcaaggtttgtaaatgcaccaatcagcactctgtatctaggtaatctgggggggacttggagaatctttgtctagctaagggattgtaaatacaccaatcagcactctctgtctagctcaaggtttgtaaacacaccaatcagcatcctgtgtgtagctcaaggtttgtaaatgcaccaatcagtgctctgtgtctagctaatctagtgggtacttggagaacttttgtgtctagctcagggattataaacgcaccagtcagcaccctgtcaaaacggatcgatcagctctctgtaaaatggaccaatcagcaggaagtgggtggggccagataagggaataaaagcaggctgcctgagccagcagtggcaacccgcgcaggtgcccttccacactgtggaagctttgttctttcgctctttgcaataaatcttgctgctgctcactctttgggtccacactgcctttgagctgtaacattcatctcgaaggtctgcagcttctctcctgaggccagccagaccacgaacccactgggaggaacaacaactccagacaccctaccttaagagctgtaacactcactgcgaaggtctgcagtttcactcctgaagcccgcgagatcaggaacccaccagaaggaagaaactcggaacacagctgaacatcaggagggacaaaccctggacacaccagctttaagaactgtaacactcacccaccgtaagggtccgcggcttcattctggaagtcagtgagaccaagaacccaccaattccagatacactatgatagtcttatgtttagctgaatcaagaggaacttctagaaggtagtaaacatctgactagaacattatgatcaaaatagtgaaatgtttggatttttgaatgattttaatatgatagtgaaaaacagttgttcactaaagaccagataatttaacttgattcttatagaaaaatataatatttattgaagtctactgtgttaccccccggattcatagctggatacatttttaaaaaaattataagacactaaaaacccaacttaaaaatgaaaatttatacctgacaagtatttgttttgtcagaataccagcttggctgagtatttttgttactgtctccataaattttatatattttctgaataacatttatttgggtacaactgtaaaggaatggattagccttcatgtttgataattggagaatattgggtagattggtcatgttaccagaatgggcaaaaatggaccatttagagtgttgaatttaaagttagggtcctagttttctccaaactgttttttattaacttcaagattatataaaacaacatatttatgttatcttatgtatttgtgttcttttttaaaaaaaataagttaggcgatcctttctttatataaatcacatagaaatttatagcctagttgaaatgggccaccaaattcctgctaccttctccccactttttttctcatctagcagcttttgaggcatcactagggatccacaaagggcagtttgtaagaacactgctaaacataattattgtggtttcacacggtgtattttgccattggtagccaatttgttggtaaaattactaatgtaaaaataatttttagtgtatataaacatatcatttctgaccttgattcttttctctgcttatgtataagcatgcttatctttactgcaatatatttgctcttacaactattaccaattcgtagtatggagggttattgtttaaacttaatttaagaaagtaacaagaaggaaagccaccttttgtccagcaaccaaacttcccttccctccctttctaccatccaaccaatttaccagccaagcatttatccttccatccaccccacaacaattatttgttgccaggggatttagagataaatacataatcgttgccttcaaaaagccctagtcaattatattccttaggatactaccagcatttccaaatactctttagcacagattatttccttcaaattaaaataaaatgtgtgcatgactctttttttgtttgttttgttttgttttgtatgagagattgtgacttcaagaaagtttaaaagcctttggctagatactacattgatattgatctctttcttcttatacctttgtaatttttgaaatacatgagaaactgtcgtttacgctttcctttcattttccaatctcctattgtatttggcacatagagttgaaaggaaacaatattagcatttagtagcaaattaattttcgcagtaacaaatgacatgtaccaataagttatatttgttcatgaaaatacatttagagagttatattatgacttggtgaattttaagaccgaaaataaagagccaacttagcaaacctgtggctgatcaacacagattaagacacttctagtttctccctctttccattggtgtgtaccttaccaatcaacaccctcaaagcaattaaactatatatagttatccctaatacacatttacttccttgggcattagccagaatgcacattttatgatcacttatccttcaaatacaactactggtaattatctaagatgtttagatgcagaggtttgacaattagcaatcaaagttcatgtttgctaggaaaatgtacagcaagtcctcaaataacatccttttgctcaatgtcatttccttataagtttgaggggaaaaaatccattcctagctggagccattgtctgtatggagttcacacattctccccatgtcttgggttgtctctgggtactccagtttcctcccacatcccaaatatgtgtatgtttggtaaattggtgtgtctacattgttccagtgtgagtgagtgttggggggtgtgtgtgccctgtgtgagatgtcctcctctccagggttggttcctgctggtgccctgagctactgggataggctccagccacctgtgaccctgaactggaggaactgggtaaatcatttgttttgattaatctttcttaaatgtaagtatagcttacattcatctcaatgtttaatattaaatcttgtttatataaattagcctatgataaaattggtttttatatgtcatttcacttaaagtcagtttccaaggacctatcaacaacatgaaaagaggacttactgtgaacacatctgaactttcaaagcttgtgtagtagcattcaacggaaatgcataaacttctctatgcattagtacattaacattccctttaattgaaatgaatgcttacaagtgtgaaaagcaactaatgtagtgttatttaaattgaatgtaggctccatttttaataatagatagtctagaatcatagataaaaaggaatgataaataatacaatagagtccaaatcattcatctctgcatcactctacagaaacatgctgctttccatcagatattttttctggcatcaaacctctgtttttgcaaattacttttttttctgtgagtttttaatgttgaaatattttccacattagcatgtattgactcagtttactttttggtgcactattgaaatcactcaattgaacgggaacttatgccagtcctgagaggataagaaacttgttgaaaattatttttgccctctcaacaaaagacattagatttttaagtatcctagaattatcatgttatgtctaatagcagtcatcatagtgattaaggcttcccaggcctcaccaagatttgggtaacaaatgaagcaatgtagtagcttcgttcacccattttacttatttgaatgaaactggagaaaggctgggctaaaggaaagaagccctcactcccacacttaccctcttttttctcattcccttatgctatatttgtcttctttgccatattaaaccagaagcctcagccaaaatgaagagaaacacagaaggtatttcttagtttccaaagtacaatgttctgaggaattaagagagtttgaagagtaacttcctatgttcaatttggggagagttatgtagtaattttataacctccccactccaaaataatgctagtcataccagtatctgtcactcatagaaatgccttttctgcatgttaagtttaaaaaatgtttctatagggtgtgatgcttctgcttagaataagccacatatttagctgtgtgaaaagatgatggaatttagtctttttcttcttcccttcctttctttctactttcctcccttccaacattctctgttttattcaatttctctaaagaatgctggggagagcccagcctatcttgcctatttgacctttactctgaaaaggatgtatgtatgtctcgtataaaacatacagtctattctgccattttatatttttctacaaccactaataaccaaattgtaaataggggaatgtgaaagtcatatgaagtcatatattatcctatacagaggtttctgaaatagcaggattagaattattatctctaccaggaaaggaaaaaaaaaaaaacctctcaagtaacagccatatagacaagagaattttcaagtctgcttacaaaaaggaaaaaagaaaacaagcaaacaagcaaacgtgaacatctgcaccaggggcttttccccttgaaaggcacacgctcatctgagcatggctttctgccggtgtaggctgcactttctcaaagcctactgctttctgcaagaaactgtcacgcccactctcatggttttgtgtactttgaagtaccacctagttagtctccaactatgctcagctgcctacctaggttatccaagataatttcttagggggcactaataattgtctttggtaatgttcttgttatggagctgtaagagtttttagtggcctaccaaaaatttgtttttcctcataagccatattttggggatataattttacaaagagtaaagttgttcaaaaatgcatgtctccgggtatggtggaaatgcctattttatcctcctttatgctaatgcagaactcttttacagttttatatttgtgcactaagcaacattttgcaaacatggaaaatagcttgaacactggaatatatgttgcattataagtaattttgtctactttgtatgtattattaaatttatcttataggaaaaatctcaccctgaaatatggtcatgaattaaaggcaatcaactttcaaatcacgcccaccctttattttctcattcccgtatgctatacttctcttccttgctggatgaaatgagaaacttcagctgaaatgaaaagaaacacagaaattatttcttagtttccaaagtactatgtttagcgaccaagatgctgttattcaggcctcccagttgacagaatgacctagatctagagatcaagataccaccttctttagtgtatacaaatttccaaataaagaaagaataggggggaaaaatcagtctttccaggagggtagaatcttctacatgaaagcaacaaatatacttcttcagagcctaaatcaatctggaaaaccaatagaacaagacatttaaaagtgtatattgtgcctaatatatctcttttctcctccatatcacccagcacatagtacgtactcagaaatgtctgtaggaaacagcttattgtgaacaaattcacccccaaatgtatgaatttatgattatcaatagaaataaagatagttgtaagaattgaagaactgaattacacaagagtaatagattgaaaatttttatatgagcacagtctccttaccagatgccttacgctctaatgggtcaacaattgacatgaaaagaaaaaatacacgtgtatagatagatatatgtgtatgataaaatgtcaactgctattgaatctaaattttgggtgtattggtgattattatacttaaaaaatatttttctgaacgtgtaagcactttcacaagaaactaggagaagaagtattgttgcataataagagatgtctaataaaagagatattactgtgaaatcttttataggccctcacaggctgcaaaaatcattttcaaacttgtattatttagtttcaactatcctatccaacctgtattttcgtgtgtagttcaaatctctttaattatagttttcatatttatggcctttgatattcagtatggtagaaatgcccttaaagacatatatagtctcctaatttaaatccttcagtaaaactagaaatcgacattttctcgaatcttccgtcaaggagcagactgcctgccgtggttttattgcagtctggtgctttacaccactttcttctctgtgattatttgtgagtcattttgtaagtttttactttgtttcataaatctatactgtaaactttttaggcaatgattatcttaagtctttgtttttttttagttacctgtgaatcagaaaatgagggaatttagactatatcacattgttttgattttgatttatttaaaaaaaatctatgcacctttctgcatttattcaataataactcgaaataataataataacttgaaatctccctgaaggcaggaaatgttgcctcctgcgtttctagcacagtggcttttatacaatggctgcttagtaaatactgttgaattttgatgtaaaaggtggcacatgtaccttgcagatattttgtactcttttattatagcgcctgttttatagcatttgtgagcccttccttctaaacgtgtcccaaatttcagagagattggagtttgcgatagtgggtcagatttttgggcttagtcctgcaggcttatcatggatctggggcagtaatctaaagacattggaactgagatgtcatacccggttgacaactggggctctaattcaggtctgcgaggcctcattctctcattgacagaacgagagagcagattctacttttaggtatattgttttggagatccaagagctgggagcagccatttcttctcatcttccttttccatatttacagatacgtaggtgaccatgttatctgtaatagatattttttactctttgttgaaataattgggaagaaaattcttagttgtttggcttattatcaaattttcttagttttttatttaatctatttttatgacactttggatccttctgtttaagagactgcaataaatgaaggagaggaatgaagcaaataaacttggattagctgtctttgttgatatcgtttaggaagaaccgcatgccagtaccctaattaacaaatacatggtgtgatagtttatagttcaaacagtattgtctaaagtcgttttaatctatcaggtttttataggaagataccacaaagacttgatggtacagttacacagatttaattctatgaacataaaaaaattgattttcctgggggcattaagaactgtttttattgattgaatattttacttgcataaatggtagttcttaaaaacagctgcacattttactgttagtatctgaaagttcttaaattgtaggcgtaaatgtttcattttaattgtgcatttccatccttcaacccaagtaacaagaagataatatagagagtgtgtcatactttttctgggtacaaagatgataaagttgctgtccatactctcaaaataacttctttcttattccttttgtttctacctgctctaagataattgactcaatgggactaccctaatactcttgcagaatctaaactagattatactggacattggaagagtttacgtatcagaaaatgccattcctccggacataaggtagtgagataatattttagcttcttcaggaaaactttcctgaaacctcaaagctgaaggatgtcttggaagcattcgcatttctggcctccctcattttacagggctggagatgcaaaccacacacggatctagttggtgtcttctcatgaactagaaatcttatttttagaatattcttccagtgatttctgccactatagttttattgttggtttgagcagttagtattgaggattcattttggaaggaactgctagctgccaaccaatatcctttatttctttgtactttaataatagaacaccaattttattttgggcaaccatgtgcccagataaaatactgtaattgctaacacattcacaactaatacggtcatgtggctaaattttgtccactaaccagaactattatggggagacttcagagatgtttctggggaaatgattcggctgggaattgtgctgtcatcctcttgttccttctttttgctgcctggaatacagacttgatgactggagctttagtggctatcttggaccaagtgatgatcttgaagatgaaaatgctattctagaatagtggcagagtgagatagaagaagcctaaatctttaattgatgactatagaactgttataccagtcctggattgtttattaggattttttttttttcctgtagtcagaaatgaacttctcttttatttgagctattattattttcctcttacatgttattgaaccaattattgatgaaagagagtcaaactctgtaaaatattggaaaggatttatgtttagccaaatataagtgaccaaggcctaaggcacagtctcaagagttccggagaacacatgcccaaggtggttgggttacagaccaattttatacattttaggggacagaagttacaggcagacatcaatcaatacatgtaaggtatactttggttttgtccagaaaggtggtagaacctgaagcatgtggcagggggcttacaggtaatgggtagatttaaagatttgctgattggcagtcctttgacagggttaagctctgactgaagagatgaggtcagcagaaggaaatatttgtagttaagataaggggccttgttgaagccaaggttcttgttatgtagatgaagcttccaggtagcaagctgcagacagaatagctggtaaatgtctcttatcagaccttaagaggtaccagactcttagttaaatctctcctggatcagggaaagtcctggcaggggaaggagattcactacagaatgtagcttttccccacaagaaacagcttttcggggtcatttcaaaatatgtcaaagaaatatatttcagggtaaaatactttgatttctttcagagcctgctgtctgttgtgtgatgctataccagagtctggttgtaatagtctgtgtggtcagtcttaagatctctgtgttaatgctggccagttgtgcctgaattccaaagggaggagagtaaaaaatactgtatgtatgtacaatatgttttccattaataatagtccttgttctatatcagggtttctcaacccaaagttcatgaatttcttgaggtattatgaaaaactatacttgtatatacattttttttcctacaaaggtagtccattaagtcctcgagagatctggatatcagagacagtgctcaaaataggaagatgatatttatctagagaagggcttcatctattgcagagcagctaaagtagaagattatttgaaatgccgccttcaacatcataatcaatatttaatagcaatctctgaatgtctaaaatgacaggccttcaagttcttatttcaaatacctcttcctctccaaaatatttttcaaattgccaagtaggaaataatatttcccttttctaatttcccataatactttaatacatactctcttaaaatacttacctgtgtgttttgaacttcttcaagttccttgaaagccaatatcacatctagaccaccattaaatccccagccatttacaaatatgacttattcaataaatccttgttggatgaataaattcctgaatccattggcttattttggtggacacactacacttttaatatggctcttgtttggtccccaatccccaggccatggacaggttacctgtctgtggcctgttaggaacctggctgcacagcaggagatgagcagcaggcgagcgagcattacctcctgagctctgcctcctatcaggtcagtggcagcattagattctcatgggagtgcgaaccctattgtgaactgcatacgagggatctaggttgcaccctccttatgagaatcttactaatgcctgatgacctgagggggaacagtttcatcttgaagccatactccccttgcctggtccgtggaaaaattgtcttccatgaaaccagtccctgctgccaaaaaggttggggaccactggttgaaaacataggaaacttcagcctcaaaagtaatttaataggaaggctccaaattggatccaggtttcagccactagaacatagcacagagaaggcacagatggcagtccacagcacctggctgaaacacagattggcctcttgtcttctgtccctaaccatccagatgatagatttatgcacaagcgggctcagaaaaattagacttaagaagatataaaccattttctacctgggagatatcagttgtcagcattctattttctgtgtagtagttataaaacaaaagaaagttaatcaaatgtttcctctggatacaaattctgatttgtcatgtcattccaaaatgtagtggcactgtaaaattctaccagtaggaaagccatttactcttgatgacgtccgatgtgcttacagtcgatattgatttaattctgcttggttgttgtttattagctcatttcatttttactggggtattggacatttttagatatgtcaggaaaatattgttttaggattttagggagcttaaaaacaatgcctctctttctccacaaagttcagaagcaatggggaaacatatgtaacagtctgatacaaataaaaatataacatttattatcgatgaagtgaaaaatatgacatagatttgttgaccagtagagtgctaataattcacccctgaattaagtggatttacctacccagttactttcacgcttggacaatttcagtctcctggagataggctctgtgatgggtggttggaaagcagaacagaaggcaccatttttgaaggtaagggtttcagaaaaaagaatagaagaagagctgagatgcctatgttcagttcccttttccaaagtcactaaggaaggtccaggaatgttgtcctaccattgtttttccaaatggaaatatgtgatatgggtaataagtgttcccttgtgttaaggctctccagagaaacagacccaatatattaagaggtcatttattgtgggaattggctctcacaattatggagactgaaggcctaagaactggggacttctcatagaagtcctggagtctgaaggcttgagaatctggagctctgatatctaaaggcagacaaagatggatgtcccagctccagaagagagcaaaattgcccttcttcagcctttttgttctgtctgggctatcaaggacccaggtgatgcctgcccacattgatgagggcagattatctgtactttggaaacaacgtcacagagacacccaaaaatgttttactagctatgtaggaattccttaacccacttcagttgacatattaatttaactatcacttccttcttctttcatatgtatttcactgtgttcctctgacactgtttgaaattttaagtgatgtcatcattttcttctcactacaacctttaatggacactcttcccctattgaatcacatataaagtccttggcacctaagattactgtgaactggcccccagtatctaaaatcaatacctgtagttcacatccctatagcattttcaccctcaaatgacttagctcattatgtagtttttggaaaatccagaatgtggtacattttcacacctactgttagtagttctcaccttgacttgtataatgaaccatttaatgtcctgtgctcatgagtggcaacctagggagacctaagcgatcttcagtaagaagaggtttgaggatttaggggtgggagttaagtctcataagatccaggtgaagttatataagcattgtggcatatgaaatttcatatattttgtattaatattgctgattggtgatgtgaacttatttaatgtcattttcctgttcttgcctacccgattgaatactaaagagctaaaatttttattctctcttatgacttttgaatcccttatagagcacttaacagaatctataactattgaatttacttatcaattacttatctgttatctttctccctccacgggatataaacctcataattgtcatgtttgtctagctcttcaatatgatcggcaccacatagaccataaatatgagttgagtgaatcctctcagttatttacttgctcacttctactctttttctctacctttccacccacccataatcaactattactaaaattagaaacaaatgaagtaatttcaaatgccttatagaaatatagtaagtcaatggtagtaaaaagttgtttatatcatgatataatatatggccaattcattgaatattactacttaatttcatctttatgtatttttgcaaatatatatgaatacttatggagtttgaatatatatgaggaatatatatggagtatgaatatatatggattttgaatatatatgaatacttatggagtaaatactgattgcatttatggcaacatattcattaataactgaaacctaacatgagcactgctgctaggttgtgtggtaattacagttcagttattttagaaattgctgaaatgttttccagagtgtctctatcattttacattcctcctagcaatgtatgagtgatgcagtttctccacatcttccctagcaagcaatattttcgctaatttttgtttgtttgttttagccattctttttgttgttgtcgttgttgttgttggagacaggatctcgctttgtcacccaggctggagtgcatgcagtggcatgatcatggctcactgcagccttggcctcccaggctcaaatgaccctcccacctcagcctccagaggagctggaactacaagcgcatgccaccacgcccagctaatttttgtatttttttgtagacacggggtcttaccatgtttctcaggctgatactgaactcttggactcaagagatccacctgccttggcctcccaaagggctggtattacatgtgtgagccactgcaatttttcctcttattgatggtgcttttttttttgagatgaagtcttgctctgttgcccaggtaggagtgcagtggtgtgatctcggctcactgcaacctccacctcccaggttcaagtgattctcctgcctcagcttcccaagtagctgggactacaggcgtgcaccaccacaccaggctaatttttgtatttttagtagagatagggtttcaacatgttggccaggctgatctcgaactcctgacctcaagtgtttgcccgcctcagcttcccaaagtgctgggattacaggcgtaagccactacacctggcttgatggtgcttttggtatcaagtctgagaactcgttgcctaaccctagatcttgaagattttctcttgcatcctctaaaatagttttatattttatatttaagtccatgatctattttgaattaatgcttgtagtgtgagatttaggttgatattcatttgtctctggatatccagttgctccaacaccatttgctgaaaagcctatccttctgctattatattgcttttgtacctttctcaaaaattagtttgactactaatggatatagagtttattttggaggatatgaaaatattcctgattaaataataatgatggttgtacaactccattaacatactaaacagaatctataattattgaatttactaaattgtatatctaaagaggtgaaaattatggggtgtgaattacataccaataaaactgttatttttttaaaacttgggtggatttgtattgggtctatttctgggttccctacttgtattcattgatctatgtgtctgtctctctgccagtatcacactgtcatgattaaggtagctatatgtttaagccttattactgggtaaattgatttctctcatattcttcttttttatctagattgctttattctagggtgcttatctttctatataaattttaaagtaagttttaaaatgtctactaaaaccttacagggagtttgataagaattttattaagcccatatatttctttggggaaaattgacatcttttttacattgacccttccagttcatgaacctggtatgtctctctgtttacttagttcttcttttatttcttccattgtcatttagttattttcaatatgcagatcccatgcaagttttgtgaattttgtactgaagtatttcatttcctttggaatgattttaaatggtattatgtttttaattttgccttttaatatccatttttaatgtatacaaatacaatagattcttgtgtgtttatcttatgtcaacatcctacagtatcttgcaatattgctgaactcaacctttaaatttttaaggtttatgaatattggactttaaaagttttatattaattagtatttttatcttcccctgaataataccaggagtttaaaatgctaacttgaatcaccttctttctgaggcccattaattgcagcctagtattttagatttgccttcttttcacccttaaaaatccttattataagtgttctttttgttgcttttttagtcagtaattgtgtagatttctcaaagtgttattttagcttctaagatcatcattctttaattaacgtttacccagataaaagtataaaattatattttgacacttattttttcttaagtgtttgaaaatagtattattccattgtgttcttgcccctcctttctaatgagaattctgcatacaatctaattgttatttctttgtaaatacttgctttttgtttctggttgctttttaagatttttctctccatcttgggtatccactggtacactaatatgattggttactttaggctttgtttttattaaaccttttcaatgttcagtatgtttcttttttttctgaagacaacttttgatataattcattcttaaacagaatctatttgatatttaattgtcctttgagtttttttcttaattttttctattgaagtataaattccacatactgaaatacatagtcattaagtgtgcaggctaatgagtctttgcaaatgaacatttacctgtgcaagcatcgtatttgtcaagataaggaacattttcttccctgcagaaagttcctcatgtcccactttttcaagtcctcttttttcccccccgcacaatgtatagattgttaaaattgtactctctgctcttagatttttataatgaatttaaatatgtattttatatctttcaggttcttccattatttttaggtttttgcatgccagttaatacttgaaacttctgtttgctcctgatgatggttgtcattgcatggtgtatttttagcagatttttttgttaactgtgggagacccatatgctcaggaggatagacatgtccctatatagaaagtccattcatttttgtgaggtttcaaatggatttgtaggagtttgtctagtttttgtgttaacatttcaattccggattactagaccaccactaggaagtgtaaatttgggctttatatctgttcagattgaagttacatttgttaacagattttaccctctgtatccattttctattgctgttgtaacaaattattaatatcacaaatttcatggcttaaaacaatacaaagttgttctctgactattctgcaggccagaagtctaaagtgagcctatagggctgagttccttcaggaggttctaggggaaaattgttttcttacctttatcaacttctagaggccacctgcattccacagcttgtggcctgttcatataaaaagctagcagtgtaccatcttcaaatgtcactccccaccctcacttccgttgtcatattaccttctgtacctgtgtatttgatcctctcatatccctctcataaggacccctgtgattatattgggcccacccatataatctaggataacatcccatgttaagatctttcagttaaatcaatctttaaagtccctttcactgtgtaaagtacaggcggagcattcccaaatcctcccaaatctgaaactttttgagcctcgacataacacctagattccaccatttaagcaaccacgcattgtccacatgggtgcatgagatcctgacacctttgctttctgatggttcagtgtacacaaacttcatttcatgcagaaaattatttaaaatattgcatggaattaccttcagactttgtgtataaagtacatataaaacaaaaattaatttcctatttatacgtggatccaatctctaagatatcccattatgtatatgcaaatattccaaaatccaaaaatttttgaaatttgaaacacctctggccccaagcattttggataacagatactcaatgtataatatattcatagattctggggattaggacttgaacatttagtggggagcattatttagcctccaaggcctcctttctccaaattttagagatactccacttctttaacacttcatgtgctaagggtggagttttactatccacgtgtctcatggtgcattcctctagtatcccagttttaaaccagggttttaaagtttttgcttcatgtctcatctgtctctgcagtatattcaaattcacttgcagcccccagaggtactttcttgcacaattccaggaagtacatttacattagatagtacatgaatggcacctcctacagttgtgtagcctgacactagagccagcaatcagggctcctgtctctatgccttccatccaccatcagtggatggaaccttactactctggcttagcacttttgtttttcaagctcagctgtaaacatgtgaacaggtgttcacacataattttgttatttttctttccttttgtttaaccagcattttcgtggctgtaaagagagaaggcttagtccaccatattgttggaactttaccttcattttacagaggaagaaagggctttccatatgagtgaactgacttatctgaggacacgactaataaattaccgaatcacagctagaactttggtgtcctgactctgacacaaaagttcttttataaatcttagtaacagtgcttttattatgattattcctgttatcactgatactcattactaacttcccaaattacacaagaacctgatgaaaactatactgttgtatgtccttgtgaaccgcaacacatatacaataaaaattcatttattactgaaacatttttggagatatatcattaagctaggtgataggtatacaaaactgaatgagacatgatatctgccatcagggtgtcatagtctaatagaagaaataggtgcataaacagatagttacaatgcattgtgcccaagtatcatttgaactcaagatatagttaagctgttggggaaagtgggattgattagatggggaggagagagaatgggttcaggatgtttaatcttcaaatagttattaccagatagatggctggataggattgagggatgcatagatggatagttatatgacaaagcaggcatagtaagatattagttgtagaatctagaaaggagatacacagttgctcactgtatcagtctttcaacgtttgtctatgttcgaaaattttataataaatggttggggaagtatcgtcttcatctttattatagctatcattcattgagtgcttagtgtgccaggcgtctttaagagctttacatgatttagctcatttaattcccatatcatctgcaagataagtactatcattatccccattttacagaaagttgggcatagagaagttaagtaacttgttcaggctcacacagttagtaagtggacaacccatgataccaggctgtctgactctagaattttcactcttaactttgacagagctatctctaaaagattgagaggatttttttttaataaagtgggtagggatgaggaagcattacaggcaaaggagagaatatatttacatagataggaaaaatagcatggatttttcaaggcaaacataatcctgggtggtgaatggaatataaagcataaatcattgagcaaaggaggttactggggggttgggaggactctgtaagaactggccatatttggctttaccaggtagctgagagggatccactgaaggatttttaataggaggactgtgtgtttagatctctattttgaaatgggagctctgatgtcagtgtggagaatggatttcaactaaagcttttctttttttttttatttccaggtgaaaaatgctagaacaaaatagaacagtttagagatcaataaatggtacaagtaaagtgtctggaaggagctctctgcttccttaatagagagtgcattctgcagaagttgaaagtgaccctaatctgagaagtgtagtatttttagcactagtagatatgaagagggatgtctcgttttcagtttaaggcattattaagaagaagactgatttccaggtttatcctgacaatttccctcttcctttcaagaagaagtgaagttcacatttttctaccatcttcatgttttctggatcatatagcttttgtgaataggttgattagttgatatcggcttctgtttctgagaaaacttcagaagcctagtatttcctcaatggcatctgttgccaccacttctcattttgtgtgagagggttgagtgagtgggtgggaccctttaagaaaataaattgagagatgagttaattatacagattatcaatatacgggtattttctaaccattcttataacaaatgactcaatccgcattcctcaatgtatgctaaaactactgagtgaaatgctattggagaaaactatatgtaatctcaaagttgcttccaaatattattgacaagttacaaaagtaaaataatacctttacatttaaataacagagaaatattgtgatcaaacaacaacaggacaaattgaccataccttcctcctctatgtagtattcttcaaaacatttgaattaatcacaaaaaagcaaccagaaaaattcaaattgaattacattctgtaaaataatggggataggctctttaaaaatgtcaatgtaataagagacaataaaaggttgggggactgttctctataaaaggaaggtatgaccacaaaaagcactgtgtgatccttgattagatcttgggtcacagaaacaggaaacaaacaaaaagaagaacccacccagctataaaggatgttattggatcgatttggaaaatttgagtatagaccatgtggtaaatagtagttttgtggcattgctgcatttcttgaattggttcattgtattgtggttgtggagatgaatgttgtggtctttctggagaagctttatttggtgtattcttaggagaattatttactgacaaagtgtcatgatgtctgctattttcactcaaatgactttctaaaaatgagtatgacagagagagaaggaaggagggaagatcggaggcagagagtaaaaacagaaagcagacatcagaatgtttatattggttctaggtcaaaggcatatgtgtattcattgtgccatcttttcaacttttgtgtaagtttgaaatttttaaaaaaatattgaggggaaatgggaattcagatgatcaagttcaaatggaatgttctatagtcctatccaaacttaattacattttatgtgttattttagaccaatcctgcccaacagtttcaaagtttatacatttgctttatttttataccagcctgttgtgaatttgcaaactgtttaaaaattgcaaagacctacataaatatatcccttagcataagggtggccatgcactttaaaattacatatgattatgtggctgtgtcaccaagattacattaatttcatattctcagaattaaaggttgatttccctatatttgacatttgcttgcaatgttactacatcatatagataaaagaaggtagaaaggtgtgaatttaggcagaggtttccctgaaaagagcttttaaaatatctacttaaagagaaacttgaactctgctttacgctctgatttacgtgtgttctaaaattaagcctttcctctgtatctgggaatcagttggggagaaaacattaaaccattttctgaaagcatggaggaagaaaagcaggcatcttattcctcttttcactccataaaatatatataaggacaggttttgcccattttaaacagacactcgcttttttttttctaatgtaacactatggtaatcttaacaaatatagaacattttagatttagctttgtttctgccggttttcctcatgtggacgccttccttctcattttgttccatctgcaccggatctaaggagagacactttccctttaagaaacaaaggttagctgtgactcctgtcatgtaaaagcctaaagaaggcttttcatagttgatggaagtgatgccaaagaataaaatgaaaagcctctgctatctacctagcgcctacacgccctggagccgacaaaagagctcagtaccagagccgaagagtccgtggagcaccacgttagtgaaaaagccgattataaataataatgaccttagtggatgctgagaactgcactaaagtttttctgagccagacagaatgatgtaggggataccatataaatgcatagaagtctataagggaagaagatgctgagagattcaatttcttcctccaataatttaaattgatggtgagttagtaggtgctcaataaatatttgttgaatgagtaaacaaaagcagtctaacaacggatttcctaatgaaagttcatgaattgaagcatgtttgcattgcatcccaactctgtattaaaactgtatctatttcaggagtaagatcagaatcctgatagaggaacatgcaaaatgttgcccatctatttagggacaatcatagagatagaaagaaaaaagatatttggaagtacatggagctcactttgcctatgagttgtgtgcatttcgaggtgggagacgggagagggagtgcaagagaggctggaatgagatttttttttgtagtgatacttggttttctgaggcataatctagtgaggagagagggccttgacgtttttatttagcgatcatgcctccagtcatgtgttctgaggctcatgttcggttttgcattgatagacttggaattataggacattcttggcttttgaactagctcattgtgctgaatgtggtaatttttgtgaaagcatactgaaacgtctaaaataacttccaaggcaaaacagtttagtacagctactgcagctatatgtagagcaccaacatttatacttagtcgggttttaatctcagcactcagttcttcggtattccaactataagaaccccatcatgcttcccttgggccagggtatcttaaacatattgaggttaacatattgagccagataattcgttgctgtggggggctgtcctgtgcttggtaggatgataacagccagtagcacccctaccccaagtggtaacaaccaaaaatcagggttttttttaaactgtctttgttggaaggaaaatcagaatcttctgaggaaaaggatttttgttctcttcttggatgttaagaaaattggcttgtgttggctgggtgcggtggctcatgactgtaatcccagcactctggtaggcccgatcactctgggaggtgatcttgtgggcagatcacaagatcaggagttcaagaccaacctggccaacatagtgaaaccccgtctctactaaaaatacaaaaaattagccaggcatagtggcaggcgcctgtaatcccagctactcgggaggctgaggcaggagaatcacttgaacccaggaggcggaggttgcagtgagccgagattgcaccactgcactccagtctgggccacagtgagagactttgtctcaaaaaaaaaaaaaaaagaaagaaagaaaaaagaaaattggctttttttttttagccattaaaataaggataagtcagttctcccccaaaaattaaatgagaagtaacactcataaaacaatttgttctctctctcttttcttctccctctccacacacacaccccctcaaattttttgctaatagtgactacaaatttctgagcagttagtggtagatgaatatcaaggcatattgcacccttttatctagctcataggtcaatttgatgtcacattgacataattatttaaatgggctattttctccacagactgttttaatttcatgaccctggtctctgggtcattgttattagaatctgattatctcatggaaaattaatatggccacatattttcttatgtgcgtccatacttttggcttacttcttgaatattttattactggctccattgcttttggttggaaaagaaggttcaatcattgctgcatagattatcattccagtaggtgccctgggcagcaatttctgaaccatcccttttgaaattttgttcccagctggagaaatgtcacagttgtctcagcttttgactctgacttttagtgagagatgcaaggaataggaaaacactttcaagaagaagcaatgagcagttgtatgcacatctggtgacttattgctgaagattctaaagcatttaaaaatattgattaagcctcaaactgttgggaaattgttcccataactttcattctgcccctagatttgctgaggttttgagctgtatttagcttggtgaatcttgtgtaatggccagaaagagacctcaggagccccatcccccaggttcttattagccttgacaagagtgttgttaaaattgcagactcttcacagttccaaagagatgccgtttcttgctgtttcaataccaagtctaaaacaatctctgtatacattttggcttctaaaatatattctgaggtaaaatagcaggttctactgtctttgagaagaccatttcttttgtttgtggtaactagtcatgttggtctcttttttccttctctttgttatatttatttggactttaatgttggctatgccctttaatgaaaaaaaatcaggcatttcccagatttagatttttattataaacacttcatattttaagtggtatatctctagggagaaatgtatgaagaattgatggaagttggaaattttttagttagtaattaacacctaccattaaaaacaagtgcaaatcacatgatggcaaagtgaatctattacatatcataatcaaagattaatcaaagtaattaccaggcaaacagggattgaatagaacttaaaaccaattaaactatttcggctgtaccactgaataaacactttggtattttaatttctcctctcttcatttgcttcagcaatatgtttgctaatatgactgaggtgcacaattgctatttaattaacctatttttgtcagaacctcacacgagctgcgtggagtagatctgctaaagtctcaataataatgagcctgataaaaaataaccaacatgaaattcgtgccagtcattttacaagttatgccaaatgtaataatatctgaagaaaaaaagaaactggttaccttacagaaattggattgaaagtacttaaaaaacatgttgaaccaacacaaaattactcaaaagtttagtaaaatttcaaaaatgtataattgccttgtttctttgtaccccactttgcatatcattaccattaactattggtaataaatctattcgagggcatggatctgttttggggatacttgagttgataatgggcacagaagggtttggtagtggacatcttttacccaatcatgtatcctttgggagagaatacttttctagctattgagtaaggcatcacgaaagtgttgatccattttgcttttattccctaagacaatcaaaacgctaacacagtttgggtggtcttggcctcaatgatacacattttttcacaaaagataacataactaaccatgtgaagaaagcctcacctttctctacctttggatagtagggatgaaagaaagtaagatggagaaatccacattaaatataaagactctttccccacaaaatcccagagctcttctgattggcaccatgaagacaaaacattctgattggatttttggttcttcacccaggtgttttactatcaggtagacacagtttgtgtacaactaaataagaccatttcctgcccaagctgtcttttttccccacacatttaaaatttactcacacttactgagcatgatgtttcaagttttctgaaacagctggttagtagccagttgatcactggcccctaaaggtaacaaagaccctccatccccaaatttttgccagtcaaaaaagcatgactttatttcactcccgtcaccccagtgctattacgaggtgtaagcacctttctagtgaaggtctattttctagatcttaggacaagaatagaatgtcacattgtaagcgttctcagaggtctgcagcaaagcccttattgtacagaaaagaaaactaagactcacaaaggtgtagatcacctgtttgtttgtttggggtttttttttgttgtttatttgtttgtttttgcagcaagatgaggattagaactcagatttctgactccctcaatgttctcccttctttatcatacaggctccttaactactggctgctttgcgtgtggtggactttaaatgatcacacgggtgccttaatcacagcctttttatgagtgacacaggcgctgagtctccctttttctaaaatggaatgttttatatccataacccagacttgcttaactaaggtcaaatttacataaacaaatgtcttccggggccagcaggtagcatgtctgggcaaaagcgtgtgtggcaaggttttgataaagcgcagaacacatgttctgtttaaaaatgttcacattcagattctcaaatctctctcttgccagaccaagcatgtccacaggctactggtttataacccctgactgcatcacgatgcagacagagtaaggaggagtgttcttacagttatgcaaatggaatccatatcaccagttccttttagaatactagatgtcccaagtgtgccatgccaaacccttttgctttgaatgccctggacttctagtattcaatgaagaggcacgacttggggaacatgaaacacccccataaacaccagctttagttcagccagtgtccccaaagactgactctgaaaagaacatacacgtgtatgtcgcataaaatccgtagaagagatgatgctgctacccacaaccttcttgggagctgctgagaatccctaacagacaaaccgaatcatagggcaaacccaccctatgtaccaaacaaccagtgtaattatattctgtagttgaggaattacataaattgcccattgggaaagaagccttaatctccatccctcccccgaaatctatcaacagctgtgtgagcctctgtgtatttttgaaaggttgaacacatttgatcggagaacaaacttgatttcctaatcaggttcgatgcgaggagagccagttagagatgtgtgtgattctcccagtgtgcgtctttgattcgtgtgctaattatgtcgatcctttggggaacacagccaggaagctgggtcctccttgatgaatgctggcggagagccatgcagcgcgcagcggagagcagttcagcatctctagtcccagctgagaatatggtcccattatctcccagctgcctaagcaatccataagggcctgttctgcgtggatgatcagtgtagtggaagcagggacttgctgagagctgaaatctctgtttgatttgctgtaacatgtaaagcgaaactgggacattttactttacagtctgtaagtaccaggttttacccccctctttctccctacagctccatgtgaatgtgactttgcaagctgcatttgattttctgttccattgctctttgttgaatcaagctggtgaggtagagtgtgatctgtttagagcttgctgtttctgttaaatctcttatataattgattcatacaaggaaataggagcctttcagaatgcttttatagaaattagaaattattggctttgtttttaatttgggagtgtggttgcattatctttggtgccaggatgattagagcatatatttatcttcttctgtacctctggccattgcaagaaaaatgtaagtaaaactaatatatatataaagagataatctttatatgcatgcctgtataaaagaagtgcctgtatttccagaatttaaatttaacatagtttattttgctgttctctgctgctactaagaaaggcagaaacagaaaagtttctcttgtttttcagttgcatgctgtttagaaactttgccatggaggtgggcaggataactgtttggaatatttgcaaatataaactgtatatctccttttttatgagacagtacataaaataagagtctgtgtttagccccttattgcttttgaatgcaccacttcttaagaagtaatgtgaattaaaaaaacaaaaaaaatcactttaaatttggttcatttatctttttatgtatcctcaaatgccatctatcaaattaatatttattattcatgcaagattcattgtaaaaatgctattagaatttaatattgttaataatgtttgcatgatgtctttcacatgatcaatgccttagtgaaattaaagattgttatcactgtggaaagggatttgtggatttttctgtttccctaacctaaacataaatcacacctgtctttttttattaaaagtggaataattgagctgttgtaaaaattgaatttgaataaaagtggcttgaacagcatgaaccaatggccagggctaatgtgaaccaaagtgaacttaaaatcatgaatacctgaaaaggggaattgaagtttccacactgagcttgagaccatggagcctgatggtcccataatttccagagtgggaaatacagtttccctgagtaggcagtaagtctcaaggcagagaaaaaccacagactgtgaagtacagaagcatcttactggtgaggacagagtatgttctcattagatttggtggagaggaactgtgcaagagagagaagactcaaaatagatggttgtctacatgagcacaggcattttcagagcttgagatttggagggaaaatgatcacaaaacagtacagaatgcttaacatctggtaagatgaagcaaaagacggactctggtacctctgagtagcaaacagtcccagggctgtccttgccaagtaatcagttctctggaaaaaagtaagtgtgcaaaaaggcctgctaatgaaatctgaagtaacggcaagtggttttgatggctatatggtccctaaacaaaaggctggcctcatgccttcttacaaaactgaactgacctttgtgagtgatgattcctggtgaacccttagctatatttttaaataactgttagtgtttttctgactactgcaagtatatgatcttgtgcaagatgtgatcttgttttaagagggatttatggatttttctgttcagaaataggattagttaaggtccagtgattttttttaaacaaatgcttaatttgtatctacttggttgagtaaatagtgttcttttgagtttcgatttctttttttttcagggtcccgaacccctttatttgtacttagcagaaacgattgccttctgtagaggagtatcttcccaatgtagttaaatttgatttttattttccattcaaatatttagaaatttcaacttataccttacaatattaaacatttttgtagtcagtcaccacaaatctcagagaggtatttgcaagatttgtagtttgcttctattactttcggaatgtttagataattttataaaattgggacactgtcttcctagttgtttgcttaatctgcaggaaagtggattgaactctccaggggtcagtttagggtatgtggtctcttgacagatcgggaagccagatataccttgtaagaggtacttctaaagccataacaatttggtcttcaaaataaatttaaagtgctatgaaagagaataaaggaaaagtcttgaattgtatatgtaaagatagtgcatctctgtacgtgtttgcatgcatacaaatctacccaacaacattgtggacaatttctgtgctacccaagtacactagctctttagttcctagaaagccctggggttgagccaagtggaaagaattttgtaaattgggatacagcagcagagagttaaatctccttgcattctttgttttggaccctcggcagactgttttgtttgaccccagagctgccggcttaagcacaaagaggactttataacgtcctcagcggcatttggaagcaggacctctgcacacaaatcataccctaaccctccttaacagcttagggcagccactgtgaagcaaggaatgcagttctgtgaactgtctctatgatgacaagttaaagagtgaatatgagctgggtgtggtggcacaggcctgtagtcccagctaccagggaggctgaggtgggaggataggtcgagcctaggagtttgaggccagcctgggtaacttagtgaaactctgtctttaaaaaaaaaaaaatgaatatgactgaatgaaaaataattaatttagtaactgtaatacttttggatgattttaaatgttatcaagccttaactgtgcattgtcaaagtatacactccattggttatctctagtaacagtgaaagattgagttaacctcctgtaagatgctgtgcaactctaacaagctgctttacctctctgtgcctcaatagcccccagtaaaatgaagtatgatttctgtgatccttccgaggttaagaaagttacgaactcatgacatcttattctaactgggcattcatgcctggaacggccttcaaattgcctagggacagggtgacatgtgacttagctgtcattttaaacaatatttcactaggatgctttcattttttcttctttcatttctctttctttcttcctccctttttcttccttcccttccctccatcttctgctaccccctccctctctctctttctacccttctccttctccctgtctgtcccgttccctgttctcctctccctctgcctccctctctctctttttcatcagttaattgtcctcaagtcaagtgtgactttagaaacgaggttcggattgtctgctcatttgcataacctgtttgcggctttctcttatgatagttcattgaagtatcaatgacttactgatatactgctctgttatatattagaattacttagctttaggcatgtatgtgcagcagggacccagaaagttatgctgcatatgtaagtgtgtatagattgcccatgttaatttttaaaataagagtgttgttaatcttatactctaaattgaagatgattaaggtgaaggatttatcttaatgtattaagctaacaatatttactttaaaaataaaacaagtgcacaaacaatagcccatttcaaggtagcaggatattaaagagcttgatttttaaaaagagaaaatatgttcatcgaatgatttgatttttctgtaagaaattgtcttgccaaacagtatggaaaaataaaaggcatacatcattttattaacaaatagatacccgtccacataatgaagtaagcaactttgtgaaacatgagataggaaaaatattttatggaaagtttttttaatgatacacttcttgtaatcttaggattgcttatcactagataagtcctcttagttgaaaacagcagatgaagaagttactaaatccatcactaatgagtgcttcttgatatactcgaaccaacttgtgaatacacttcatttgagaatctttactgcagatactggaaaaagctaaattaatttcataatttatacttgtaggacatggattgtagtgctttttgtttcttccactgttaaatggaatagatggaatggcacaaaaatttacggactaatattttactgtacagttgactatatatatatacacacacacttataaatattttttaacatcaagtgtactccaagatggatgataagtggccatttgatgacagtaatagcttggatgggctcatcttatttcagatcagggtagtgttatgacagcttttaaatgttagttgaaatactcatttttctctccatttttattattgggaggtctctatatgtgtcttactattctggagtttgaatattaatgttattccttattgaacttgtaggctatatttgatgcatatatatatatatttttgatgcagagtataaaattaattttccaaatctcataaaactgagtagatatcctggctttttaggcagcaggcctgttgtaagtagaatccgtaatgtgaaataatttgttttatcgtcgtgcatccatctatgaccaaaatgattttgtacttaggaactatttcaatgcaaactagattatactgacagataatgtttgataatttgtggctctcaaatccttgattataaagttaccaagcagcttcagggacattgcttttggttttaatctagtacctctgttgacttgagatgttcaattcaatattacttagttaatagctccaatggcttatccgactgttttattgtatagttaaaaaggtaaagtaaattggacatagacatgactctagggcttgtacatggcttcatgtcttcacctctattccaaagtaagaagggaagtccttctgcatttttgcatgaaatttctctatgttttaagggaggaatggggtgatttaaaattgagaggaacacatcagaaggagctgcaaaggaataaagtgtttcttatggttagatataaaatgcagggctatacattctgaagatatggcagaatttagagaagctgactatgccaggcatttggcacaggggactaaaggagacagatttaatgcttgccagaaggaaaccctatatcagtggatagaaatttgagtgccctgcaagcaagcaataacaaaagaaagaaagaaaaaaaaatgtaaataaggaagtagaggaatgactgtattgtggttggaagagatgtggtttcattctgcaaaggaaaattgtgagtgaatgaaatatatcaagtgtaaggacattgggactaattcaaaaatattttgcataggtattgctaagttactgtgaaataattaagacatttggatcagtgaagagatacagagaaaaaggagtgctgttggatttgactgtactggctgacacactttaacaatgtaattatcttaaatgaagtgggtattgtgacaccgtagtcagtctgtcttatttcagtgagtgtttctggagtagttaatggggatattccatctagttcagtagatattgataaatatgtatttatggaaactatatagcagtttttacaggctgccagtaaattaccttgatccttctaccaatgtctgtgtttctgatcccccactcctccctccaatgatctgtattaccccaaatagtcctaggagatggtgtgagaagactgagtttgaggaggttgattttattaaatcacttcaacctttcagagagtaaataagttcttacggtagggcgtaatgccatgcaatactgaatgacttcttgaaatcctttcacttcacttttcctttaccaagcactttgtccagagtaatatgtttaggtcttccaagcatttagataaataaccttgtctgctggacatggactcaatgagtcataccactaattaaacacggtcatttgcaagaactttgcctcctcgctggttagaattcattgtatatgtgtgtgcctttcagataggtaaagctgctcacacacaggcataatgcttgactccaggggtgaaaacaaccaccatctctcagaagagaacaaatcatgtgttcaaacatggtctctggcatctttttgatgtgtgtgttaagtgtgaatctggtaatttaaggtgtgtgactcctactcccatccagctgtctggctttgtgcttagagagaagaatagcaacagatttagactgacacaatccttccctagagtccccctcccctacctctccctgcaggaatccacaagggtattcggttgattgctgttgttaacctctcttgtagtattatatttcttgttgaaagtaccttttgtggcatgtgagtacatttaagagatgtgaaaggctttaaaaatggctttacttttaaactttcttacctaaattattaggaggaaaacagtttcttaggttaatatgtgtgtgtgtgtgtgtgtgcacacacgcacatgcacgcatctaggctaagatctttgcaaacctttaatgttcatcaagggctgtgtctaaatgatacgttgattataataggattttttttccaaatcattttcgtaatacatgaataatactcagaatgttcatgtaaagtgatagactgaactatttcacttgagaaacattcttgatgttgtacatgacagtcttcggtcgcaaaataatctagaaaattaggaacatgtctgcaagtctggttaaggctctgacagttcttctaatatatctgttttggtgaactttgagcatcacagagttttctcaaggtatgaaataaatacctctggtagaatgtttgataatctcagagtactcaggaatttttaatagatatgttaaagataaaaaatatataactagtaaataaaacatatagttttacagatagaattgtttagcccatggctaaatggataaacctaaaagttttgataagcaattttggaagcgattcttgaatgtagcagaacttgtgatgatgatgtggaagtatagggaaggtagaactttgcctgtgggcctgagacttaaatctacacaaaacagactaatagaagaaaatcatacagatttttcacatttacatgggagccgccacaggaaaatgaagacccaaagaagtggcaaaacctaagtgcttctatattaggttgaacaaagagaggcaattgtaggaaaataactaaaatatatggggcaactaaagaaaaatatgagttattttaacaagatctgtttgtacagaatacccttggttttgactccctgtctctagtgataagaatgtttcttttctcctggtttagggaagacatctttcacataggagttttatctcctgatgtgacaatgaaaagggaagatcggcttgccctccttgtaccaactgtgtttcaagtgtctttagctcaaaataatccttttgccaaagtggcatattctgataagggctcttctgccatccctcacaagtgaccttgccataagttatttcttgtgtgtctaaggatgacaccctagccaacaaggaaaatggtgacattcaattatggaattttaggcctggacatgatctacagattgtcttgtctgttcctctaccagtaggtccagaggcttatccaagacagaatggtcttcttgtagtctgtctagggatagaatctagaatttccagagccccatatgggttcccttctctggcaagaaagtcattcttgcatttcttttcacattctgtaccacgaagctagaactctattggcagccagataacccagaaccaaagacctgcagaaaccaggctgaacacacgaagtgtgaggtggaccagttgtcaggcaatagggagtccacagggtctgtaaagaacggtgcatcagggttcctcctaagtgttgtggccatgttggattgtggggccagtgttgctgtatctcaaaaattttaaatattgctgtttatttttaaaatgtgtgaaagctaaacgcatctatcgaattcataacatccagttttcaacttctatggtaagttatttgaggcatctctcattggttgcgggaaaaatatgcggattcacatcatgaagtggcatatactctacctaagagagggaacctgtgttaatgatccatcttgggtacttctagggaggaacctaagagaatgaggtaaagcatgtaaggattcctacaaggctttttttaaaccctaatatgtttcattcattgtcagtttataaggatcagatttaagaaatcatattacaggtatgagtctgaagttaatgacacagaattcaataaatatattttgctatgcctaagtaattcaggtcaatagactatattgtagttactgattttactaacatatttaatatttttatttctactggggtgctaaagttgccagtcatgatttacattaccatagaaaaagataggttggtgattgcttcctttttttttttttttttttttttttttttttgagattgagtttcactctgtagcccaggctggagtgcagtggcacaatcttggttcactgcaacattcaccatctgggctcaagtgattcttgtgcctcagcctcctgggtagctgggattataagcacctgctaccacacgctgctaattgttgtatttttagtagagacgggggtttcacaatgttggccaggctggtctcgaactcctgacctctggtgatccacctacctctgcctcccaaaatgctaagattacaggcatgagtcaccacatccagcccttttttccttttttaaaaaaacttttgatactcactgattaattgggcaaatagaggaaatctgcaaatgagagggatagaaaaatggtctaatttacacttttttttaaaccacaagatagagcctaaattccatttaattttccactagacattttagacattctatctgataaaggaacagagaacacagtgctgggctgtttaagcacagtcatttttcttgcgtacctgtgcagatgacagaatcaccaggtggtcccatcttgaggaccactggcctatatttattaattcatttaacttattattaattaaattcctgccatttacctcatactgtttgttctagagttcagagatagaaaatgaacaatatgaacaaacaaacaaaattactacccttacgaaagtacgtgcattctagtatggtgacaaaaaggaaaggcagtgttctccaagccaccctttggatctgaggcgccttgtccctattttcactacttcttcttgctctgttggctgttttgcccagctgaacatacttctgtggtatttaagttgatctcatataggccatatgaagtggatgaacaaaagtttttcagatatttttgtgaactcaaaattatgtgggcctagaatagctgagtaattgaggcaaactcttatttgtttgaagataggattttgtaatcaggccatccagctactgaagcaggcctctgcttcattttgtttctgtgaacaagggtggacctctacccatcccccccaccccccgcaataagtcactcatttctcaggtgtttttgtttctgcctgccttaaatggtggagttgaccaaattgactattttgaaacctatttataacttctagataagggtacagccatccctccctaggacatggttttaagtagagttgaatgaatatgtgaggaaggaagcattttgagcttttttgaacaagttttacaactgcaaagtgctattactattaaagataataatttagaagtaaatattatagcaactaagtgcaaaagagctcttagtgcactattttcatttcaccgtataaaaagaaaattggtagtaaaatatatagtgtttatctactttgtaatttctttcccccaagtctattgacttttctctcccttcggacttccctttggtaactcagaagcttacctaagttttgaagtagccagctagaaggagttacagagtagatgacagctttgtctttttttctactatcagagggctcaacactgtggagtgatttgtgggggcatctgacatcatcagaggcgcaaaagtaatcgtgcttatcactaaagagagttggctctaagctttggtaaagtggtcctgatcccgtgtgatcctaaaaaaagatgagaggaatgatcattactgtttggagcctacaggctcaataaccttctaactctgctttttaattaaacacagagcacttaggggtttatttatccattatcaggcaggcaaatcctctactgacatcattagattttatggcatgtggcctgcctaagcagtttgtgtgtgtgtgtgtgtgtgtgtgtgtgtgtgtgtgtgtgtgaataattaatatgaaagatattacattactaccagtacaatatgctttacttccatagtctagaaacatgcctttttatgcaaagttgcaacatgattcaaattgatgtagtattttaaagttaaagctctatactcagtattaacaaggtggttgcattttccacagagactctaacaaacgatgtagtcttaaatatcaattgatttacaatatctcttagcctgacatcaatattaaggctttaggatagctctcacatgagaaatctgatattttgaactttggatcataattaatttcacaatacagtattgttatcttgtattacatattttttctcatgttaatttgacttactggctattaataataagaaacgcactatttcaatgaccgaagagtgcaaacattaggtagtgatgctagtagaaaaacagtttggacagtgcttcttaaacattagtgtgtggaaatgcagattctgattcagttagactgactgggactcaagactctgaatttttaattagctcccatatgatgtcagtcttggtggtccacagataacacttgagtaataaggataaagaccatgtggaattccctgttcagcccacatgagatttcccaactgaggaattctttcttgagtgtctttttctttcatctttgtctcactgtattgttatttgaaatcagaaaataaaaagtactagattgatagctctgtccacctgtcaagtgaaaagtttgcatctcattttgtattacactattttatgccctaaatctttgctttctgtcctaaattgatctggtacatctttgcctgacatctgagtcttgtagatagttatttaaagatatgtgaagtaaaagattgtgaatgtcatggctagaatagatgctatctccagagtctaggaattgaggtatgtactggagacaaaacagacctgttctatatggaatgttctggagtattatgaaagacactcttgtttgtttctttatttttcaccctgtggcttatgaaagtgaaatgtgggcttttctaatatatgcattctctagtttcctatacactgttgatttccccttagtaacattgcatattatgttgctcctagtggtgacaaatctcaggaaagcaagagaccttaaaaaaaaaaaaaaaacaaaacttttttctatttgtgacatgatgacagctgtcatgggaatggggaaagatagaacagtttttcagaatccatcaagtgaaggtacattcaatgctgtaacttaatgaaagttgctttattgtgacatgagtcagagtctttggtgatgcaagtgtggaaggatcttttctgaaagatttatgcctcaagtctggatttgagctgaagggacatgaccttggctttgaacttgaaaaaggttaccctctgtaagaaagtccagagtcagtatgaagaggttttcagatcaggacggcaacagagagtaaacaacactgcagagtctctctgaaatgtgcaaatatcatgacaaggagaggtctccttagctttatttacccagaatcctcacgtaagaggtagtcatctgggtgcttagaaatcaaaatgaatgactcactttttcaattttcatcaaaataacccttgttttgtaaatatacacaaaaaaactacccatcatttgaaatttctattgtaaaccccattgtgaatgtattattgaaaagattggaaaaccttaagggaaattctcaaccaaatctttttctgaacagcttttttgagtggaataattatggtataattcttatgtcatacaactaacacatttaaattgtacaattcagtgtttttagtgtattcacagaattgtataaccatcagcattatcaattttagaatatatttgtcatcccaaaatgaaaccccacctgttcacagtcgcttcccatttctcctcaatccctccctagaccaacaataatctctttctctgtgcctcgtctggatgttttatataaatggaatcatacaatatgtggtctcttgtgactggcttatcttgcttggcatcctattttcaaagtttagccatattgtcgtgtgcatcagtacttcattcctttttatggccaaataatatttcatcattttagatatactacattttatttatccattctttagttgatggacatttaggttgtctaaatattttgactgttgtgaacagtgaccctatgaataatctggaatcgtttttgtgtggacatacacctaggagtggaattgatgagtcagaaccgaagattttaaccaatatgtttaaattttagcaacactgaaatacagtggatgtaactaaagagaatatggaaatggctataaacgaaaatgcttctcaatgaagagttttactcatttgaacaaaggaactatccctcttatttttttagtctctataaagtaaatgttcccaacactttttgtccatctcctctgtcttcagtagtggcacactgtccatgaattaaggatatgaatactaggcaggaagttaaattctgttctgcaaaaaaagagtatgtcatttctgcttattaagaccatgataaatgcaacttgaataagaagaataattgtttagttaacacaataggaaaaaaaagtttaatagaataccagctcagccttttggaggcttagcatatttgaatggcaacatagaacactgtagggaaactctcaacctgtctctaaaatccagagtttgaagatgcagtaaggttttgagcttgtattttctcatccctgaaagtgccaattaagataataaaatttagagcctatccaagttggaattagatcttcactgtgtgtgtcactgaatatgacgacctggatgagaacacctattagaggggaggctcatttaatgcactggagatagctatggtgttcatgcagcatgcactgtggaaggctgtttggattgcatttgattaccactgctgtgtgtttgatgttttgcaagtattctatggggactgccttttctttttccaattgaaaataggctagaaaagggatataaacatgttagtgctctgagaaaaaataaagatattaatatatttctgcaaaaattgtctttcttgacctgaatcataaaaggtattgtgaacataacaactgactggatattgtttatattgtcggtaaatttcagtcagttgaaaatattttaaagtccatatatatctgtgaaaggcatagatgtaagctgcatttaatgtgctccaaaatcaaacaagcaagtattttacttaaaatgtaggttattggcatacctttgtgtgtatgttacttcaatgttgaacacaaggtgtaaaaatacagtattttacatttctgcagaatcttgtcactacagttttctttcatttgaacttaacagatgccaagattttccatttagtaagtattattactagcaaatatattatctggaacacaatcagtatcaaattctggctttctaagaatattgaaaatgtatatgtagaggtgaatattgcagataaactgagtactgaaggaaatggttgattaaatattattcagtttgctttgtagtatgatgaaacattttatatatacatatgtgctagcacacacatgcacaaacacatgcttacattgtcacagggaaacaaatacacattatacctccacccccattgctactacaaataaaggtcttaacaaggtaggtttcttatcacacatcttacagtacatcagttaagactgaatcagggacagcacaagacaaaacagaatcaaaaaggtagtgtgactgcagtatatactgtacatttagtgagtttctatttataatcccgcccaccctcctaacacattttacccatccctggcactatggtcctccctatgactcagctcccaggcccttcatgcgccccacaatcttttttctctccaccttctcatttctctgtctagatttattcttagtaaaaactgagaatactctgtttcagaagttgttagaattatcaaagttaaaagaaggaaaagaagctggtatttctgcagtgtatcaggtagtttcacctacattttatggcatatttaaaggacaaattcttccctatgactaaaattctcctgcttggaaaacaaataccaaaatcatagccattcctagtatctgtaattgctaaaaatcaaagttgtcaaagttgaagtttatgaatgaaggaaatatagttgtataaaagcaaaaaatgtgaaaacttacatagtaactaggataaaataatccaagaataaatttattccagtctaagaaaaaacttgatttaccaaaatacgtatgggatttagggtaactattacatgtaaaccaatcatgtacttttttgaaatggtgactgttgcacactttacattctttctcttatattcatgaaatataccactaatattttgatataaaaatatcttccctgaggtttttttacttaatatttgcataaataggcatacatccatgcttgggaggcaggttgagaaagaagattatattttactgaaaaaaattgtgggaatcatagtcttacaagtttactggagctgctaacagagcagcatatgtgcaatgagaaccatccttgataactggtttgcttagccactgcccaaatctctagatctgaatcttgttttcattgctgactttctttatgaactcagacacataccattaacctctctggactttggatactttctcagaaaacgtagaagacagattgattcttcttaagccttgttcctgtcctggcattccttaagaatgaggttgcatccagctgcagtgtgggtgcacttgggcttagtgctttttctgagacactgtgttgagcagagatcttagccatgcactgttggtgtgaactctggattccttctggtcattacatgtcctctggcactgttttccagctgagggctgtgacctcagagccttggccctgtttcatctttttatgtggatgtcctctgaagttttaattgcttacactgtcttcctttttgctccctgttctgtcaccttagaagtggtcgttaaaagctgccattttactcttgaggactggcacaccaaatgagggaacaatgtatgctgctgctgctgctgctgctgctgttgctgttattgttgctgcggttgttgtggttgtgtgagtttaggtggctgtggagaaacgtctttcaagatttagcatctgaaacgagaagtgtgttgaggagatgggattttcatatcgcctgttctatctttgcatgcggtgtaaaaggtcaaagccttgcttcatccgtaaagcaccttctttacataatagcgagcattgactctgggcatagcttatgtcccatcccctcttttcctgaggattactttaaatagaaatacctgtctattatttaaatataattttgtcctctttgtgtcttctgagagctagttgcccctagatgtctttcagccttgctcttcaacaaaaatagaacaagtttattggtagcccttatgacacatcccccacagttggatacttgatcctcccccttttaaatctgccctcaattctttctaaagccatctctttctaaagcaagagttctgctttccttttgttttcagatatatgtcccttcccgatgtctcccttcatttctaggtttcagttttcaatgttctttcatttggtcatagactttttctgtgttctttctaaaacaatcagtgtactttcaagttgtcacttttcattctcagctatggggtgaggtaagtaggtgttcagatttttattgatgtcaaggcctcctcttgtcgctgaattggttgcatcttgttcacagtactgagtaattattaatatatcaaatccaagctcatatgttgattggactgcctcctttccccatggatgttgtagtcttgattctttgttgtatttcagaaaggaaacctctaaaattttattattttacatttgaaattgttatttctattttattggaattggattttgattgtgtattatctcatatgtggagaaatcaggaatatcaaccatgttatgctacactgatgatcagtcaatgcattggcccataaaatgaacacagttatacaccagagatcaaatcattcccattaaaacaactagatgctaaaatagcactgatattaggaaaaccatgctatgacattaaaataattcaatccaaggtgaaaccgaaactgatttgtctgagattgtactactttactgacccattttattaaacgtaattttttaaaagcacttttaggaggtagatagtatagtgcattattgagattataggtggtggctaaagccctgtaagtatattactgaaacaaattttttcaattctctggtagaatatgaaccaaggtttttttcaatattagcctttaaaaaactcttaatactccataattagcctacaatataataatttgtttccacctttagtatgacaagctatttcttgatttttttcactgagacataattatatatatttatgaagtacatagtattgtctcaatgcatccaatatatagtgattaagttaggttaatgagcatatcctgtcacctcaacattcatcatttctttgtgttgagaacattcaaaatcctctcttctagctttctgaaaatatataataaattattgttagctatggtactcgtacagtgctatggaacagtacaactgatttatcctatctgcctagaattttgtatcctttaatgaatttctccctatctttgctctccccactcttcccagcctctaaaagccactactctactctctacttctaggagatcaacttttcttagcttctacacaggagtgagaagatgaaatatttatcattctgtgcctggcttatttgacttaacataaagtcctctggagtcatccatgttgccccacgtgagaggatattactattttttatggctgaatagtattccattatgtatatatacgtattttcttcatccattcatctgttgatggatacttacattgattccataccttggctattgtgaatattgctgcaacaaatatggtagtgcagacatctctttataatactgatttactttccttcagatatatacccagtcatggtattgctagataatgtttattgactttcatatttgtatggagtagaaaatgtataatatgtattatgatttgtaatacatgtattacttactatatacaaacaacagagccaataaaatgacatagcctatctgtcaagaaatcaacatgagaggagacattgttggtttcaagggatatgccttttttcacaggtaggttgatctttgcataggctaaactattcacactctgtttagctgccttgatcgtctttactcttgtttgagtaacttggtaatggtgaccaccatatgatgaggaggaggaggaggaggagaaggaagaggaggattatattattgaccaagatgatgacatcactgacaatagataataccagaatatcttgaaatcctaatcctttaacagctgctggtttgattccagttaggcttctattttcttggccctagtgcagtagatgagctccttgcacttgatatattttcatcaatgaaaataaaaaagtgaaaatgctgtgctttttagatttccctcatgtgatgcttgggctatatcatcacacttcctccctggcagtggaatcattaccttctgctgttactagtatagattttcagaaatcttgtaataaatccactgatttgagagcagtaggagcttttctttctaggttgcctctccaacattttcatcttgatatgcattacttagaattcagccaaaataaataaaatccagctctgtcactgcttgacaaatataatacattgtcagtgtacctgtttatttcactaatatactctattttcttcttctttctcctcttcttttttttttttttttttgtgactgagtctcactctgtcaccaggctggagtgcagtggcacgatctcagctcactgcaacctccacctcctgggttcaagcgattctcgtgccttaggctcccggatagctgggattacagatgcgcgccaccatgcccagctaatttttgtatttttagtagagacaggggtttcaccatgttggccaggatggtccccatctcctgacctcgtgatctgcctgcctcagcctcccaaagtgctgggattacaagcgtaagccaccgcacctggcctctattttcttcttaaaaccacgttgattgggactatggcctctaattttctcataatttagctgttgtatgttagcattgtcttttaggtgctatttgcattttccttttattatttagagaacacttatgtagccagatttttttaccttgagaaaatgttcttaaaagtgtaactcccgtgatctaagaaatgtcattcagccaagaagttactctaagctttattgtctgaaataatttggaaataattctctttaaatttcaggaaaaagaggacataaaccactgttatagtttcagttgtttttaactatgtgttgaagctttcccagtctcttaccttgtttattcagttgtgttaatttggcagttaaaagaattgtgccatcttcatagatgactcatgtggaagtatactatctctactaacagaagtgactacagacatccaaaaatgaatgctaagcctggggaaagaacctcctaaaaaagagtcaatatgtttgatgacattaaactgcacactatcatttgtgagtattttcacttgtcaactggaaaacaacggcaggtcttgagatctacctcatcctcctctgttagccaggaaaggagacaaggtgttgtcttcagggtgttttcccttcatcatgggccacttggagccaaaaacatcaagggaaaggaaggagcttgggcgggtaggcctgggtacgggagatacatttttgcttagttttcctcagggatagtcaggactctataattagcagtctagtcaaagagaagtttggaggaacaaatgagggaccttctccatctccattgtctctctatgccttcaaccagggaggcagtgagtctttagggatccaagctgttacccctagcttgttaacatttaataactacatgacctaaataatgttgttctcttttcacaattctcagttgcaaatgggagagtagtataatgattgccattggatgtccatttactctttcagccattgaccgcccttattccattaaacagaaagtagtgactctttcctgactctcttaacgagatttctgaccttttcccctgctttatattgtctttagaagtaaagattccatttgatgagtggaattatctcccccatattaatggtgatgaatgctcttgagaggctaatgcatgcaatttaacaaattcaaactcgagtcaaaatctgtcttaatattcataataagaacttatgtgatgtccctgacatccagcagaaataacctgtggcagtgttcgctctaatacttgatcttgtaagagaaaatttcaaccttatacacattttagaattacaactgagccagcattacagtgctaaagaatgagaaactgttgtgttgcctgtttttgaaatgtaacaaaagccatgttttgagagtaattgacttcttaactcacactggacttttcatgtcttgagttccctcaacctgtattcttgtggctgattttgctaaatatatgtacttataaatctcctgcttattggaagattatacatttcaagttcaaagatgtaaaatagactagtatttctctattttgtgagatagtttttcctaggtcttatggcaggatttggggttttgttttttgtttttttgagagacagcatctcaccctgtcaccctgggctggactgcagtggtgcaatcatggctaactacagccttaatctccctgggctcaggtggacctcctccctcagcctcctaagtagctgggaccacaggcatgcaccaccacatccatctaacttatgacaggttaaagggagaattctttcttttgaccaaaatgtttgtactaggaacaaaaaataaaaatagtagccatccctagactctgtatttttgaaaatcaaaattgtaagtagaagttgactaacgaaggaaatatagttctatgaaagcaaccactttttaaacttcctgctttgcacatagttaactggaagaaaaggaaaccaaaaacaaatatattctactctcaaaaagcttaatttaccaattattagtgaaaactattgtaaatattcatttaaaaacaagagttgtttacattcttaaaaaagtaactatagcagtcttcatactctttcgtgtcatacagtaataagattatattttgatagaaaaaagtcatatcttccctgaagtttttttatttaatatttacataaatagacatatatccatgcttgggaggcagggtgggaaaagagattatattttactgaaaaacactgtagaactcatagccttacgagtttactggggctgctaacagagcagcataagaaatgagaaccatccttgatcattggtttgcttagtcaccgcccaaatctctagatgtgaatcttgttttcattattgactttctttatgaattcagacatgtgacattaacctctctggactttggctactttctcggaaaatgtagaagacagattgattcttcttttttttttttttaattatactttaagttctagggtacatgtgcacaacaggcaggtttgtttcatatgtatacatgtgccatgttggtgtgctgcacccattaactcatcatttagcattaggtatatctcctaatgctttccctccccctccctccaccccacaacaggccctggtgtgtgatgttccttttcccgtgtccaagtgttctcattattcaattccgacctatgagtgagaacatgcagtgtttgattttttgtccttgcgatagtttgctgagaatgatggtttccagcatcatccatgtccctacaaaggacatgaactcatccttttttatggctgcatagtattccatagggtgtatatgtaccacattttcttaatccagtctatcattgatggacatttgggttggttccaagtctttgctattgtgaatagtgccacaataaacatatgtgtgcatgtatctttatagcagcatgatttataatcctttgggtatatacccagtaatgggatggctgggtcaaatggtatttctagttctagatccttgaggaatcaccacaatgtcttccacaatggttgaactagctgttcctatttctccacatcctctccagcacctgttgtttcctgactctttaatgattgccattctaactggtgtgagatggtgtctcattgtggttttgatttgcatttctttgatgaccagtgatgatgagcattttttcatgtgtctgttggctgcacaaatgtcttcttttgagaagtgtctgttcatatcctttgcccactttttgatggtttttttttttcttgtaaatttgtttgagttctttgtagattctggatattagccctttgtcagatgagtagattgcaaaaattttctcccatgctgtaggttgcctgttcactctgatggttgtttcttttgttgtgcagaagctctttagtttaattagatcccatttgccaattttggcttttgttgccattgcttttggtgttttaaacatgaagtccttgcccatgcctatgtcctgaatggtattgcctaggttttcttctagggtttttatggttttaggtctaacatgtaagtcttcaatccatcttgaattaatttttgtataagttgtaaggaagggatccagtttcagctttctacatatggctagccagttttcccagcaccatttattaaatagggaatcctttccccatttcttgtttttgtcaggtttgtcaaagatgtgtggtattatttctgagggctctgttctattccattagtctatatctttcttaagccttgttcctgtcctggcattccttaagaatggaggttgcatccagctgcagtgtgggtgcacttgggcttagtgctttttctgagacactgtgttgagcggagatcttagccatgtactgttggtgtgaactctggattccttctggtcattacgtgtcctctggcactgttttccagctgagggctgtgacttcagagccttggccctgtttcatctttttatgtggatgtcctctgaagttttaattgcttacactgtcttcctttttgctccctgttctgtcaccttagaagtggtcgttaaaagctgccattttactcttgaggactggcacaccaaatgagggaacaatgtatgctgctgctgctgctgttgctgttattgttgctgcggttgttgtggttgtgtgagtttaggtggctgtggagaaacgtctttcaagatttagcatctgaaacgagaagtgtgttgaggagatgggattttcatatcgcctgttctatctttgcatgcagtgtaaaaggtcaaagccttgcttcagctctaaaggaccttctttacataatagcaagaattgactctgggcatagcttatgtcccattcccacttttcttgaggattactttaaataggaatacctgtctattatttaaaggtaattttgtcctctttgcgtcttctgagagctagttgcccgtaagatgcctttcaaccttgtacttcaacaaaaatagagcaagtttattggtagtctttatgacacatcccccatggttggatacttgatcctcccccttttaaatctgtcctcaattctttctaaagctatgactttctgatgcaagagttctgctttccctttgtttccaaatatgtatctcttactgatatctgtcttcacttctaagtttcagttttcaattctctttcatttgatcataggcttcttctgtgttttttctaatactatcagtgtactttcaaattttcacttttctccttcaaccatcatgtgaggtaggtagctgttgagattttcattgacgtcaaggccctccacttgcctctttagagacttgcttgctttttgttcacagtacttggtaattatatcacatcccagttcatatgctgcttggactagccctttcatgatagagattcctatgttctaatctattcctaagtgctaagaggacccctgtttctttatgttaaaccttaaaaagcatctctgttggatttggtagttgtatattttgatgttatttctactattatgtttttgaacattttaacaagaagagaaaacctttttttgtccatgcatgtttaagagaccccctcaaaatagactgagtcaaaaatatccctttcagtagtacactttcaaaatgtttgagatgtctctgtgaaagggctaatctggaagtctttgacagtttggaagcctgaagaaatcccccattttcccaaagctgtgtttttgaagactgttcttcaaagagcaagcccaccgttttgctattagtgccaagaaagaacaatgagtagattttctgtgtcacaaagaaaagtagtagacggaagatctgattgccaccatgttgcatttaaaacctcattttctttagagaactgtccacaggactctccaataggcagggatttaagggtgaaacagttcagaaccacatctcccaccatataactcaaagatgacgtttatatatctgggaaccttttaaaaaccatctagatctatgggtaaatttcaaatccacaaagttcaactggatggaaagtttactcaaatgcattctttcgtcccagtttttaagcctaatcctactgcttttaggctgactgaaatttatagaactgaaatcatcattgtatctccccagtgactggtggtgatatttgacttcatatactgagaccaatttttatttaattcacatttttggaagagcttgacctgaaagtcattgccctatgctgaaaagattgaattggttttctcaagtatatatcataaaaacagttgatcctatcgaggtgaggtcatatcaaagtagtacactgaaattgagccctgaagaaaatattttttaaataattttttttttttttttggtagagactggatcttactttatttcctaggctggtcttgaactcctggcttcaagtcatcctcctgctttggcctcccaaaatggtgggattacaggcatgagccacaagccacccctaaaaaatgaatatatttttcagatatcaaggcctagcaattttcctaggtcagcaaatatagtctcttctttctgtacttcacaatgcaacatttgatattgagtagatgttgtagaacattacgttgaagagcccaggttctagaataccaccatatagtttagatcttggctttggtgctcgatcattgtgactttgagaatattgcttaaaattttctttcctcagcttgtctcatttataaaataatataaaagccactctctaccatgtagtgtttttgtgcctaatatatgagtagtatggaattgaatcttaacccactagcatctgtagtatgtgctactgcagtatacgaaaagatgcagtagatttctaaattttggggggaatattgtgttttatgcacatgcgttctataagggaaatttaggaaaccatgtagtgcatgttttcatacactatatttgtactggtatgaagtcacacagacagttggaatactgtcccgaagatatataattgtttgagtcacagaggttcctacgactccattaagacagaaggtatagcctagagttggtgggtctgagacagtgtctccaaagtctgaaggataataactgaatatagactccaaaatttaaggcttcagcatcctcagagtccttgcatttgtgagagctatgtctgtgatgttgccgtttgtcaccaggatactttatgttgtcttttaagtgttaggtgtccagatgcagatcacctgcatcttgcctcatatgtctctctgaatgtaaagattttgcctacatctgatgaaaactgtccactgttcacattatttgtcatatgtatctgcttggagcagagtaagacacttctaagggaacttgacatttcatgacccaggatatcagattcatccttaccactagctactctctgaaatttgggaatttcgttggtcttatggaccacgatcatgagactttttagaaagatgaactaaaaaatcgctattcatgcatccatttattcattcatccacatatccacccatcataaacatttacttcagttacttatccttctgcagaagggagcaagctgaaaacaaagtaattgggggtacatctccaataaccctccttctggaagtggaatgaaactccctccttcccgtcaagtctctttacataagtaaattgtatagaatgaattgtgctcctccccctacccccaaaattcatctgttttgaaggcataacccccctgtacacctgattgtgaccttatttgtaaataaggatattgcagatgtaattacttaaggtgatatcatatagaagtatggtggatccctaatgtcatatgactggtgtccttataaaagggggaaatttggacacaaatagacacacagggaaaacaccatgtgaagactggagttattctgcacaagccaggaaaccaccagaagctaaatagaaggagaccttttcctagtgccttcagagggaacatggccccactgacactttgatctcagacttctagtcttcagaactttgacacaatacatttctcttgtttaactcagtttacgttactgtgttacagcagccctaacaaagtcatggagtaaactctgggattaatccctttccccaacatttcataaactattctttatctacttagcaatgcattttggatattcttctgtgtcagtaaatatgtttctatgttatttctaatagttttaatatatatagttatttcccaaattaaaaaaagttaatccgttcactttgatatacattaatatactaacttgtctctaatttgtattaatagttaaaaattctgcagagtggtggtgtaatctggtttacatttgaagctattgattgtacttgttaactttcataactgctattttatatacttatatttcatgttattataaagttcttaaattggctaatttttaaaaacaggaatgaataacaaagaaataaaatataatcattcctaatggcagttatttttcttatgtattcatgcctagttttcaccaatgtgcatgtattttatctatttctaatatacatatatatgcacacacagacacacacccacaatgttctttaatttgatttattacttaatatattataaatatatttgcttttatagtacctttatggaatatttggaatccccatacaattttccatcaaatatatatgctcaaaatattattgatgtaactactccccattattgaacatttagtttctttttagctttaagctattggaatttgtgctgtagaacctataactatcctaaccataagaaggataggtcaaaggttatgaaactttgttgatcttctgtaattattttcataaggattttccataagcaagatgatagtgaaattgactaatttaggttgacaatttattcttgaaattagcataaaccagcagtatacaaaacagtaatgtagggataagattcaatttaatgctacattttagtaatcagaattctgattttctgaatatattgtgtcctttatcaggtgaatgctttcgctgttgatatgaacctcatctttccccattcctgcaacctaatgctttgtctttaaattctctgtcaattggcactaatttcttttgagacgtgttttggaaacaaataagatttttcttagtttaccaacttaactattttttccttaatctccacttatgataataatcttgagaacaaaagtatttagaaatgccctaggtataaatcccgaagagattgagtataataagccgtccatggtatttacacttggaaagcaaactttgactctttgccctttaccacgtagacttgatgcaaaaatcaatgagatgttctaggtttatgaatttgatttctttttatctttttcacaatgaaggaaaacaaatcaaattaatgttacaagtaaacagatttccgagctttgctacctaatgctgaacatctacgtacttcaaagacaatatagaatctttgagataaaatggcatttttttcccttatgataactgatattcaggattggaaacagtttgcctcaagaaaatgctgctttgcatactataaaatgccggtgattactcaactcttgcagtgttagatctaggagggaactcaagagttattccaatttttttccatgcagactcaataatgacattgagagaataacttttaataatacaggtatctattattaaaatgaaaatggcagaggacaagataatatgccataatctgcttcatcagtgttgtgtgtgtgtgtgtgtgtgtgtgtgtatcagcaaatattttttcagctaactaataggtgatataaaaaattggggttgtaagacctatccatagaaacaatcataaattactagccatagaatttatttgcctccctttggaagtttatttccttttgtgattaataacaaacttgagggtaggtgtatgtggttgaatggtaacaggcacccaaggtttggttacgtgggattgcatcatgttgcttggcaccacccagctgagtctccaaacagctagtttggaggcatgtgtctcgtgggcatggagtgttaatttctcttgcagcaaaacagaaagcggccgactgagagagtggaggcatgggtgtggttgaagagcacacaggagaaaagacggtgggggaatatcatttttttggttctgcttctactccagtactggatgccataagatattgcctactgctatggacattttattttaaaaagtagtaggagtttcagtatgatttattcattgtctatagaaatcctaatgtggattatgttcatacacaatatacagaagtatagatattaaatagtcaatttcataaacataatctttaagtaattgtgagtcaaaaatattcagggtccaattacaaggaaaagtacaattttttaacaatgctttatgtattttatttgtcttgatccaaggtttataaagtagtttaaatcctgtgcttacttaacttttctgtttatttgccaattaatagagaggagataaatgaaaaggatcagataggaagaagggaagcagccaatattgtcaaactaacaatggaaccaattgtacctgtgatgttatattggcgagtacagaaatattgaaaaacatattaggatttcaaagcatctgttttgcatatgagtaaacggagggttatgagatttcttcactcattacatagctggaacttatacccaagtccttatctccaagtctaatctcctatctttcttcagctatcttctgggtcttggggccagatttagggtgtttgaagaattatttgtttgcacccttaaactcatttgaattttgtaaactcttaagtatagtaacttcacattaggtgttgcacttgcacagggcaactttggctaatggttattggaaatgtggagtatgggccttctagggcactttccttagtttttttctttttctggagtgaggtgaggctataaaaaatagacaatattaaagcatatagtcgtttatgtattcaatacttttctatgccaacagatcctctcagtgtactattatgcaccttattttgcaaataagtcaagagaaaaaccgttttttccatattaaggaatcatataggacaggcagggtttatataaaattctgatagcacttagtaaagcttcgttctccctaaagtgggtacaatagaaggtaagctttggaattttaagagtattcactgttcatgacactgtttatcctacatttgtcacatatcattttctcaggatatctgacataacctctccaagatatttggtttaaaattaattggcagtcaatggcaaagggtagagtcacttaaatttgctgaagcaagcacagtagcatctaccagagtatatgtcagattgttctcagaccgccaagggcaaaaatatgtgctgagggaggctgtactggtgccactgtgttggaggccttcttcaactcttaattagcttgctatgagtggagatgccatcttgactggctctctgggaaccattaggcagggccactgaccttggcaactctaatatttatctctgtggaactgagttgtgaaactaaaaggcactgcacaggtgtttccaaatattttaaaccagcaatggagagactattaatttaggccattaaaactaactaccaatgtatagagtgacctggtacaggacactctgcaggtatcaatctacctttgggtcagtagcacagtgccccttgccttctgccaccacattagaggcatcatttttatttttagcctggacataacagctggttaaattatgtgaggagtagctcttcttgataagatcagcaaagatgctagaagtaagactgactgtgaaatagctgcagccaactggcctctcagccatcattcttatctcctggataaataagaagcctgcaattacattttgaaaatctctaatagtcagataggcaaaacaggacttccatggactcaggttgaaaggtttgattgtgagttgtgatttaaggccaaaggaagagaaatagccaagagagaacagtatagataggagacagaatctcagtaatgaactagcaccagaaaatcttctgcaaagaatatacacaagaaataatctccaagacacaggatttaagcttctgcattttctttctattcctaacagtgtgcctagcaaccgctgatatagtacaaattttgctgaatgtcagatcgagagctctggaaggtttatatctgcaggagattaaggtacaaatatttccagattcgtttcagggtggcaagatcaactcacagcatgaggcttctgtcatcatagagatgctttgtggtactttctcttctttcgtaaatgaactggcaaaattgccacttgagtcaaatggaagaaggcaaaatgttgtgttagctgttctggggagtgagtggcatgtttcctgggccagatagtggatccatattcagtaaggggactgactcagtgctctttgtggaactagaagatcagaaaacaactgatcatgcttacgttgtattcatgatggccttgaaaagaaacatttccacccattatgttaccactatattgaacatgcactaatagaatagaagtggaaatcatcagcattaacacagattaattttatgaaaggtcacagccagattgtatacatggacatgccataggatggaccaagataaatctttaccatttatttagttcttcattgctctgggaaacctatattttgtcagttacaggaaatatatagctcaatggctaccattagtttgaaaaataacagaggatatattttggcctgaaaggaacagaggtctaatgttattgcagctgtaataaagaactaagcgcctgaccttatgcttgaaagagttaccaggtgaagacagagctgttcacttaaagcactcagattcagaagcaatccttaaaaacaaaacccagaggaaaaccatttaataaacaaataataaggcatgctggagaggcagttgtgggagtctaagtgtagtcaagtgtttccgtcttagtgcttgttccacttagccagagctctgggtcacctgggatttgggccctgggaggggataacagtgtgtacgggtttagcactggactctgctgtgcattcaacttggagataccataggccaactggagctcacaggcttcacagcttcatcgatttttagcttcagtgaggataatagggagccaaaacaagacaatttcattgctccatctctgctacctcatttctttttcctcagtatgcatttagacgttgcagagagttcatgggacagacaaagaaaaccctttgctgtgttcacaaatggtccaagactgaattaagaatcacaatgatattttctctattagttaatacattatttaactttatattatacattgagtatttaagttgttttaagtgctgttttacttgcatatattaagacaaatattacctggttgatttccacacagtggacttttaaaaaatcattcaatcaagagctatcttggtatgaaggtaaggaagcgacaagcctctgtggtagacattgaacttttcatattttggatatatctgtcctcttttttcctttgagaacacacaagagaatccttattattaatttgttaattcagaaacctttcttgagtaagctacatatttttataaattcacacttacaaatcaagaacctgatactacctgtaatcctaacaaataaaattaaatctttctcagaccccacgtgccaatattcatgattgtcccatgacagcgagtggtgcctttatcttttacaattattcacgcatcaagcttaagtattttggtaaatgatggagacacgctcctcagtgccttagtcctccttggagaacatgggaagaaagattgttcttctgcaatcataagcagactgtggccatccaagaatccaagtatattcttaaacaagcttggtctcaccaaaaatagttgaatagaatattgcccagtcatcaagaaatcagcaaacattttaagcacctttaaagtatgctgtgctaggcattctgatgggatacaaaaaatgtgaggatacattttaattaaataaaaacaatatgagtttctgtcctcaagaaacttataattgggaaaagaaaacaaagtacagtattcaatttcttcctggttcagttttgggagattgtgtgtccggggttttatccatttcttctagattttctagtttgtgtgcattgaagtgttcatggtagtccctgagggttttttgtatttctgtggggtcagtggtaatgtcccctttgtcgtttctaaatgtgtttacttggatctctgctctttttttttttaattagtctagccactagtctatttatcttcttaatattttcaaagaaccaattcctggattcattgatcttttgtgtggtttttcacatctcaatttccttcagttcagctctgattttggttatttcttgtcttctgctagctttgtggttagtttgttctttgttctctatttccagtggttgtgatgttaggttgttaatttgagatctttctgaatttttgatgtgggtgtttagtgctgtaaacttttctcttaacactctcttagctgtgtgccagagattgcgttatgttgtatctttgttcttattagtttcaaagaatttcttgatttctgccttaatttcattatctacccaaaagtcttttaagagcatgttgtttaatttgcaggtaattgtatgggtttgagagattttcttaggattgatttctatttttgttgtgctatagctgttgctacaattttgagttttttgcatttgcctgaggattgttttatgtccaattgtgtggtcaaatttagagtatgtgtcatgtggagatgggaatatgtactctgttgttttgggttggagagttctgtagatgtcttttgggtccatttggtcaagtgttgggatcaggtcctgaatatttttgttaattttctaccgcaattatctgtctaatgctgtcagtcgggtgttgaagtctcccactattattgtgtgtaaatataagtctcttcataggtctctgagaacttgctttatgaatctagctgcccttgtcttggttgcatatatatttagggtagttagcttcacttattgaattgaaccctttactgttatgtaatgcctttttttttttttatccttttcatctttgctggtataaagtctgttttgtctgaaatcacgatagcaacttctccttttttttctgttttccatttgcttggtagatattcttccattcctttatcttgagcctgtgagtgttatcgcatgtgaggtaggcctctcttgaagacagcatatcattgggtcttgctttgttatccaccttgccactctgtgccttttaattccaaggacatgaacagacacttttcaaaagaagacatacagtatgcagctaacaaccttatgaaaaaatgctcaacatcactaatcattagattaatgcaaatcaaaaccacaatgagataccatctcacaccactcaaaatagctattatgaaaaagtcaaaaaataacagatgctagcaaggttgcaggaaaaaagggaatgcttatacactgctggtgggaatgtaaagtagttcagccattatggaaagcaatgtggtgatttgtcaaagaacttaaaacagaattagcatttgactcagcagtcccattacaggttatatacccaaatgaatataaatcattctgccctaaatacacattcactgcagcactattcacaatagcaaagatgtagaatcaacctaaatgcctatcaacagtagactggataaagaaagtttggtacatatatacaatagaatactatgcagccaaaaaaaaaaaaagaacaagataatgtcctttgcagcaacatggatggagctggaggccatcatcctaatcaaactaattgcaggaacagaaaactgagtactgcatattgttacttataagtgaacacatggacacaaagaggggaagaataggcactggggcctccttgagggtggcgagtgtgacgaggtggaaaatcagaaaaaatatttggtactttcttattatatgcatgatgaaataatctgtacaccaaacctccatgacacacagtttacctatgtaacatgtttgttaacctgcacatgtactcctgaaccaaaaatgaaaatttaaaaaaaacaaaatatgaacaaagtcccaatgtaagagacaaatatcagttcaattaagtacagatattgattaaattggtagcaggaataataaatacttcagcagagtagaagaagaagaaatggccatgggctatcctggcctttaagataaatggaagaaaatgaatatgagcagtatcctgaaggattggtaagatttacaccaatttcattccgagcggatgttctagcatgcacaaaagtaaaagcaggaaaatgtaaaatcattaggtatgatgatgatagtagttaacttttattgagtacttgagagatcccacgtaatattgattaatctgcaccagaacatctaagacaaatttaagacatgccagtggaaaagcttagccacagattcgatgtaggtgataaaaataaagggaatgagaaagctaaacattgggagaaattagcaaaaactccaggtcttcaagactgggtagctggaagaacatggtatagatctactaatacgagtgtcttttgacagacctggtttacagagaagagatcagggttttgtatgatatttatttatttatttatttatttatttatttatttatttatttattttgagatgggatctcattcttgtctctcaggctggagtgcaatggcacgatctctgcacactgcaacctctgtcccctgcattcaagcgattctttggccacagcctccctctagtagctgggattataagtgctcaccaccatgcccagctaatttttgtatttttagtaaagatggggtttcgccatgttggccagtctggtctcaaactcctgacctcaggtgatctgcctacctcggccttccaaatactggaattgcaggcgtgagccatcatgcctggccatgagataatttttaatgaatttaatggaatgattcaagaagaaatattcagtaaacatttagaaagttgggaactgggattccagagaggctcaactggaaaaacacttaatagtcaaatgcctagggaaggtagcttcattcaccagaatgaaaccaaaaattgtgaacctcctttagaagttttacatctagagaaccatgaaacaaagtgaattttcatttatctttaagtccaaagagaacttaataaccctcatgtttctcatgatactgtccaaaatccacagatccccaggaaattatttcttgttttcacagagacatgcgtattaaagctaactgaagaaggcaaaaaggaaaacaaaatgactgtgaacagactaggtgtatctgttctgttcatatcctttgcccactttttgatgaggttgtttgttttattcttgtaaatttgtttaagttcctggtagattctggatattatccctttctcagatagattattagccctttgtcagatggatagattgcaaaaaattttctcccattctgtaggttgcctgttcaccttgatgatagtttcattgctgtgcggaagctctttactgtaattagatcccatttgtctattttggcttttgttgccattgcttttggtgttttagtcatgaagtgtttgcccatgcctatctcctcaatggtattgcctaggttttcttctagggtttttatggttttaggtcttacatttaagtctttaatttatctcaagttaatttttgtataaggtataaggaaagggtccagtttcagttttctgcatatggctagccagttttcccaataccatttattaaatagggaatcctttccccattggttgtttttgtcaggttcttcaaagatcacatggttgtagatgtgtggtattatttctgaggcctctgttccattccattggtctatatatcctttttgttaccagtaccatgctgttttgtttactgtagacttgtagtatactttgaagtcaggtagcatgatacctccagctttgttcattttgcttaggattgtcttggttatatgggctctttttttggttccatatgaaatttgaagtagttttttctaattttgtgaagaaagtcaatggtagcttgatggggatagcattgagtctataaattactttgggcagtatggccattttcatgatattgattcttcctatccatgagcatggaatgtttttccttttgtttgcgtcgtctcttatttctttgagcagcggtttgtagttctccttgaagaggtcctttgcatcccttgtaaggtgtattcctaggtattttattctcttcgtagccattgtgaatgggagttaactcatgatttggctctctgtttgtctatttttggtgtttaggaatgcttgtgattttgcacatcgattttgtatcctgtgactttgctgaagttgctgatcagcttaaggagatttggagctgagacgttggggtttctaaatatacaatcatgtcgggttttctaaatatacaatcatgtcatctgcaaacagagacaatttgacttcctgtcttcctatttgaatactctttatttctttctcttgcctgattgccctggccagaacttccaataccatgttgaataggagtggtaagagaggcatccttgtcttgtgctggttttcaaagggaatgcttccagcttttgcccattcagtatggtattgcctgtgggtttgtcataaatagctcttattattttgagatatgttccatcaatacctactttattgagagtttttagcatgaagaggtgttgaattttatcgagaacttttctgcatctattgagataatcaggtggtttttgtctttgcttctgtttaagtggtggattacattgattgattagcatatgttgaaccaaccttgcatcccaaggatgaagccgacttgatcatggtggataagctttttgatgtactgctgaattccttttgccagtattttattgaggattttcacatcggtgttcagcagggatattggcctgaaattttcttttttgtgtttgtctctgccaggttttggtatcaggatgatgcaggcctcataaaatgagttagggaggagtccttctttttctgttgtttggaatagtttcagaaagaatggtactagctcctctttgtacctctggtagaattcagctgtgaatccatctggtcctgggcttcttttggttggtaggctattaattactgcttcaatttcagaacttgttattggtctactcagggattcaacttcttcctggtttagtcttgggagggtgtatgtatccagcaattcatccatttcttctagattttccagtttatttgcgtagaggtgtttatactattctctaatggtagtttatatttctgcggtgtcagtgtttacatccccttggtcattttttattgtgcctatttgattcttctctcttttcttcttattagtctggctagtagtttatctattttgtcaatcttttcaaaaaaccagttcctggagtcattgattttttgaagggtttttcatgtatctatctttttcagttctgctctgatcttaggtataccttgtcttctgctagcttttgaatttgtttgctcttgcttctctagttcttttaattttgatattaggtgaacagacacttctcaaaaggagacatttatgcggccaacaaacatatgaaaaaaatctcatcatcactggtcattagagaaatgcaaatcaaaaccacagtgagataccatctcacaccagttagaatggtgatcattaaaaagtcaggaaacagcagatgctggagaggatgcagagaaataggaatgcttttacactgttggtgggagtgcaaactagttcaaccattgtggaagacagtgtggcgattcctcaaggatctagaactagaaataccatttgacccagcaaccccattactgggtatatacccaaaggattataaaccattctactataaagacacatccacatgtatgcttattgcagcactattcacaatagcaaagacttggaaccaacccaaatgtctatcattgatagactggataaagaaaatgtggcacatatataccatggaatactacgtagccataaaaaaggatgagcgtatgtcctttgcagggacatggatgaagctggaaaccatcattctcagccaactaacacaagaacagaaaaccaaacaccacatgttatctctcataagtgggagttgaacaatgagaacccatggacacagggaggggaacatcatacaccggggcctgtcgggggagtggggaagctagtggagggatagcattaggagaaatacctaatgtagatgacaggttgatgagtgcagcaaaccatcatggcacgtgtatacctatgtaacaaacctgcacgttctgcacatgtatcccagaacttaaaatataataaaaaaaaaatgccaggcgtaaagcaagcagaatctgtcagctccctttcattttagaggtctgtggagcatgttgtacaggtttgcattaattccttcagaaccagagaaaggtatcacttaatggaaaacattactgattgagaaatggtatggtttttttgaggtctaatgcaatattttgaatagagaagaatgtcagctcaaaatctaaaatgttatatgaatgtcaggagaagaaaagtggctgtatatgtttgtatatcatgtgtgtacttgagtgtatgtaggcctacacatgcacacacaaatacacacaagattttcttacgtttatccacatgataatggatcaagaccgtttgtgatggccaaagatgcacaaatttatatgaacacctaaattatgttaggatgggagtgaatggaatgattttcatcaccttaatactttgtaatgatcatgaaaggatttttgaaaaaaagaaaaagccctaatgatttttgaaaataataatagcagagggaatcccatgcaaaatcagtttgttaggcatgtgaagattttaagtaatgcagaaaagtaaaaaaaataccttccctaatggtgatgtacagaaacatgtttatcatcaatgcttttataacttttctctcatctcagtttctgttagagaattatgcataatggattgtgtatttaacaggaattcctcgattgcaatggctttttaaaggtttttttctttagttattaatagaatctttcatttacagcctaaatattgctgtcatcttagagaaacagtgaagtatcagagaggaaataaaatgggataaaatggatattcagaatgtcttgctacctgaccgttacttaaaacaagataccttttctttcttttcatgaaaacaaaactatttgtcttcactatccactctgttaaggaaaataattttctcaatatataaagtgaggcatagagcatacttaaggtaaactaaatcttaagataagtgaggccagagtaaaggagcaccaagcctcacttaaatgggttcatagatctaggctgcagtctgttactgttgaaacacatgatacttttacaaacataacaaaacaaaaaacaagaacattcaggtgtttcagtagaaaccgacagaaaagcgttttaggaatgctgtagattagggaaaattccagagagctcacagaacaacaacttcacttcttttgacttttaaagaaaaggtaaaagaataaattctggaaaatacagataccaccagaaacatttgtctgcccttgtaaattagggaatataggtttggtacctacagagtacaagacaaatgctcatcatgttgtgggggaagcaaaatttaaaaacatgtggactctacctaacctcagagagcttgcatgctaattaaggaattaatatgcaattataaattggcatttgacaagtagcactggaaaggcacagaaaaggtgatttattattcagagaagtggtaactttgatctgtggacatctagaaaagttatctctttggaaggtgagctgggtatcaaagagaggagactttattttaaaaggcaggtatggggtggagaaaactgtcaaaacaaagctatgcaggcagtataatattgcagcaagctgctgaatggaaaaaccaatttgatggaacatggttggatgtcagggaaattgggagatgtgttcagaagagtcagtgaaatttgactgcagatggtctatgaggaaggtgacgtgctacggcatggcgaagtgtgttgagtaggcacccggagactagagtttctgttagtctctgtcactcactcactgtgtgtacttgaggaccatttgacctccttggcaagtacacgtcttacctggaaaacgacggtgtctagttggagaccagtgtatcaactcacggtgattccatacagcaaatttttcttccaggtttggggtagatcaccaggttattgattaaacaccacacaaagtaattggcttgagtttaggaaccatgttttgaaaaaactgttatatctttaaagagaagaatcatcctcagcctggggagatactcacattatttcagagacacaagaactgaaacctcccatgagaatggtggactgggtttgtatgttccaactagcactcattccggggcatgtgctatctacagcgttctgtctctataggtatgttttgatgtgcttgtttttatcctttttcacagcacatatagtggaattcatttaaattaatatgtaagatgcatttgggcctttcatctcaagaacaagaatatggaaaccaaagttatttaaaactctagtcaaaggactgccttgaaataagtatcaaaactccaatatcaactttggcttcaaaaaggaacctaaaggcatttaacagtgtgtcctaagggatcaaatgtcaaatatgatggttactaacacacaggaagaaaaggaccagagctagaaaccagcagtaatatcttccagtatttttgggggagatggaagctgaaaaggatgaggaagagaaaaggatatgaacactgggtttcaaactaactttgctgaattatggaaagagaagaaatatttatttctgctgatatatcatgaaaagttactattaactgaattatttcttttcatttcactcttttctattaaactaatgatcaaacaggttggttctagccacttagaaaatgatgttgaatatgtcttgaaccaaaccagtagacgagttagtttaactgtatgaattaacaactaaagaaacacaaaatgctcatttttaccaggagttaaagctatgtgttttctgtaactaccaaactggaataaaaaagttatctcaataatcggtgtactgtatatgaattgatatctcatttaaattaatctacatcacaaaccttgttcagctttactcctgtctggccaaaattaatctttataatgaagtaccttaggtattttaggataccagtatgtattcaagtgagcgaataaaaattcagttgtctttgctaaaatttctggcatgtttagtgttttaataagttatctatccaaataggtattttaaggtattagtttcagacttccttttggtaaatgtgtttatatttgtaagttttaactggctagttttataacatatattaatttctaaacaggatttagagcaaaaaaaaacccaaacatactttgcttagtccacatttcactttacaaagtaccactggtcagctcagtgatactttctccagtttgtgggtcatttcatcctgcatttgtacaatgattttgagtaacacatcagtagtgaggccagctgattttgttatacccagagaagacttttaaattaaagcttgagaacagaaaaaaaaattactgaaaattgaggatcagcaaacttttcttgtaagtgggtaggtagtaaatatatatattttttattttataggcgatatgatttttgtcacactacttgcctctgctatagtatcacaaaagcagtcataggcaatgccaaaatgagcaagcattgatgtgttccaatattacttacaaaaatagatgttagactttcggcctttgggtctgggatttggcatttaggccataatttgtaaggaatttggccaaagctcatagtttcctagtcgttgctaaacatgacaggggccccaaatgaggtcccaaaatgagttctgaagaacgtttgtcccatgggattttcatggatgaaaaagtaaatctaggaaatgctgcacagaatgcctttcttcttacacactgaaattcaatgtcatcttattaaaggctataagacatcttacaataaagtgatctgtctctgttggctaactcagttccccagaacacatgtgaccttgaaattctttttgtcatagataatttgagtatctgtgattcagaaacaagtttccaaactgatcatttggatatctatatagattgtcatatgcatatctttattgaaatatctttttaaatccgagtcaacttcgtgagtcacttatccacaaaggtaaccaggaaaaatactaaccttcttaagtggttctggataatttcctgattagtcccttcttaggttctaacacattagctcctgctgacaatttgagccgttggccttattctgctttttcctcggtaattaaatccattgtagtttaaatcagttcaacatatatttaccatgtacgatattttccaagcacaccgattaatgaatgagagagaccgtgtctctccctttagggcatggatagtagcaaaggcataaagacaaaggttagaatattatgtgataacttctctaataagagaaatcctgaatgctgtcaaagcacatatgagaagtactaaactgttattatgaaatcagagaaagcttttagcctggagttcatctaagctacaaatttgaagctaatcacagaagggaagagagaggggaacagcaggtacaaaggtaaggagacaagattctctgatgtatcaaggcagtgcatagtacaactctaatatagatttatgctgcagagatgggtgagagttggattaagcaggtttttactgactttgtgaaagtatgtaaggtaggtggaaagttggaggcttgatcagagttgtactatggtaatatagctgtggctggaacgtggagaatggcctggaggggcacactgctcagaagtgagaatttctgaagctgttatgaagctttcccagggaatctgccatgggtaacctattaccccaggttcatcccttagacagataaggtgctgtcaagactcctaccttatgacaagaaaccaagagctacgtaatgtttttttccctgaaaccatctgtttgctagtgtaaacattaaactgtctttccatttgggggttactggaaatatcataaaaagggaataattttagactttttttaaaaacttgaaaggaggctttattatgtatttatagcaaaacaaaaattggcaccaagaggctagcctgagttttatacctgaaggaaatgtggaggcaaacctgggcattttccttgacaacagcaattaaccaagaagagcctcaccttaacgtctgttttaagacagcagaactggtcggcatatgaatatacaaacgtttaattacacaccctgcctgtccttgtgaacctctgtggtttacttacaaacgcatgagttatttcacgaagttatcctcaatcaggatgcagcatagtgttgtgtttactacatatgaaacatgcacaccttatccagtctgacacactgaagcacttaaaaggatgtgcagtaggtttttttataaacaagtagggtttttataaaccattttcttccacacaacaaattatactgttaacagctcggccctggtaagttttatatatgtgtgcatatataaattttatatatgtgtacctacaaacacacatacacacacaaacatataaaaatcacattttatatatgtgtgtgtatatgtatataatacatatattatttggaagtgtgatttctgtatttttcctgtattctaaccatatgaggaatgtctactcaacattgcttagaaacacaagttctaaggtccaaacttaagggtgtgtgtagtttagttagtggctgctatggttgttggtggagagtcagatgttgaaaagaaatggaacaaagttttttctaaacttgaaaatgctgtcttgaaatttgcagctaagatgtagtaaaagaggggctggtaggcaagaaaagaaaaactgtatgtaggcatggatcttaaacaaatcatgaaattgaattttcctaaagcaacttaaactatttatgattttctttgtcctttgccagatctctgaaatagcgtcagtctcaaaattcatgttatcactaattaggattctatcctcagattttttttgcagatgattcaactatttcttagtttccacagataactaaaattactacagtttctcctaccaacaataggcctagactgctaatccaaggaggaaatttgatgtcagaaaaagacacaaacaaagcaaaaatgcagtgttaacagttattcccacttttatctttctttacatagatctcacatcgcattgcaaggagcttacgctagtagtaaataagaaatttaggggaaacctgcatgctgcatttttagcatacaagaagtacaaaattctggctttatttttttcttcattaatatgcatggtaggccaggcatggtggctcacgcctgtaatcccagcactttgggaggccgaggcgggcagatcacgaggtcaggagatcgagaccatcctggctaacacggtgaaaccccatctctactaaaaatacaaaacaaattagctgggcgtggtggcgggcgcctgtagttccagctactcaggaagctgaggcaggagaatggcgtgaacctgggaggcggagcttgcagtgagctgagattccaccactgcactccagcctgggcaacactgcactccagcctgggcaacagagcaagattctgtctcaaaaaaaaaaaaaaaaatgcatggtaatcttggttcttttcatacctacgtttgaccgttcagcagtctaattttaattaaatcataacaaagtaacaacattgactatattgattgcatcttgggaattcagaatttattttttcacataatttttcctatgactagctggtcttctgtaggcaaacttttatgatccttgaactttttctggaaatgatgcagcaaactataaatataaaatctgcaatggtatactgtatgtacatatctttcaaggaggatagctccactgatgtaaaaacaaaaagatattaaaaactctgattttcaagctagaaaattatttatgcaccattggctttattttaaaatacatacttgcagaaaagttgcaaaaatgtcagcgtttccatacgcccatcactctgattctactaatgttaatattgtacgtaagtatagtatgatcaccaaaccagaaaactgacattggtataacactgttaactaaacaacagaccttattaggggtttaccagtttttccataatgtccaggctgcaatccacaatcttgcattgtttatagcattcatttcttcttactcttcttgagtctgtgccagttcctgagccttcgcctgccttttgtgatcctgacacttttgaaaactactagtcaatcttgttgtagaatattactcaattttctgatgttccctcctttttttttattgatgtcatgcattgttggcaaaataccatagaagagtattatgtccctctcagtgcaccctatcaaagggcacacgaggccagtatgtcttatcactagtgatactaattttgactatttggttaatatggagtctactgagttttcccagcatgatattagtgttttcccacattagctttagacaaagacacataaattcttaatttcctaaatatgatatactcactatactcttttatgcctcagtttccctgcctaaaaattattatactgcaaccctaaccctcatctcaaccagtgtagtaagaattaatgtgctgtcctttggagattcttggataaaactcactgtataactgcaaatgatcactctatctcattttaaagaagaacataaatagaatggttaaaagtagattggcagcatgtactcatttcacacccagaactacagagacatctgttatatatgtgacaggccaggcctgaaatctggttctctgagaaccagttagtgtttgcccgatttggcctaagtcagcctgattaaacaaagaacatatttatcacttgctacctaacaggctattacactaactagatggataaccacccattgataaggacaataaataactttttaaaaactgtcacattcagggtttctgctgttcatataagagggaaaaaagtcccttgacatactaaggattctggatccatgtgctgtaattctgtcatattagtttgtatctgataatgaagtaccccaccattgcagagaatggcaaacttcgcaaagtgatttactggctttctactctatttttatttttgaatgtcagtactatcagccctgacacaatacactgggaggaaattggccacttacaggtctagagggaagtaggtagggaaaggtatactaaagaaataagggactcacataatcctccaagccccgctttcctctttgacaaatggaaataatcatatacctgcctcctcaagttattgtaagcatttggtaatctgtccaaaacctttgtattgtaactgacccatagtaagtactcaagaaaaaaagaaaaaggttgtcatttttatcactttatcatctttcatacctgagacccagatttgggtgcaaaagacaagaaaatggaggtgaggctctcataaatagtgtggtttaatttgcagaaggcttctggaaaatgattttataccaaataagaattcaatagcatttgtcaaatggggtggaaatatcccaccatctgcatgtagtcatgaactaaagcatgatgatactgaggtgtacttctgctctttgagagtatgtgttcataggcaaataaacctagaaaatgaagaagaatgcaagctccatgatagcaggactgaactttaccgtgatacccagtgcttgctggtacagtgtctgacatattgcatgtgttcaacgaatattttcagatgaatgttctaatagttagctataaatacataatggcacaggatcttgaatacacagtttatttaccattacatgagatgggagatcccatattatagtttagctaaaaagtagggggatttcctgtcccaacctccacttatattgttattattattattctttttctttttcttttttttttttaagacagggtttcactcccatcacccaggctacagtgcagtggtgcaatcatggctcactgcagcctcgatttcccaggctcaggtgattctcccacctcagcctcctgagtagctgggactacaggagtgcaccatcacacccagctaactttttgtatttttagtagatatggggtttcaccatgttgctcaggctggtctcgaatttctgggctcaagtaatctgcctgccttggcttcccaaaatttggggattacaaatgtgagccaccatgcctggcccactccacttattttaagagaatgacttctgacttccttctaagtaaaacaacacttatattatgttccttttgcattatggtggtaaccattttacttgtgttatctcatatacttctctacaaacttctgaagtaggctcagtatctccgttttatggacacaaaactggaggatcagaaataacttgcctaaaacaatacaagtccaagacttgaacttaagtctatctacaaagaccatttatgttcttgactgatactgttgcatttgtgcactgttgcagccctcttagagtattatattatcttcccccagtagagtaaaataatctccatgagggaagaccctgtcttattcattgctgtatcgtactgcacgtcagttactagatgttcagtcactaatttgtaagtaaaggatagagtgccgtagtagattttatttaacaccctactttggtatagcctattacaacttcagtttttatgtttgaaatcttatttctgcttctgattaagcagacatagactcccttttaggctaccagttatctgattttctgatgtggctgtccgagcaatcagcaagctgtgcgtaatgatggacatactagtaagcttacttccccactaagtgtatccaagtaaaagccctgaaagtcacacggttcttgccacttttaatctgacacctaatatattaggtattagagtgttttgtgcttacctttagctcttctttagtttaggtgattaaaaaatgcctgttgctgtctgtatgtgcagcatgcttcattaacagtcatttatttgggaggttagcagaattggcactctgcagcacaccagcgagcagaaggaaaacaaacgtgagatgattgctaagaaatccttctttcctgctctggtgatagaagctttaagagtttgcaaagtttacttcccagtacccagaaagcatgggaaagagcagggtttctggggattgcaatttcccccaagtcccttgcatccgctctcctccagtgctcagtgggaaatccaaggggtcatggatttccccctttggcacggtgtgctccctgtatttgtggtctcccagaaccagatccttccactgcttgcccctcttgttttttccagcaagtttgccgactcaaactttttctagcagaatccaattatatggattttctctcatattcctttcaacaaccctgtattttcactgtcactttatgaaagaggaaagtgaggctaacagaggttaaatgacttgcccaagaacaacagctaaatggtagagctgggatttaaacctggcttgtgtgattctaaagccaatgatctcattgccatagggaagcaaaggaatttttattttacttgaaacctgtattgattttgtcatgtgtacttgaaatgccatgctgagaggattctggggctgcccttgggctaagcagcaaagagtgccataatcaattagcattgctttccataggagtgggacagaggagtggaggtgccatgtattttcctgtcttgaactatgatctacttttgttcttgattttattgtaataagactgtaataacacgggaatgacattctaaaggaaggatgaagtatctgaggggcaatctaaatgcaagatgaaaataccacatattttatatataaactacaattgcctgctgttctaataataaggctacatatacctatttgggagaaattcaacagagtgtttaaatatccacaatcttaagtcaaacttcataatctcaacttttattttaaattcagggggtacttgtgtgggtttgttacataggtatattgtgtgatgctgaaattaggaggacaaatgaccctatcacccaagcagtgagcatagtacccaataagcagttttcagcccttcctcccctccttctctctttgttctactagtccccagggtctactgttcccatctttatgtccctggatatgcaatatttagctcccacttgtaagtgagatcacccagtatttgtttcctgttcctgcattaatttgtttagtataatggcctccagctgcatccatcttcctgcaaagaacatcatttcattcattttcattgttgcatagtattccgtggtgtgtatgcaccaaattttctttaatccaccatcgatgggcacgtaggttgattctatgaccatgaatagtgctgtgacaaacatacaagtgcatgtgtctttttttttttaattatttcttttcttttttttccttttcttgtttttgagacagggtcttacactgtcacccatgctggagtgcagtggcacgatcttggctcactgcagactccaaatattgagctcaaacaatcctcccacctcagcctcacaagtaactggggctaaaggcaggagccaccacggctggctaacttttaaattttttttttgtagagatggtatccccctgtgttgccctggctggtctcgaagtcctggactgaaacagtcctcctgcctcagcttcccaaagtgctgggattataggtgtgagccactgtgcccagcccaatttatttttctctgggtatatacccagtaatggaatttctgggtcaaatggtagttctgttttaaattctttaagaaatctccaaactgctttccacagtggctgaactaatttacattcccaccaaaggtttatgagcattctcaggattcattttgggagtgatagaaatattctacatcatgatggtgatggtggttgtatgactgtataagtttttgaaatctcatcaaactatacataaaaagaacgcatgtcagtgcataaaatatacaataaacagggaaaatcagagaaagttctatctattacttattaatttcaacttagttaacccataaaattaaaatcatattgttgtttaccttcaaggtttttttaaagattatatgagttaacaaataatacagaaactactatatagtaaatgctgtttaaatggtatctattatttatcatttcaccagttgttttgtactatattctaccattacgttatctccaacattgtttgccagtttaatcacatacccttttatgttgctgatttactacattgtactgtatactctcacaaatacataagcttcatatgtatggataattgtgagaaaaatcatagctttgaatacatggctcttctgtgtttaactaaacaatgttagaagactagaaccattcatgtctgtttttcaactgaattgctgaagtgttaagtatctatatgtccaaataaataatacttattaaaaatgatggactgtaaggtgtgtttaaaaatattgaaagcattagctatgatagaatgtttaggatgaatttgtggtatatacttagaaacctgttattaaagaggaaataacagtaactcagaaaaaacaagtactataaaaaaaaaaagaaaagcagtatactctcaagctcagctaacaaattaccaaattatgtgctataactaagtttagacaacagtgaagcaaggtatgtttgtatttgtgtattcctgtctgtcattgggaatgattaagagagttgaatatcatcattcataaaagaacttagtacatatgacaaaaaaatcaagaaatagtagtataagcatgttattttttcaaattatcattgttgaactacttaacagaaaagcagtttgttgcccctggacaatatttacctatggggactaacagctagtatttaagctatgttcaagcattcctttaataaaagtaaaagttaaataaaactttaaaaaattacaataagtgattacttagtgaaggctgtggatagtgaatgtggacttgtggcttggagttaaattttcagtaacagtttaatacatagaatttaaaagcaatatatctaaaacaattttaatggatgggaagatgatataatccgaaaaattgttacaagcctcaaatggctctagggatgacaaagacatagtctttacttcatttaactaattaaatatttttggcatatataaccttcttcttatagaataatgtaattcaaagtttcaagaatccttaaaaacaatctggcccagtcccgtcttctattcatgaggaaacttgtccagcaagcaaataacagcactgagcctggaacgcagttattctgaatcttatcccagtgatcttttgaaatatcactgtgattattgaggttacttccgttttttgaagagggtcttctcggtagcaaaatataaaggtccaacatcaaaggtagaataaggttttctataaggggaaagtatattttgagaaatccgtagtgggtttatactttaagaaatttcaatgaaagacttttccaaattaatccgtataactgtggactctcgggctatggaagacatccttcagtaagtgaaatgatgatacattagctacctggcttttatttcagaggatttctgcctaatgtactcatatttatggttagaatcttcacaagtggaaagtcttttaaaatggggagcaactgtgtaccttagctgaccctccatcattcctcaaggtcctctttaatgtggtattatgatattatgatggaaacggtgtctaaatcaaccattgggtaggtgagtatggtctaaataagggattccatcctatacatgtctgcctcttgtttaatagatgtagcttcccgaatatatcatccaggtcccttatgtcttcccctcttttgcactgttctattcatattttcagatgcttgggacaaataatctaatgataaaaaccaattaacacatattttctcatcattcctagcagactacttactgcaatctccagtcaagtttgaaagacatcacctataggaatgaaaatctgtttttactggtagatagagtataaagctggttaaaggagaaaatccagcaagttatttgattgactgatgtgataggaattttcattatccaagaagaacctataggctagctactgtaatcacaggacatacagatgacctgaactactcatttgacatataaactatatcttgtatggtcaataatctttcctatccaattgagctgtagtgtccttgtgggcggagaccttgacccaaaactcttcatattttgcattttaccaattgaatcatggacattcaacaaatatctattgactgattgaacattaagattttactgtatgccattttcctttaaaattattggcatattgctttctgaggaagcctatttaatctcttgctttcatttctgtttcccgcttcctcgccattgtgattgactgcacccctcattagctaattgtagagttaggaaactctcaactctacagatgggaactgtggatgatcctttttaaaaatctctgccttcagaatggtagcactctaaataataactagcaagaaagcaaatgtttatgttgttcttacacttaggaggaaagaaacttattcacagttatgctatcacaaaagacttctgaattaacactagtgaaacgtagccttccgacaaagtctcagctctgaaacctgtgctatcctttacattatgagtattacagattctgcaccttggcttactggcacctggcttcacttctgcagaaggacaacatgaaaagccaagttagagagaaaggagtcaccatcaggatgttatctcacacttgaaaagacacaatacttttagaagagttcattacctttagaaactagttcagtatttgaagtatgaagacatagatttaaatactggctctattgatttctagatatttaaccttggacgagtttcatagcctctcatattctaattgccaaagctctaattttatagaggatgatgatgcctgactcccagccatgttataaggattaaatgagaagtgaatgtaagatcacgtggcaggtccacaagagatgttagctgcctttattctttcatttacatactagctgttgattggctgcctgctctggtggttcactattctatgtgcctctaaaatgtcaatcaagaatacaaagattcctaccttcataaagttaaaaatctatttggtgggggccaggaggcagaatttgaatccaagtttaaataaacgatgatagttaatgctcacatacaaaacaagccagtggaccttcacagcacacttgtaagaaagatagggcttctggcatgatccctaacctacaagcaagcaaacatgtttacagagattaagtgtctttcccaaagtgaggtaatttgtagtaaatccaggaagaactcagtgtgcgtgaatccgtgttttcccactctgtcttgctgctatgaggctttgaaaaacatactctgttggaagtattcttagtaattagagatgtagtcaacttgctaaccagaggagaaaagcaaaaaaggtaaaatagatattatgtccttcaggggattgcattttaagcagatcttcatacaggaaaataaaatctttttaggtctttcccttcttgaaagtcattctcaccctcctcgtagacttcagaatcaagtccagaattttttttttttttctttttttcagacggagtcttgctcattgtccaggctggagtgcagtgatgcacgatctcggctcactgcaacctccgcctcctgggttcaagccattctcctgcctcagcctccctagtagctgggactacaggcatgtgccaccacacccaactaattttttctatttttagtagagatggggttttgccgtgttagccaggatggtcttgatctcatgacttcgtgatccacccacctcggcctcccaaagtgctgggattacaggcatgagccaccgtgcctggcctcaagtccagaatctttaatatacgttcaaagatgattggagaccaggctcttgatttaccttccagcctctttccccctcagcctataactcccaaactcaggctgcgctgtgctgtctttaacaaagatagctatgacgtttcaactttgtgccagtacctaagctcagtgctttccatgcattctcactaatccttaccataagtttggcagatagatatcttgctgctcttttatagatggaccacacagctggagagtgggaagtctaggaatagagcacaagttagattctgcagtctacgcttttcattttcttgcactgctgtaacttaaaggttctcacagcttcttgccagtttgttttccttgtcacttggctcagaatggccttcctccctcttatttatcctttaagaatcagttcaaaatggtagcccctttgaggagctttcttgaaactcctgccctaccctacctcccagctcagttcagtgataatcttttgcttccttaacatcttgttcttaataaacttactgcacacattgcaccgaattataatgactggtttattagcacctcctgctaagtaaactgtgagctccttgaggacaagacccgcacctccctaacctctgcacacccagcacctagcaccgtgcctgccacatggtaaacacgattactttttttgttgagctgaattagtactgtttggataccagcaacattttaattcagcagagtgttcaaaacaaataaatacatgaccaggccctgcatgtagattcttggaaaccaggactcttaagggaaaactgattcatgcttttgttttcagcactttgtactgaggtcttcagtgtcactgttagtatgagaattgtttgaagggttgagggaagttttgttctgtgcaagaatgtgaaaaaaaaaaaaaaaaaaaaaaaccaccctgtacaattctcagttattcatctcctcctggctcaatgagagaaagcaatcgaggcctgttttattgtgtagcttccttcttaggatttacgagtctcattcttgggcaggatctcaaaatgagtgctgagtacactacctttgctacagccactgttggataagccagagagagctcacagctgcaggggagatctattgccaccataactcttggctcatcctgcagctttctttctgactctgacagaaaaattgaaattatgaaacttcgtatcctgcaccagagtcccacgtgagattcatgaatcttcagctcccttcagaaaaccggatgctttggttaccactgcccactgacaaattactgtccacgaccccattatttctgattagcaaaggtgaaccttacctacctgaatgtaaataaatgccaataggattcgtgaaattcttcatccttaaaaatctacagcccttaatagaacatgcactgtaaatactatcatatcatgaactaaatctttatcaggtaattggatacatttcctaagctaattttaattgcttccagaaactgcttaacattgtagatcaatcccgaggtccgagatgacatttctctcacaaaattaattattaataccctgatcatttgcttaagacattaatagttttcattgatcagcacgtcctgttgatctaaaatggcctaatcaccatgcatgtcagaagagtatctgaacatatccaattagagatacggccagctttctgccacatcagcagatccgaagttaagagtcccttttgtcttcacaatatattaagtccagctctatcagaaactaagctatttaagggcacaaaagaaaggcgagttctctaatgatgcttgttcattttctgttagctccctggtaaacatacaggctttgcagtgatcacatggtgtaaattaacgctaagagcccattattaagtagcttgtgttggcccatgttttcatgtaagcctgtgtttgctcacagtgtttttcttataagtgggagtaagatgagaaacttcaggttattttcagcttaaaaatattggggctcccacagtgtgtacatatatcaaaatatcacattgtataccataaatatatacaattattatttgtcaatttaaaaataatataaatgtaatatatttttttacatgaaagctaaaataacaagttgagaccacagtaacatctggcaatgtagggtgctgcagagttttcaaagaagtttcatttacttaaccaggagttttcccttgaaacaagattcaaagagaggctaggtggagtggtctacctaggaccacataacaagttcctgccagagttgtaaatagaatgagatctcccggttccataaatttctggtttatttgattgactgatgaataggtagcactctgctcatctttcagaccccaagggaagctcacctcctttgtgaagattgccaaacaaaaagtttcctccttccttgataacgggatatcatattgcaattatatgaaattctcagtaacagcccctactggataaagagactctagaggatagagactgtgccttgttcctcttgatgggcccagtgcttcaccttgtgtctggcaagcagaagatgcttcacatatacattcacacatggcgggctggcaggatgggtgggagaagggatgagtggatgagaggaaccacagttgagagttctgttttactaacttcatgttgcaatccttcagcaccagagggaaatttggctttacttgagtcatacagtgtttaatttttttttttctctgagacagggtctccctctgttgcccaggctggaatgcagtggagtgattatggctcactgcagcctcgaactcctgggttgaagcaatcctcctgtcttagcctcctgagtagcagggactataggcgtgcaccaccatgccaggctgatttttaaaaattttccgtaaaggtgggggtctcgctatgttgcccaggctggtcttgaactcctggcctcaagagatcctcccatcttggccttccaaagttctgggattacaggtgtgaactactgcacctggccttaaaaagtattttgaactaattttcaatacttaaaacttaggagattttcaaaatacagttatattttcaacttttctttgaaaagtcgtagatgcccctgcaaccctggatctgtgttccacattacccatctgcttgagctgaggggcacctgttcccttaagcaaggacatgcctccattcctcagaataacagtgtctgcccacagcttcactcagttactcactttgtagcttttggtaaaggtaatgagtggcctctcttcactgcagaattctcctaattcagtattcttggctaacagaagtattagtgttcctaatcatgttctggatatatccaaatgaacctagtaggcagctactgatagctgtttggatttctctcattagacactggagctgcatacttctgtggcatgttagaagtgaaacacggggcagaggggaaaaattgtttgagttaatggggtagtcaccattttcccacacgatataactccattggaaaaattgggaatttctacctgaggtccaccagtgttaagcctatcttgttctgtggcagttctgtatttgctttttttttaactaattggaaaataaataagaacaggatctggacaaagagagaccttgcaaagcatagtgcattcccctgccttcaggttggttcatgcctaatcagaaactgttcttgtcttcactcagaagccacagggacacttcagctccaatccctgcccaattattatctgcaagaaaaaaataggagtcttattagctttatattcataatttaacatgtccctttcttcccctccaatggtactttcccacaagtgagttttattgatatttgagtaaagataaacttgcagagaccacaaggagaaatattcccaaatctcattgtaatgtctcttctttcccacagattaaaggttatacaaaacttaaaagaagcagcaattctattcgcttgttattggacttgaaactccctttgacctcggaaactgaagatgaggttgccatgggaactgctggtactgcaatcattcattttgtgccttgcaggtagagtgtcattttaaaactttttgatttagaaatgccactgtatttcacactaattcaaaagtgggccttcactttagacggcaatgataaaatcgcaagagtatatgctgctatgactagcatttgctgacactgttgaatataccttcctgatggtcttttagtgactcttttcatggtgttgtatccagagatagacaccgatgtttcacctgtctatctggtccttttagagtcgtttgagccattatttagtttgaaagttgttatttttgctcatcccagtgcccagttgcacagagatattgggcaataaaactgataatatagtctggagtgttgcctactttcatttcagtggatggacgtttatctggatagctctttcagtgtctttgttgataccactccatcttctgatactgactctctttttcatttcaatgtactacagtttagtaggaactagaaagcaaaacacaggaggtttttaccatatactcatggccaactactagaaaagggatttggaaagttcaaacatggctgggcgcagtggctcacaccattaatcccagcactttgggaggctgaggtgggtggatcacccgaggtcagaagttcagaccagcctgagtaacatggcgaaagctcatctctactaaaaatacaaaattagccgggtgcagtggtgcatgcctgtaatcccagctactcggggagctgaggcaggagaattgcttgaacccagaaggcgaaggttgcagtgagccgagatcgcgccattgcactccagcctgggcaacagagtgaggctcggtctcaaaaaaataaaaaaagaaaagaaaagaaaacttcacacatactctctattgctttctccattttctggaagatatgagtctagcagttgacatacatcattcaagtgctggtgcatcagaagtccagcatgcagcgggaattggtttgcagcttgggctgctgtgtatcattccacgcccctttgaaattagtctagttgacttgttttgttattcagagtgtcaagtccaagagggacacctgaatatatttgcatttttacaacatgaagcaaaaatgacttttggatcaccattactttgatgtatgcattcactcaaataatgttactgagtaccgtgtcacaagccagccctgtactgggatctgggaatataatcctgatcaaaacagacatgctactgctctcttagagctctattaactgagtgctgtaacttctgacaacttgttgtagtagattatttgcaattgctataaaatcaaaaataataatggtagtactgacatgtatagatcactcattctatgctaggcaatatgctaagcacgtggtatcctttatccaatttctttcttccacgacccttaagaagtaagcatttatcatttatttcactgtattaactatgaatattaatattatgactgaagcatcaggaagttaagaaactcacccaaattcacaaagccagtaagtggtcgagctaagatgtaaaccgaagccgactatagtcttgcctgttcatagcgtatggtcttttagttgtcttgaggatttggcaagtttatggttgcaaatttagttctgagatttttgttttcattcttcctatgtttttctaaatgtaaaccctcatttacttatacatcttttaatagtctaccttcatgtttcaaacttcttgccttagttgagttcacgtcttccccgctgcatgattgtgaacatcttggcatccctcttagtgatattatttatttcccccatctggtcagagccttcatcttcctcccagcagtatgcccaggctctaatacctcagttgtttttctctgggaccttgaccctcctaagggattcgactgacactttagagttttaacttctcataatgactctggtataaacgtactctttaagccataaagcagtgaattgatttctcatatttggctacagcataatgtttatttaacccaatgtgctaagtaaatatcaagatatgaaagggttaaaaatcaagaaagccactactctcttcagtagtgttttgaaaaacttgggggaattctcacctaaggtgtgtgtgtaactgtatctattttattcacttagctttttatagagaatcagtgtattgattgtttttgtgaggcttttttgtgacctgttttacacggcattaatattctcttaccatatgccttcttcagtgtaggaaagtcaagctttaattaatgtttttgttttcttgctatttgtcttgatttcattaatttacatagcactccactcgctgaattttgattttttaaactgctttaggccaggcatggtgtctcatgcctgtaaccccaacagtttgggaggccgaggtgggtggataacctgaggtcaggagttagagaccagcctgaccaacatgaagaagccccgtctctactaaaaatgtaaaattagcaaggcatggtggtgtatgcctgtaatcccagctacttgggaggctaaggcaggagaatcgcctgaacctgggaggcggaggttgcggtgagccgagatcacgccactgcactccagcctgggcaacaagagtgaaactccatctcaccaaaaacgaaaaacaaaaacaaaacaaaaaactgctcattcttttccttttgtgtatcatccataacttttctatacatcttcaggctgaggtttcttggtgagtttttggtaagggatatgtttacagctgttatgtttaccataattagtgactctcacatatgccttttcctgatctttttcttccccaagtaagacaggatccaaatatacaagcaggctcatcctgcaagggatgcaactgataagatctgttaattatttgagggcatttattagtactttatggtacaatgggaatgttctttttcgccagatgactcagtgtctggcaataattttcaaataaaccaaaactattgatgccagtaatctaaaagttcagccacaatgaaaattggcttcattattcttcttcttcaccaatttaaactcaagatcataaaaccctgctacctaaaaaagcaaggaagctaacaaatgagtaaaatgttcttacagaagtaaaagtgtacagtgcaacagggaatgttagtgactatggaaaactagaaaacaacatgccccactaaaatattaatctgtgcccggctctactcctttgtgacaagtctcccagtctttttttttcaatctacaaactcctaattctctaggatttccataatgttaatgaataaaatttaaattggttttaaaagtaaaaataaagggcctgtataaagcaaaccaaaatggtctgcaggctagatgcagttcctagtccaccactttgtgacactttatttcaaatgtttgctttacaataaactattagtatattttaaaataggtagaagagaagaagtctaatatttctaccataaagataaacaaacatttaaggttctggatatcccaattatacagatttgatcttttcaaattatatgaatatgttaaattatcatatgtatccccaaaatatgtacatctattgtataaaaataaaaagtaattaaaaaaaataaggccaggcacagtggctcatgcctgtaatcccagcactttgggaggcaaagcgggcggaccacttaaggccaggagttcaacagcagtgtggccaacatggcgaaacccagtctctactaaaatacaaaaagtagctgggcatggtggtgcacgtctataatgtcagctgctcgggaggctgaggcatgagaatcacttgaacccggaaggcagaggttgcagtgagccgagatcgtactactgcactccagcctgggtgacagagccagactcaggaaggaaggaaggcaaggaagaaagaaatgataccgcatacacttagaccttagggcttttatactaactttcttttgtcaagaatgctcttgccttaaatgtccccaggacccaccgtctaaccttctttaaatctgtgctcaaatgtcacctaattggtgaggcttttcctgaacacagtaaatacattaaaatggcaatatttattttgaccaatatcttctatgctttttattgcttgatttctcctcaaagctctcatcaatatctgaataatgatatattttgctttcttcttcttcttttttttttttttttttttttttttttgtgagagagagtctggctctgctgcccaggctggagtgcaggggtgtgatctcggctcactgcaagctccacctatcgggtccacaccattctcctgcatcagcctcccgagtaagtcttccaagtagctgggactacaggcacatgccaccatgcctggctaatttttttgtatttttagtagagacggggtttcaccatgttagccaggatggtctcgatctcctgaccttgtgatctgcccacctcggcctcccagagtgctggaattacaggcgtgagccaccacgcccagccgctttcttctttttatacaaaataactttccctactagactgtaaggtttatttgggtagatatttctgtccttttagttcactgctgtattcccagcatccagaaaatgtctggcacatagtgcaattcaataaatatttttcaaatgaatgaatgctgcagcctggccagtcatgagagaaagagactagatctccagtttcaagctgtgctatagaccccgggtgctttgtagtcaccctgataccaactctatggactagcaatactatgatgctaatccatacatgtttttcaaaagtcgatgtaaatatctaaagtattaaaattggtctgtgtgccttgaagtctatatcttggtgcaacactgcctctcccatttcttattttattttatttttgttactgtttttttcttttttttttttttgagatggagtcttgctctgtcttccaggctgaagtgcagtggcacgatcttggctcactgcaacctccatctcccaggttcaagcgattctactgcctcagtctcctgaggatctgggattacaggtgcctaccaccacgcccagctagtttttgtatttctagtagagacggggttttgccatgtgggccaggctggtctcgaactcttaacctcaaatgatccacgtgccttgccttcccaaagtgctgggattataggcatgagccaccacaccaggtcacgcctcgcccatttctgactttaactatagctggggtagaactgttcccctgttgtatttttctgcctcaagtctttatctgagtcacaagcaaggagaactatgggaagttaaccccgtccttaggggcagccttcagctaagagggcatgagaatcagtagataaatgcctctgtctcctgtcctttgggaagtcaattctcaggcatatttaacatactttcttaggggttcaaggctggattgagtctcagtttcccacaataactccttctacttttttcttctttacttctgcttcttggtatcacctcctaaataaactaaactgcttggaagtcctgctcttagcctctacttttaggggagtccaaaccagctaatagcagagaggcagcttagttttggtcatgtcagtaattagaaagaaagcaggtgggaaaaaacagctttaacagagatgattggagagttgactgtgtatgtattaatagatctatatatgtatgtgtatgcatgtgtttgcataatacatgctcacaaaccactgtgtagttatatctataaatattatctgggtcctgcaattagggagttttactctttttagtatttgcttgttttattattaaccagatgttgagcaagtcattgtacctaagattcagcttatacttctgtacaatgaaggagttgaacagatggttttagagtcctgttcaattccagtaatttacaattctatctgtacacatggtttgagaggaagatatgtatgccgatagggttagagctcagcctggaattctattcaactaatatgaaatttcacataggtcatatgctttaccatgtgctattgattctgttcacattggcagcatttgaaagaaagaagaaaatggctgctccatatgtttacgtgcagcaagaggcgtgaagacatttaaaactctctgtgaatgagcgcagaaatttatgcttgatacattctcagttgatcttggtttcaaggaggctaaatttattcccatctctgtggtgcagtttaccaacttcagcaattatctctttctgagaaagtgcatcctctccaaatgcaagcatttgttgatttgctcacaaaatctatgtcgttattatatctgcatctgggggcatgtagtggagaaagatcctgtataattcacaggagacatattctgaaatgggtgaatgttcacaaaaagtggagcaaggaagacccctggattgaatcatcaatcacaggatgtagcttgaatctatgatagacaaaaatatatacaaacctgcaatgagaacacatacaaagaatgctcattggtcttcagaaggcttttgaggctcaggaagtctcatcactaagactgaagtaggctgtctaaagtttgggcttattctagttctgagagcaaaaatacacaaaagaggaattcccagtatttgttaatgttgatgaaaggactccatgagcaccatttttctatctactcagaatatttcattaaagctcatgaccaacccagaaggatcctcccttttatccccaccaggatggagagcacacagtagttcatttcaaggcttgacctcactgcacagcaaggtataatatttcaattcccaagattctcacattttcccccagaataaacagagacacaggcaacagtcaaataattcacaattctacccatgtattaaacctagtactactctgttcttgcacaagtaacaaatattcaattaagaccaaaagagagctgagtgttagttttcatttagttactgcaaagcatagtcctgtattttattgtttctctttgtaagaaaatgacttgccggtgtatttacaatcatgctgaccgaagccaaagcctgggtttcctgtttgctctacgctctctcataactatggccataaaatgaagcccatgtggtagaaagacttagtcaagaagacagctaataactagattaaaaagcagtgactccattgatgaaagttaagaaaaaaaataggggaagtatacttagaaaataataaatagcaaatgcaaaacttcttttcaacataaatttaagtatttaagtccatagtgggaaaatgttaatcagtaatgaagatgttgaggtaaatagaggaactggcagcgattttatatccccataggcatggacatgtagtagcaagcacacaacccaaaagttattagaaatgttcaatttaagacctctcctgaagtaaaattgtgaatgggtccattagatatgctcagccatgctggatgtcttaactataagtaaaactcccttactgatagagtctagggcgtattgtatctagaaaaaaatggaagaactcttttgaatgaaacaatttaggaagacaggaaaaaaccagacaagtgaaaatccaattatgtgtacctaacgtcaacctgtgtgatcattctctgtttaaatgtgggatcagtgatgctgcctcaaagcttgaggatgacgggagcaggaacagtctggcagttggtatcatgccaaaaacaccagctggagacactgcagagctggcggttgagaatatggactccgaaattacatagataggtctgccacttatgagttgtgtgataaaggtacatcatctccctaggtcatgggtttctttttttttttatctgtaaaacaggcaaaataactgtatttacttctttaggctatctgtgaggattgagaacgtgcatatattctttgcacttagtgcagcatctgatactttgcaaacccactgattaatgagctattattcattgagtaatttaacatatgttgaaggttccaaatgtgggaactatgtttaacttagaactaagctatttaatatatatgttaaatgttaaatatatgttaatgtttatgttaaatgttaaatagcttagtttgaaggtaaacatagttcctgttatggcaatgataatgattatggtgacagtgatgttgacgatgatgttgccatattagtttcttagaacattagtttctggccattcttcagtggttgaaggtgttagaacagggtttacagcacatctggaccttatctatacaatggtgttacaataataaatacctatgcagaacaaatacctaaattggttaagcttgtatgtgtgtgtgtgtgtgtgtgtgtatgtacatacatgtgtatgtacatgtaattgtgggtagagcactcaggaaggtctgtcttagtacaggactaagtaacagttgttattaatatcagttaatatcaggactaagtatcagttgctattaatatcatcattagcagcagcaacaacagcaaaccagtggtgttggtgacagccagaacatttagggtctgtctcctggcagcaaggcagctaggacaagtgccaattagagacatccatctgggggcctggcagtggcagagagctgaggaggtgtctataatggtacttccagtagtttatcaagttgtaagaggatagggttccaaacagagtaggatccagtggttcaaaatgataactttgtaaatgcattttgcaacaacaactaacataaagaaaatagcacgtaaaagcccttaatgttactgtactggaatatgctgcagcacagactccattttccaccataatcttccattcctctccacacgcaaactccccttgctgattttaatcagatatttcacctgaatgaagaaactttgttggatgatgtagccccacttaataatgaccttaattcatttagtccttgtgagtctataaagtatttgcttaacagtctatttaagaaggctgttaggaattagagacaactgcaataataatagtaagagtaaaaagttattgggcatttatatgccagatacagcacctcagttttgtatgcactatcacccttaaactcaaaacaaccctctgggagaggtattatcctaagttcatagataaggggttacatgacctaccaataaaaccagagcttgtagaagtccaaggcagcatttaaatttaggtctgcccaggtccaaagcctgggcttttaattgtcatgctatgatgataactattgaaattgagtacctgtcttcataaagcttaccatcttgtaaaatactctgaaccaatggttaccaaaatttagttcatgaaccagcagcatcattgtcatctggcaacttattagaaatggggattttggggctcaggcccagacttacagaattggaatctctgcaggtggggttgtccttgttttaacaaggcctccaagggttgtgtttctcaatcttaccagcctgggtttctactccaagaagacaaggagagaggggaattatttctcagctaaagctataccttaagtactctgaggtcagaccagaatccatttagaatccactggtctgacctcagagactttaatatataaggggattctgatgcttaagaaaggttgagaaccacattaagcactcttgaaagacaagtaaggcagaaattatcagtatcccaattttacatatgagaatctgagagcacactaacatggtcaaggttatatggctgacataaacaaagctggactctagatgtattagtcatggttgactcaaagaataaggtaaatactgttttaacacatcccctttaagacaccttcatagaggagagaatgtcagagtcttgtatttagaaaaaacagtgaagaccagttttttttctcttgtaaagtttttccagagaacctgcaaattgcattgaccaaaacagaagtaatttgcacacaaatgttcataacagtattattcataatagccaaaaagtgggaacaatccaaatgtctatcaattgataaataagtaaaaaatgtggtagtcccatacagtggaatattattcagccataaaaaggaaggaagtactgatactacaacatggacaaactttgaagataccgtgctaagtgaatgaagccagagacaaaggccacatattgtatgattccatttatggactgtccagaatagacaaagccatagggacagaaagtagaatagtattttcccagagccaaggagtgagggaggataaggaacgactgctgttggatatgtgatgtctttttaggctgatgaaaatattctggcattagaaagcggtgatggtcactcaacctcgtgagtacactaaaaatcacttaactgtacattttaaaaggctgaattgtatgatgtgtgaattatatctccataaaaacaattaaatattctgaggagaaaaaaagtactactgtctcctgagagacactgtctgctgtcaggaagttagagttgctcagagccaaattccctgatacatgataaacagaattacataattatagtcctatcccagttctctcattttacacacaagtacactgatttgtccaaagtcccacagataatgagtggcataatcagattccaagtttcccaaactgtaatcccaatctgtcttccactcctccgttatggagcttccctgttgtgtgttttatagtcatggaaggtggctgggattgggggcggcggggaggggcagtcactggtctcttaccaccaccctgcccagcaacaatgtgcaacttctttaattagagaaaaggaataaagcacaaaccttcctcagagagtgaactctctcatgttaattcacctgaggtgtgatattggattccaccccaagagcagggagacttaagacttctagagggcaaaggagggcagcctctgtggtgtgagagtgatcttgaagatgcaggataggcagtcacttcacctattttcaattttgtcctagattggcatccctaggaagcaggatatcttttcatttcctgccaaacctcctggtggccaaaattaaaaatccatattgagtcagtaattaaacttccccctacctgagggttatgtcccagaccaatgctttaaaaagagttctgatacaaaaaaaaaaaaaagcagtttaatggagaaagactatctgaagaaagaatgatgtcaaatagatttaaaacgtatgaatgcagcaatatatatgttgcttgggctgcataagtaaaaagagacaaaaatcaatctaaactccccagtttcaactatattgtttccacatgcgtgacatctataccagaaaaaaactaacaaaactagaaatgcattcctcttggaatggaaacaaatgtcaaaacaaacaactcaggataaacttgagctagagaagaaagctttgctctactcttttctaaggagctttgaagatctggccatggttgacataacaactcattgcagcagatatgttacttcaacagggagcatttcacagattgtcaaagttgtcttctcatcccatccaacctatcttgggggagggtgagaaaaccgaagagcaaaaagattaattcatttgcccaagttcacatggctaagtgctttcagatactgggaatgtttgatttacttgaatcaaaatagtgagaatgtcttcctgaattatacttgataatggttttctagttacattataacatgtctaagctctatataaatgaaaatgaattttattaagagtgttttagtatttgattggctttgtcaaaagatttcagatagtggttttggggaacttggtgaatgcccatgcagtttttgatacagtggcaaagaatatttgtagaagatatgactttttaaactctagaacttataattcctcagaaaatatttacgcattctttatttattaatttatgaatgaaataactgttcattcatttaataacaatttgttaaacacctatattattgggtactgatagatgttgggtgtaccgagatatctgtgatttagtccatgaatttaaggagtttataatcttgtgggctgacacaatttgtttcaaactctgttctgccagatttaagtgagaaatccaggcaaaatacaatgtttctgtcaatgaaccatattgttacagtatcagaagctactgccttggtacagcccacagtggataagatcatggtcctggggctgagaaaaatctgggttcaaaacctacctgtaattatagttgctcagtgtatgagcttgaggaaattgcttaattctctgagaaaacatttaaaatagcccagtaactgccctatagtcagcacttaataataatgtctattgtagtcatttattaataacaaaaggccatggcctcctctctttatcgctgagctccaatgcaagtaaaacacttccatctactttaccttcaatgggtcctaacttgcatagtaggaataaagaaaaaaggaaaattgtgggagtaggagggaaagagagaatgccatgagccgcatgccttctggcctttctgtcattttccaggtatctattcttccaagtaggagggtcaaaagtgattgtgtttagttttgttgtaaagttgaccaagaacggaataggtctgccgggcacagtggctcgtgcctgtaattccagcactttgtgaggctgaggcgggcggatcacctgaggccaggagatcgagaacagcctgaccaacatggcgaaaccccatctctactaaaaatacaaaaattagcaaggcatgatggcaggtgcttgtagtcccagctcctcaggaggctgagaatcacttgaattcaggaggtggaggttgcagtgagctgagatcgtgccactgtactccagcctggatgacaaaagcaaaactccgtctcaaaaaaaaaaaaaaaaaaaaaaaagaataaaaaaaagggaacaggtcacaatttccctcactatcaaataattgtttgcatttaaggggaaggaggaagaaaacaagcttgatgcctattttgtttaattatattattctcagggtaaaactgtatcttgttctctacagtggtaggtaggtaggtagatacgaagtaggaaggtaggtaggtaggtaggtagatagatagatagatagatagatagacagaaaaaaatgtatataagcacttttttctgtatttttaccaagtctgttgggcaatctgttgatatttgaactagataattttaaaaacagaggaaaatactacatcactcacctaatattttgtcattaactacaaataattattattttaactgatgtttttacatcaaaacatgacttaaaagtcctaagcaaatttttcactactgatgatggtaatgattaaaaagtcaggaaacaacaggtgctggagaggatgtggagaaatagaaacacttttacactgttggtgggactgtaaactagttcaaccattgtggaagtcagagtggcgattcctcagggatctagaactagaaataccatttgacccagccatccccttactgggcatatacccaagggattataaatcatgctgctataaagacacatgcacacgtatgtttattgcggcactattcacaatagcaaagacttggaaccaacccaaatgtccatcagtgatagactggattaagaaaacgtggcacatgtacaccatggaatactatgcagccataaaaaatgatgagttcatgtcctttgtagggacatggatgaagctggaaaccatcattctgagcaaactatcgcatggacaaaaaaccaaacactgcatgttcttactcataggtgggagttgaacaatgagaacacatggacacaggaaggggaacatcacacaccggggcctgttgtggggtggggggaggggtagggatagcattaggagatacacctaatgttaaatgacacgttaatgggtgcagcacaccaacatggcacacgtatacatatgtaacaaacctgcacattgtgcacacgtaccctaaaacttaaagtataataaaaaaaaaaaagaaaagtaacccaatacagagggggagaaaaaaaaaaaagctaatgaggctagctaggctcagtgtttctaggaatgatgtaactagaaccatgtgacttttatcatatatttcatcaatgaagataataaatgcttaaacaagataattaccatcctccttcctctctgttaaatgcttcaaatacattatataatttatactgggctcagagtagccctaatatggctaatattggtacctctgtacctctgtattatagatggggcaactaaattgggtcaagtaagtggctgaaggtcacacaagcatggcctccccagaaccagatacttcccacctactttgtcctagtcaaccttagcttccgaccttactgtgttccttccagtgcaacattctccatttttgttgttgttgtttgttgttgttgttttgtttgttcatttgtttgtttttgagacggagtcttgctcttattgcccaggctggggtaaaatggcacaatatcggctcactgcaacttctgcctcccacgttcaagcgattctcctgcctcagcctccagaggagctgggatgacaggcacccaccaccacacctggctagtttttgtatttttagtagagatgggatttcaccatgttggccaggcttgtctcgaacccctgatctcgtgatctgcccgcctcagcctcccaaagtgctgggattacaggcgtgagccaccgcctgcacccctccaccaacactcttctttttatagtccctgtgcggaaactcaaaccatttgtcccctgtcccagtgcctcttcagtctagtccttcaatagcttcctcctcagttactgatttgctacatgactatggagacaaccagattaaactgtgtagatgtcatttcccattgctttatttctgtaactgcaaccacactgtagtgatttctgctttccctcaagaagacaactgtcctccaacacccaacattttatctctgaattgttaccttatttactctgcagcccctacagtagcagtcattatgtctcctcctgacctactctggtatgttctttctcccttcctccttccctcctttgatttttcagtctaattatatcttagcttagaatataaacttttagctaatgaaattttcttcaaacatgccttcaaaccccagctgttcatttccctctgagttaaaatgagtaaagttttgattatgtttgtttaaaattcactaggctaatatatccatatattgaatgtattccatatacattatcttctgtacttctttaaaggcaaatgtgaaattctctaacaaagtctttcctataaaaaaatatgacacaccactctcaggggaattatgataattcaaagaacaaaccaaaccaaattaaactcacatcttttctgagcaaaagagtaaataataaaaatgcagaagtattgtttgttagggtcaacagcttttgctagaacctgatgtgatattctgtatagaattttgttgggaagttatgaagtactgataagacaggcaaatattatttgcacacaaatgatccttgcaaaataaaaattttcaagtggagataaattcttccttatcctctttagttcttcagcagggttcttggataccgtctttgggaatgctcttctctccaatgttgtgatatttacatgaaaactttggttttaatgtaatatttatctaactagatataaccagacttgaaggtgattctctagatttcttgtacctcccttatgatttcagctatgcgctcgattcagttgaatttaagaagattatcaatggcatttcataattgtttatggatttcatattatttaaacttgctctccagttcagtaaataaattttagaggaaatcaatattatgaattttttttcagttattagaaattgcttttgagttttagtctttttctttctttcttttttttcttggtgtaattgtaatagaaacccaaggagtctagaactgtacttgctaccttctggttttgtgactttgatcaaatcactctgcctctcaggatttcagactctgcacaagtaaagagtgagatggagcacaagtgagctttctaggtcagcgtttcccaaaattttatcatctatttttgtccaatctctacgctccctgtattattattctctttaattttttattaattatgttttttttttacttgaaggaactttatcacagcagtatcacttgttataagtaaaaagtagccgtaaagataaagacaacagaaacaaatgtattaaagcctggcacgtcctcagaagactctgctcctgagccttgatagttcaccacaagtataagactgtcatgtgtcagagagattttaaagacatgctggcaccaagtgagactttatttttagtttaatcagaagaactcaaagagaattaagtgaaagaggagtgacttattcttaagtgagttaggttttgtttgtttgtttgtttgttttttgagacagagcctcgcactattgtctgggctggagtgcagtggtgtgatctcggctcactgcaacctctgcctcccaggttcaagctattctcctgcctcagcctccaagtagctgggattataggctctcaccaccatgcccaactaattttttgtacttttagtagagacggggttttactatgttggccagactggtcttgaatgcttgacctcgtgatccactcgcctcggcctcccaaagtgctaggattacaggtgtgagccaccacgcctggccatgagttagtacttttttagtgcctgatctctgtacaatccaaaaattatctcccattccagtgttgtgcatcttgcgtttttagaaatgctaatgtaaagaggaagcatcttccagctctaaaaaaaaaaaaaaaaaaaaaagtggatgctgtaatgccccaatgtaataatatattctggcaacagtgatccagatgaatcatatttttgtgtgtgatcagtttttctttctacatttttcatataggtaaatatttgttgtgtattttaactcatgtactaggtaaaagttgatgtaaatcaatttggggctaagatgtaataatactgttgcctttatggtttaatttaatgatgttgaaaagctttctaagtagtaaaactatagctcattttattccttgcctctccccatccataatagcatgcaatgagtgacataaaggggccagattaacccctgaactgcagccctagaacagcgatggcctggcatagaaagttattgtgactggagatcctttaatcaccagagtattttgacagagtgctgagtagttgcggcattagtagtaggagatttgacacagaaaccattcttaaagtcttggggagcccagttggctcttaaaaacacaacttggaattcctttagtttcagtgccttatttttacctttctttgaagtgcctttttgttcactgatctgttaaaagtgcaatcttgtttctgtttttagccatccattgctattaccataataagcccagtgtttcaaacatgtgtgtcttagagtataattcttccttactcaagactactcaagccattccttccctcccacaaagatgatatctgaattgtgcaggcattggaagaatgcaagtgtcattctcaacttttttttcacctccataaaataaaaacaaacatttatgacctcatgcaaactttttgggtcaggaatttgggagcagcttagctggatggttctgattcaggaaattatactccagtatcagctggggctgcggttgctgaaggtttgactgcggctagagcacccactttcaagttggctcagtcacatatgtgactggcaggctcatgccaggtgttgacggtaggcctctcttctgtaccgcatggagctccctatggctgcttgagtgtcctcgtgacatggcctgtggcttccctcagcagatgatccagagagaaagcaagaggaagccaagtggcttgttgcagaagtcacagttgtcagttccataatattcaatttattataagcgagtcattattttctgccccacactcaagggaagggaaataagttctatattttagaagggggagtgtcaaagaatatttggacgtaatttcaaaccaccacaatctgttcctctcctttgctttcatactgggacaaactgtcgtcagttcttacctacacaacataatacgattctggttggtcttccctcatcttcactgctcttccactcttgtgcatttctaatccattctccatggagaatcccaagtgatcatttgaaaacacaaatctatcatatcacctttcttctttttttgttgttttgttttgagacagggtctcgctctgtcgcccaggctggagtgcagtggcacgatcttggctcactgtaacctacgcctcctgggttcaagcaattctcatgcctcagcctccccagtagctgggattacagacacatgccatcacgtccagctaatttttgtattttgtgtagagacggggtttcaccatgttggccaggctggtctcaaactcctaacctcaagtgatctgcctgcctcgcacttttctgcttgggtggcttactgttacacataggataaaatttagagatcttttcaaggcatataatgtcttacatgagttggttcctgctgccttctctaacctcatctcatacaactccctctgagctcactagaaattctaatcttcttttccattactaaatcatgtcaaccgcttcctaactcagggccttcatacctgcgatttactttctcttttgaatggtctttccccttcctccttgcctgtctatgcctagctttatactgtagatttctgcttaaatacctctccagcagaaaaacttttcctgataaaacttagatagcactgtatcatttgttttctcttttattaaaaaaaaaagctgtattgaagtataattgacatgcaataaactataaaaattaaggtatacactttgatacattttgtcataggcatataactgtgaaatcatcatcaatattcgaaataatgcatcactccaggaggtccctttgtggaggatccttgttattttccaagttggaaacagtgcctagaccatcacaatatttcttacaatttataattgctaattgctttcatctcagtttgtagtaactcgcttgtgcatctcaccatctagactggagctccatttgaagagaaaatgtgtctgtagagttcattgctacatctccatgatcacattgtccagatgttcaataaatttttgaatatatgaataattgtttgtattataagctgataaagtcccttaaagaaatacaagtcaagtgcttagatacttttgatgtagtctgccctttgaagaactagtagatttgtgacttttttttttttttttttttttttttttttgagacggagtctcgctctgtcgcccaggctggagtgcagtggcgggatctcggctcactgcaagctccgcctcccgggttcacgccattctccggcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccgatttgtgactttttaaaattgtagccttctgaaactaagcgaaaaaaaatatgaggtgaatttttgaaaggcctaaacgaagaaaaatgagatcccaacttgtctctcatgtaagggaggtaaagaaaagtaagtgttgaatgccaggtgtagtagtctgctctttatttgagtcgagactaagaagcaatcattgaaaggtttttatttttttatttatttttattttttgaggcagggtctcgttctgtgagaccaggctggagtaagtagtgcaatcatagctcactgaaacctcaaactcctgggctcaaggcatccccctccctcagcctccctagtatgctgggactacaggtgcatgccaacacacctggctagttttttaaaattttttgtacagatgaggtttcactttgtttcccaggcgcatctcaaaatcctggcctcgagcagtcctccctccccagcctctgaaagtgttggacttagaggcatgagccactgtgcccggccttcattaaaggttttcagcttggccctgactttttattgtcttggctttgcctcaggacaattaatatggcactgatacataagaaaacatatgaatatcttcgagacctgtactttacctatctgcatgatttatatcattgcaaataaggaagaaaagttaggaaaagacaaatataattcaaagtgtttaagttttctgaaactagagggttggtgatatggtttggttctgtgtccccacccaaatctcatcttgtagctcccataattcccacatgttgtgggacgtaccgggtaagagatgattgaatcatggggatgggtctttcccattgctgttctcatgatagtgaatgggtctcatgagatctgatggttttaaaaacgggagtttctctgcacaaactctctctttttgcctgccaacatccatgtaagacagaactttgtgcctcctttccttccgccatgattgtgaggcctccccagacacgtagaactgtaagtccattaaacctctctcttttgtaaattgccccatcttgggcatgtcttcatcagcagtgtgaaaactgacaaatacagttagtttaaccactctctggagtgttctattcatgggttggtaacaaataaaccatttataatttaaagttttcacagccttagaaatgctcacatagatgttaggaaatagttttggtatacaacaaaacagaacctttgtgcacatttatttttgtattatattgtactgagggtttctaatcaggtgaagagaaaagcagtgtcagaatgggaagtctgaatttgaattggatatgtttaagcaaattgtctctttaccagccctacctaatttgagaatacataacacccactcagctctccctgaactcacatgttggattttcccaactaattttaatacacacagataaaaagaccagatatttggtctatacattttctgaatgtatggaaacatctatttatgtaacaagcataatattatagctgaaattgaaatcatttttgtattttggtggttgttgactggctaatagctaataagtcaatgtcaggatagcgaaatcccacatgtattcaaatatttaactccaataaataacatttgttcattcagcacctactaaatgaatctacctctgttaaccttcgcaattatcggataggtagatacattgagattatccctgcttagtagatgagaaaactggtggttaggtataattttcccatggtaatgccacttaccagtagcagagttgcaattgaaacttggatttgtggcctctgaaatgatcaagtaatagttattgatttttaagttcatgtaatgacaactatttgtttgatcttggaatcaggactgagtatttttgatagaaaggaataagtcatattttggatgggcagatgaagatcttataagaatgttactgccacagcttatacctaaacatgttgaaaatattttagggaagagaatgtatatgttgatggatttgtgttagctgcttttggattcaatgattaaagccagttttgccttatagctaaaagtatctgataaaaaactaatcacttgtcataaagaagagaagtggaggctatgtcatcattaccatcaccatctgaagtcgtcaaatatattgcatttcctgtgatgtcccagttagttccaagcagttatatttatataaaatcatatatttcagtaaatattggagctttgtaagaataacattattttaacataaataggtgttttcagacagtctcattatttgtgtattccaaatatgtagtaccttgaagaccttgacttatttgagaacagcatgaaaatttgcctgcctgaaaatctattggcgtatattcaagatacgttttacaagcaggagattattttgggagcataattcatcactttgcttacatagttgttggctctttgtctggcatttgattggagagctacattttcttggagtaatgttgaacacaattttggagaaactggtttttttttgacaatttgaaatgttactgattaagatcccttgaggccaattctatacacaaagtacatatttatccattgattccatgaaaacataaaaattctttccatttagtaaatagataatttggtacaggattatttgccctggagtaactggttaaccagggtataataaaatggatcttttttttttttttttttttgagacagagtcttgctttgtcagccaggctgtagtgcagtggcacgatctcggctcactgcaacctccctctcccaggctcaagcaattctcctgcctcagcctcccgagtagctgggtttacaggcatgtgccaccacacccggctaatatttatgttttttttggtagagacggggtttcaccatgttggccaggctggtcttgaactcctgacctcagaatcggccagccttggcctcccaaagtgctgggattacaggcatgagccaccgcactggccaacaaaatggatcttgaagagttccttcacattagatcagaagaaatgtgtatgtgtgtttgtttgtgtgtgtgtgtctgtacctcctgtaattgtcatgtgtatatgtttgcatttagagtagttttttcttattcattttcaaaaataaataatcaattttgcattatttcttgcctctgatcccaatctattagtggaaagaagtgagattcaaccataattggaaaagtcatcaccttttaaaagaagtaacattggtcacattagtcccaattccatctcacattgggtatgtgaccagccttgaaccaggtgaaatatagaaatacagaacttcagatatgatccaagctatacattagtgggaacagtacatcccttgatagtgacactattctatttgaatgtcttaaggttccattgacatgcttttattagctccttcaaaatgttggctaatattacacaattgactgagtatttctgatgcatcctttctgttaataccaaatgccaataaatttcatggtaaaataatttgatattggcattttaaagatattatccttagttttcatgccagttagatcccatctgagtctgcatgtattaatagacttcaggaaaaattccacaatgtcacatatcatgcatggcctagagaaaaggctttattgggaaatttacatatgtcaagatttaacaatgagaagagaagccaggggtcctataatcttccacatcccacctaaaggtgtggcaggacctggctgccttgatcctgcagtgtggctctgtgttcctagcaagggtccgttctcttcagtagcctaccttgtcaatgaaggataagtggaccccttggctccaggcccccagagaccctcaggcgctgtgggatactaaagtatcccttgtgtggaggtggaagcccctggttgtatgataagctgagcttgggtgtagcccctcctactgggagaaggtaggatatccctggctgtagttgtcatattgtccagagttcagagagtgagtatccagcgttattttgagtcagtcctgctcatttaaacttacaacagtagatctgcatgatccccaaacacgcaggtataaaaattttctcaaagttgaccacctgttagacaatctcatcatttagtggaaacctcactgtaatcgccatgaggattatgtatcatcatctgttgtatgtgggtggcattgcactagtactggataaaacaagtgaagctatcatggtttttctcttctaagagtttattagatgacatcattctcaaagtctaaattttgtgaataaaaaataacactatagcatgtgcctttacatgaaggtttaattaaaagcaatgaatgaatacatatgcttcaacattaatctcactgaatatatttttaagaatcctgcagtttgactgtagataggatgaaatgttaaaaatagaccctaaacccaccttgatttatgtatttacttggagagaaacaggtgagggaagcatattgaatcataacctaattcctacaaacattgatttacacacaaattaatttactaaacaaattatagtttatacatttatacattaagcatatttatttaatttaaacatactagtaaaatggacatcggttgtcctccaaattctttgtgttttcatttagataaagatgataatgttgacaataatctgaagcttaataacagaaatagcaatcatgtgttgaatatttattctggtggtagtaaggaatcaatccatatatatttacacatctataaccatacacatatgcatacatatataatagataatatatatttatgcacattttgtattttttttcatttaatctgcacaccatcccttaggagtaacttatttttatgaatgcttctcagataaatggagaattagggaagtgcaatcatttgcccctgttcactctactagtggaagcaggatttgaatctaggcgatttgactctaaaggtccatgctctttatcactattcaatactgcagatgtaaattataaggccattctatccatgtaattttaatacaataaatgctatgtgctgagtgttttttaaagattaaaatttgaatctgcagtaaactggctacttatcttattgtcaaccacatctttttcggtactgtgtccaggacacagttagatattaagtaaaaacatccctggtcattttttttttaaatttgagtttctctggcttctgcacatagcccatataaactcagaaacccgttatttggagatttcactgaatgaaataccataagctttgtagtgggaaggggttgtaagaccaggtcacccaaacttagtttgcaaatgctgcagcagctactcttagcagccactgtcctttccatagcatttccaaggcacctgcattcttttgcagctactactacccaccacacctcttccttagcagttccatagccaagatttcagagattgttatgaaaatcacattgaggccagtacttcgttagaaatttaataaggactacaacattgggttgcaaaggaaggggtaatgcctcttctactaccatttgtagtttgtcctctaggttcagcattaacaatttttatgaagtattaggagctttcaagggcctttggcagggagcaccttatgcctcaatgaaggagccttaagcaaagttaataaaaatgcgaaagtattgtgtcttgacataaggctcctgagtcgtaatgttgataatcttcagcatagagctctagcaacatgatgcatctggtgtctgtaacccagctgttccccaggaaaggtgcagaattgagaatcatcagcctgaaggcatgcataaaagacagcacctgagaagtggtgctgtgtgcctatggaagagcccagtcagaggagtacagacttcaactgaaccatcccccagtatagagatgcgcacacgtcaggggagcataaatgagaaaactggactttctcaagcctgaggtgttggataatgacctgacagcgttctcactagtcccataaaacagcctatgtttgttcccatctaatcatgtgactagaatgtaggagagtacttctaaaagtaaacacatttgaacaatctgtatgtaggaggaagaaagtactgtattaaaattgtcagtttttcttcttatttttccttacctaatgaactttttggcatctatcagtttctaaccaggcagctgctgaaatttttattcatgccttggtttcctcaagaattgatttttgtaattcttttttgcagccttcccttaccgggctattttgaggttgcagcacactgtgaattcagcaggtgcttcaagcctggcagcatcttattgcctttcttccgacttcctttagtgacctccagtatcaaacatgattgctcttccaattttaatttctacttgctgtggtaccgaacaacctcgttagtcctatcactgagcccagttggcaatgttgggaggtctgagtagttccacactccgtaaattgcagtggtattagcaagtacaattgcatactcttaatcatcttgcccttattatatgagaagtttctggtgtattttaagggagaaaatgctttagagagtaaagagggaaaaaatcaaagcaaactctccctctcaatattctaatcacgaaggactggaattttcaagaaccaatttcaatttgatgcttcaatatagaattgaatttagggtgtatgtgagtgagtgtgtatttttgcacacattcacatatatatatttttaatatggtacttgaactgcaataaagccagtactctttccttgattttatgtagaccacttttacatcataattcaaaaatataaggaaacttatgtagccgtaatagaaattcagtagaattagaaagtaaaagcaacaaaatataaagggctgccagcagctaagccttcgcaaatcagttcagttagttgatgtgtttatttgtgcatgtagagccattgtatttgtacaaatgtccctccaacatatatacatgaaaggggtattaaagatccactctcttggttttgtggctgaacaaattgcctcaagctcttactaatggtaataacttttcctatttaaagggcattttcaaatgggagaagattgttattttttacttttttaaaaataatttctgatctaaggaaaataagctaacatctatacaacagaatacattattggtaataactgacatatgttgagtattgtgtgctcaacatatatagcttggtgtataccttatagatcattaaaaatagcaacactgtaggtaagactgggaaaatgtatgttgtttatttcagagattagcgtgtatccacatgtagggaccatggagtgtagagttggaggttcggccaaagccctcctgggccactccttggcaatgttactagttgtaggttccattctatcacagttttaaggatgatgaaactgaggcttatagaatttaagtgatttctcaagatcatagagctggtaaatggtgaagaaagaatttaaaactagtatatctgaatccagaatctgagctgttgactaacatgtagcattgccatctccaatccttggggatttatttttcacagggcctaaatgtgtggaccttttattctgatgcctttttcttcattctttttgtttgcttaaactaaaccttcttttgaactataaaggtgatggtgagtaacaagtcccatgtgtgattttattgtacacagtcagaagacagaagacactcagacagcccatctgctcagagtgtggcttacatcagtttctgtattacggctatcttttgtagaatgatttgtagcctttatcaaacttctcttggttaaaagtttgtaatggcagagaatccctagctaaacagtcagagaaagtaattccttagaggaaattacatcagcattattcattattgcattagagagtgtatttttgtcaattctctagcagagatcaagttcctgagggaattagatggagaaagaagcattgggtatgaattggatgaggttttatgttgcctgaagcttgagttacttattagcaagagtccaaaacatcttctttattgaagtttggagctatctgttcctcaagtgacaaaaatgttcaaccttcatttggggattctaccccaactctattttggtttatggaattcttctttttttttttttttttttttttttttgccaaaacattctttatttggtcaataaagggcagaagttttggattcttaaacattcagtatttttttaaatttagtccagggtttattcaaataccattttgccccaaactactctctcctctctttctggggctctaattatatgattgttagaccttggagggcagcttagattttttttatactttaagttctagggtacatgtgtacaacctgcaggtttgttacatttgtatacacacgccatgttgtgtgctgcacccattaactcgtcatttacattaggtatgtctcctaatactgttccttcccctcccgcaccccacaacaggccccggtgtgtgatgtcccccttcctgtgtccaagtgttctcattgttcaattcccacctatgagtgagaacatgcggtgtttggttttctgtccttgtgatagtttgctcagaatgatggtttccagcttcatccatgtccctgcaaaggacatgaactcatcattttctatggctgcatagtattccatggtgtctatgtgccacattttcttaatccagtgtatcattgatggacatttgggttgattccaagtctttgctattgtgaatagtgccacaataaacatacgtgtgcatgtgtctttatagcagcatgatttatagtcctttgggtatatacccagtaatgggatggctgggtcaaacggtatttctagttctagatccttgaggaatctccacactgtcttccacaatggttgaactagtttacagtcccaccaacagtgtaaaagtgttcctatttctccacatcctctccagcacctgtcgtttcctggctttttaatgatccccattctaactggtgtgagatggtatctcattgtggttttgatttgcatttctctgatggccagtgatgatgagcattttttcatgtgtctgttggctgcataaatgtcttcttttgagaagtgtctgttcatattcattgcccactttttgatggggttgttgtattttttcttgtaaatttgtttgagttctttgtagattctggatattagccctttgtcagatgagtagattgcaaaaattttctcccattctgtaggttgcctgttcactctgatggtagtttcttttgttgtgcagaagctctttagtttaattagatcccatttgtctattttggcttttgttgccattgcttttggtgttttagtcataaagtccttgcccatgcctatgttctgaatggtattgcctaggttttcttctagcatttttatggttttaggcctaaaatttaagtcgttaatccatcttgaattaatttttgtataaggtgtaaggaagggatccagtttcagctttctacatatgggtagccagttttctcagaacctttattaaatagggaatcctttcctcattccttgtttttgtcaggtttgtcaaagatcggatggttatagatgtgtggtattatttctgagggctctgttctgttctgttccattggtctatatctctgttttggtaccagtaccatgctgttttggttactgtagccttgaagtatagtttgaagtcaggtagcgtgatgcctcccgctttgttcttttggcttaggattgccttggcaatgcgggctctattttggttccatctgaactttaaagtagttttttccaattctgtgaagaaagtcagcatcatcctgataccaaagcctggcagagacacaacaaaaaaagagaattttagaccaaaatccctgatgaacattgatgcaaaaattctcaataaaatactggcaaactgaatccagcagcacatcaaaaagcttatccaccaagatcaagttggcttcatccctgggatgcaaggctgattcaacatacgcaaatcaataaacgtaatccatcatataaacagaaccaatgacaaaaaccacatgattatctcagtagatgcagaaaaggccttcaacaaaattcaacagctcttcatactgaaaactctcaataaactaggtattgatggaacgtatctcaaaataataagagctatttatgacaaacccacagccaatatcatactaagtgggcaaaaactggaagcattccctttgaaaactggcacaagacagggatgccctctctcaccactcctattcaacatagggttgaaagttctggccagggcaatcaggcaggagaaagaaataaagggtattcaattaggaaaagatgtagtcaaattgtccctgtttgcagatgacatgattgtatatttagaaaaccccatcatctcagccccaaatctctttaagctgatgaagaacttcagcaaaatctcaggatacaacatgaatgtgcaaaaatcacaagcattcctatacaccaataacagacagagagccaaatcatcagtgaactcccattcacaattgcttcaaagagaataaaatacctaggaatccaacttacaagggatgtgaaggacctcttcaaggagaactacaaaacactgctcaacaaaataaaagaggacacaaacaactggaagaacattccatgctcatggataggaagaatcaatatcatgaaaatggccatactgtccaaggtaatttatagattcaatgtcatccccatcaagctaccaatggtttatggaattcttatgtatagatagcttcagttcacccaaggattacaagcattatatggtaataatacatgaagaagcagagaaaactaaagtacaggttgtcttccttagcaagtacaacctttgcccactgaatgtgctttcttaagtctcagctttgagaaaaagcaaggcttaagtaaggggggttccagtgagcagacattagagtatttcctattgtattaaggcaactgaatgaactgtttgaaagtttaactctcagggtggcttaggtggcttagtaaatacaattatgagaggaaatgttttcttcacttacttgactgtaatttgttgttaagatatattttgaaattgttgagtattttctcatttttctgtgcctctcaattttctgccaaaaaaaaaaatttctgagaattttgtttttttcatttaggatggaacaaagttgctgttactctatgtgattagggaatgatgttttaggtgaattaaataataaatgatttttcccatatgccaaacatggaagactaatgagatttgaaatgcagcgtatttcttgatattgaaaatatacaacatgaaattttttctttgattcagaaggtactttaggatgtcctagtgtgggaaaatcattagaaattgtcagtctcttgtaacattatggaagtcctggtttatcggtatttttctgtggtgagagaagcaggtaatcaaatctttacagaaacaaaatcctacagaaaataatgctggcagtctgctgattaaagtgtctgaataaaatggattaggtaaataaaaagaatgagcatataagtagaagaaattgtagtttctaaatattaaattcagaaagttttgattaatgacttacgtttcatgtcatatggcttaaagattttttgccttatttcttatccttgaaaacaaagtgaagtgcatatgagagctccggtggaataaaaacagcccgttatgggctggtctattacttcttcaacaaagctctatctactgtcatggggcagcttagtatgacagaaagaaaacagatgtgtgtttcagctcttctgcttaatagctttgtgaatcagccaggatatacaacatggtgtagttgtgctacagtagaaaccctttctgaaatttccctggcacagtactgcacgtgtgtatgtttgactcacagcgcattatccaaggtgaattggcagagggcctctgcccacgggtcattcagagacctgggctgatggaggctttctgtcaatgcctgcttcaaacaccgtggagagtggaaagggaaatgtggcaaatcatacaggctcttaacatttctacttggaagtgagatgtaatttctgtcacatttcatctgccagagtaagacacatagtcaaagaaaaagaaagtaggattctaccatatatccagagagatatcactaatgacaaccacaccatgtgtttttgtataaatctcttagtgtgtctgagcttcattatgctaatctgttattttttttaaaaagtggaggatttccctgacttgatgcctcttcctgtgaccctcctctgaacttttgtgtatcctagtcaccagaggaaagatgttttttcatttattcaacaaataattttcagctccttctatgtaaggtaccagctaggctttggagacgttgcagaaaacaaaaataggtaaggctgatctcccagttcttatgttcagttggattgacaatcagcaaaatagatacatatctatgtaatatttcagttggtaaaaagtgctaagaggaagaataaagtagggcagatttgttccaaggaaaacttaagaaaaggggggaaataatatatgaatatcagtaggtgaaggtttctagatgatagaagaggaaatgcagagccctaagcaggattctgctaggcattttttaaactactttattgaggtatgatttacatataaaaagctgtacatatttaagagatacaacttgatgtgtctagagataagaatacacccatgaaaccatcatcacaatcaatgccataaacttattcatcacctccataagttttctcctgcccccttgttgttgtttttattttgttttgatttcctcttatagtaagagccaataaaggaaatataagatctaccctcttagtacctttttaagtaaatagtacagtattgttaatcatatgctctatattgtaggggagatctccagaacttattaatattttgcataactgttctgctaggctttttaaacatttatttagagacagaatcttactctgtcacccaggctagagttcagtagtgtcatcatagttcacggcagcctcgaactgctgagctcaagtgatccttccacctcagctcccaagtgctaggactccaggcatgcacaccatgcctgtctaatattttattttcttagggacaagttcttgctatgttgacaaggctggttttgaactcctggtctaaagtgttcccgagttgggattacaggcgtgagccaccatgcccagctctctgctaaacattttgagaagcagagagaccaggatatctggagtgcagtgagtgaagacagtgttaggaggtgggagaaggggatcagagagaaggcaacatggcagatcatgcagggagagccctgtagcaaggtaaagactttggattttttttctggatgagctgggaagcattgtagggttttagacaaaggggtgtcttgatatgatctaaattttctctggcttctctgtggagaataatctatagggtggcagtgatggaagcaggagcacagctgggcagctattgcagcaatcgatgtaagataaggatggcttagacccaagtggtggaggtagagattgggagacatgccagattctggatgcattttgaaggtggagctatcagatttgtgaatggattgaatgagagatatgagtttaccacagtaattattactatatagatgccattcatttataccacaaaaccaaccgatgtcctgtcaggtgctagtgctgttccacagttggggttacagcagttgggttttcatgatgttgaattctagttaaagaagacaaatgataaataattcgaataataattttaatatgataatagtcagtagttagtgctagaaagaaaatttaatcaaggggatgtgaatgatgtaagtggctacgttggacaggcaaggccttggggagctaaggcctgagccaagaggactgagatgtgaagtgatgggggaagcaggggaatttggtggggcagcactcgaggcagacacacatgtagtgcaaggatcctaaggcttgggtaataggggaagatatgtcattgcagtttaaatatcgaatggggggacaaagtggttctgtattgatagggaggtcagtatggaccagatcacactgggcttggcaggacagggaagaattttagattgtcgtgattccttggcaataagaagttattgtaaggtttcaaacggagaacaatataacctaatttgtctttgacacagggaggagaacaacatacactggggcctgtggtagggcaggggtcgagggggagggagagcatcaggaaaaacagctaacgcatgctcagcttaatactcaggtgataggttgataggtgcagcaaaccattatggcacacgtttacctatgtaacaaacctgcacatcctgcacatgtatcccggaacttaaaataaaataaaataactcacagtgactgatgggcggataatgggttttaagaggactttgacaacgaaaccatttaggaagctattgtgttatgactaattccatatgcttttcttatctgaacacaataagttgacattagttttgtttttaaagtgaaataaatatttgcccctccatgctcctacccctgcttgttcgtcagcattcttagggaatgaaatgatccacagaagacttcccaaatagctgtggtttccctctttaaggtctgtgtctttaaaagcacatggtccatttcagtgaaagtttttctgaatatttaatacatacttaccatttaaatggaagatagtaagtaaaacctaaacttttcctttgcctcatggcagtattggtgttggttaaaaatgataacttcagagacttcagatctccagacccatgagctttacagatgctagctctattctttttccattggctcctgactgtgatgtccttgtgcttcgcttccacagtctcctatccccaggtttttaggacacatttaatcttctttcttgatacagtgctacttctcttgttgagtatttgatggacttggtgactgttacattcttccaaggccacctttttttggcatctggttcaaactatgtctgtttttgctagaaactgtcacgtgaataaaggaaagagtagaaattattgtagtcatattgcagagcaatttgaacattccactgaagttgaatatgtgctacctacaatctagccatgataattctagatatatgccctagaaaagcaggtgcatatacacaagaagacacattactgggatgttcaccaaggcatcatttgtaatagcaaaatggtagaagcaacctaactgtccatacaaaaagggaatgaataaataatctgtttattcatataatggaatattgcataataaagtaactgaattaaagctgtatgtatcaataagaataactgcaaaaatgtaaagtgaaaataaaaaatttcaaaaggatataaaaacgtaatgtaatgctctttatatatattttagaaataccaaaataatacgtgtgtatatacatatgcatccacacacacacacacataactaatggctaatacagtataaaaacatggtaatgatacataaacctttcagaaaacttcagtgaataaaagcaggtagaagagagaaaggaggacctagttgaatctgccctttttaaatgctatgttaaaaaatagatacatatgtttttaaccaatctgtacaatgttcttacctattatgtctggcttttgattatgtagggtatcaatttatgattttttccatacgatagaaatatttaataatttaaaatatcatataataaaaacgtgtcttttatagttcttcctacaagctgtatttgatcacttctgtggttttatgggtggctcataacatctagtcacatcataaaattcttttttccttgtgattggctgaatcatctttaggcgtgatgcttaatttagacgtttaggttaactcttcaataaaatcacaggaatttattgtaagatctaaccaagggactgaaataaattgaatgtagtgaaatttgaggcattgtttcagccaccttaaagaccacatgatctactgatacagttgttaaatccactcagataaacatgtgtgctccaagttggagaaatctgaggcagagaaaaagaattgtcccaggtgcccaagtccacttatatgaacaacttgaattgaacactgttaatattaggctcttttgccaggagtggtggcatgcacctgcagccccagctactcaggaggctgaggtggggggatcactagagcccaggaatttgaagctgcagtgaactatgattattccactgcactacagcctgggcaacatagtgagacgctgtctgtttaaaaaagaaagaaagaaagaaaagaaaccctaggctcttcttcccctctccccagacaaagtctgctgcagtgatctcggcttactacaacctctgcctcatgggttctcatgggtttaagcaattttcctgcctcagcttcctgagtagctggtattacaggcacgtgccaccatgcctggctaattttttctctttttagtagacatggggtttcaccgtgttggccaggctgatctcgaactcctgacctcgtgatccaccagcctcggcctggcctcccagagtcctggaattacaggcatgagcaactgcactttgccccttggctctttttaaaaaatgcatttgtttgagagtaatgaatagaaaaggaagttgtggcatgaactatctgattcttcttttcttccactactgggagatttcataggccaaatattctctctagtcaggggcatgcctgatgatgcttacagtctataaagagtctggtcttgttctcctttcatcttctctggagaaaggataatcaacaacagaaattttttaaaaaccctcatactttagacaagtcacattcagccactctgtggaaacactgatttttctacgaggctttcttagagaataaatattaacacatatgcttcatgggctgatagatattgctgtggtttcaatgtgtcctctacagaatttgtgttgaaatgtaatctgcattgtggagatattaagcagtgtggccttttggaaagttattaagtcacgaaggatgtgccctcgtgaatggattagcaccttagaaaggggctggaggaaactagcttaggaccctttgcccttctgccttcaccatgtgaggacacggtattcaaggtgccaccttggaagcagtgagtgggccctcaccagacctcaaatttgccggcacctttatcctggacttcccagcctccataactgtgagaaataaattcatgttgtttataaattacccagcttcaggtattttgttatagcagcaggaatggactaagagagatttaatatggaatcccaaacaatgaaacaactatttgtacttctaaaatataggtagttctcaaaagcattatgttcagtaggatagctctctaacttatctctaaagttaattaaacattatggctgaaaaatgagttttagtttcctctctttgaacttctataaagaaaatatacctttgagacttgaaaagttcagtgctatgaaacgtctttctagggtagtttgggtagcaccaaagtcacctataattaaaattacatattttccattttaaaaattccattttataattttcaaataaattttttactatcaataaagaggtattttttgatttgtgcaactttatatgtagcacttggtttcattaaacaaatgtcattgatttcattagcataaaactttattttcttcaccttaattttgaatacaattaccaaataaaagtagcttttatctttgtccctttgaggttagagatgatatcttcttgatttctctgtctctcccgagcacagtgcccgcacatggtaggtaattaactgtctgttgactggttaaattatctgtattacaagtaaatacaaaatgccaggttttacaaaacactcattccatattgtctatcactcccactctattttatttttcaccatagtataagttaagatattattaaaatattattaagatcatctggggaagtttgctcacttccattcttgaaattattataatctcctcttaagaaaaaactcaaaatgtgtaagagcatctctgatagcttggttcttatttgtataatgggataattttatttcttcagttgccatcctgcaaacactttttctaagtctttaggaacctctgtttttaaattgcttttgcttcatgtgataaactttaagcccgtggccttctaaaatgattcagtcagtcagttctgacatctcttcatctcttcttggtagcaccctcgccatttctgcaacgatttccactgagtcgcatttcagcctgtgtagaaactcatgatgacgtgttgttttataatactttacactttgtgtattttgccattatgggggtgggttaatgtgttataaatgtacaaatgcttgttatcacagtaaattctaggtagagaacagaccatggaaatgttgttttaatttgtgttagtttgagaaaattaataggtatctcatatgacttataccagaaaatttaaaaactataaacatacagccaagcaagaaggcagtcattatgagtattttcagagtgtattgtctgagaatacggtggcgttttccattgctaaaaagaaatgcacagttttccactagtaacttgggagaaatattttttcaggtatacaatgcagggagttacttgacctaaaatgggtacttaaatttcattgattgtttaaagataagtaaataattttcccttttttgccagagttgttttcatgtaacgatacgatacatcttataacaatacttccattataacatgctttatatgtattatctcatttgattcaggtgatgactattttcaatagatattgttgctgtctccattttacagatgttataggcaaagttaaaggtgtgtaggcaagttacattgattcaaagtgatggacttcaaactctttgcctctattttgttggaacattcattaaatcatatagcacctgctatgagtggagactttcaactcataaagaccagaacatttaggggacaaaagtactcacagcacctggaaccaaaaaaaaaaaaaaagaaagaaagaaagaaacaaaaacaaaaaacctgttaaaaatttcttcatcacagacaagactctttcaagggtactgatagccatgggacagagggaaggacaggtaaagttgatgggccaaggagagtaacatcaccttcctcagcctaagctgcaggattataggaaaagctaagtagcctctgggtgatagtacctgcttgggagagccgttgtgtgaattcactttgtaaggtccaaaaataaatgtgacttagatacgttcacaccattcctctctttcccttttttcctgggttacctgctgtccacctagctttgactattgccaatacccaatgcatggatggaatacagtgagaaggaacctgcaagtgtcaatggaggcagaggcagagaacaaggatgagaacaacaaattttaaagaagctgtcttgaacatttggggaatagaggttggtgaggagactagccaagatgttttgtctctctgttgtataacagagtgccctgtggcatctcttatacaggtggctatacagtttttaatcacttttttaaatgttggatgagtatttcttttgattgcaataaacttatggtgagacacactactaggtggcccagttttattcaggatatgtaggagatggagctttataaagctgcattcatgaagattcttacaaaatattctcaggtggtaacattttaatgggtaaaaataacacatgctttcaaagaaaaatctattattcaacttaatataaccagttttatatatacatataatacacacacacacacacacacacacacacacacaacagacagagatactttttgacttacaatagggttacatcccgataaacccatcataagttaaaaatatagtaagtcaaaaattacatttaatacagctaacgaaaccaaatgtcgcagcttagcccagcctaacttaaacataatgagatcacttacctagcctacattggtcaaaatcatctaacataaagcctattttataataaagtgctgaatacctcatgtagtttattgaatactgtacagaaacttaaaaacaaaatggttgtatgggtatttgaagtacaatttttactgaatgtgtattgttttgggggaccgtgtgtatatgtgtgtgtgcgtgtgaattggaacacacacagttgcttttgcagcagttttgaagtcaagatacaacatatactaatattggtttcacaaggtaaaggccattattatccctatgagaattcagtgaggaagatactgcttttagctgggtagaatgaggtagataaaatatattttgattatttgaattaggagtttcatgtgatgagctgcattgctacatatcttatttcttactctttaaagaaaccaacaagcttttcatgtctctattacagaataaaatagagtaatatgccaacatatagacatttaattttgtcaaatccaactatgcaaacttaaaatgaaaggaaataggaggatataacaacttaaatggcatcagcaatttctcacactgtttcaccccaagagtgttagccttagtgaccttgagacagaagaagtgaatcacttagtagatctctttttattgtatgcatgactagaggaagcatcttagggtgctgcatgtgagcattacgtttaagaacacaatgttgtagaagtatttcttgtatattgtgccaggggctttgtctgcttatcagtggtgcaatacatcatccgtgaactaagattttcattttatcattaatttgttatcctgagagtggcaacttagttttacttaagatagcttccgtagttctaagcacacgtggagactccctgttcagaagaaaaagttctatgtatttccatgtattttattaatgatgacaccttttcctaaagtctcccccaaactgtttcttctcgcttctcattagcaaaaatgacatcacatagccaaaccaattcctggcaaggaaaaggatatcatgatcatttacttagatcaaccgtgattcaaccatagacttgtggatgggcccatcttctatgatgcacatggccagtcaaaggaaaattttggattccagtagaaaaaaaagaaaagagattaaatattgattaggtaggtgctgcaacatatttgttcattaatgtactgtaaagcactatttgtatttcacatttatacattcatattactttataagatggtatacataagaccatgtatattgtactttttgggcaatataaggactttttgtagggctaattttgactccaatttttgctatatgatcagagttacactataattcatgaaaaagacaagactcaactctaatatcaatattagccttagtttaccagttatcactatcggatgtgtcataagcatttgtttttaaggttgaatagagaacctgattgggtgctataaaagtctgatcaacagcttaaatgtttgtttgtttgtctttcttaaggaaaatgagcattgagtttctttctgttccacattgaataaacctcaccaaatctatccctacattcagatactcagtccacaaatactgagtaccttctatgtgctgaccgctgttctaaccctcgtggatacagtaatgaatgagatagataaagtactttttctcaaagagctaacattctattgtgagaaaaaaatagaataatcagagaagtcaacaaaaacaaaaaatgtgagatactgaagagcatgtgagagcaggccagtgggtaactactttaggggtcaaggaagtcctctctgaggaagcagagtttaagctgaaatctaaatgacaacaaggagccaccatggaaacaccagagaagtatattctaagcattggaaatagctggtgcaaagaccctcaggtgggaataagcttgaaatgtagccagcaagtgggaaagaggaagatgaggtcagagaggtatgcgaagactagatcatgtgagattatgtaatccaggtgaaaaggattgattttgattctgaatataatggcaagtcattggaaagatccacttgatcaaaaagtgacaaggtaacatactggataaggtatgggaacagtatcatagggaaacaattgaagtacaattaggctgttgtccaggtgagaggtgacggtggggaagaccaaactggtgtagtgaaatgtacaaaaattgaacagattcaggatgtttgggagataggatggaagaagtgaggaaatgagagaacggggtgaactttcaaacttctggcttgagctacggcatagacgatgaatttttctcagagatgtgtaggaagcaggttcactgaggagagagagcaggcagaattgagagttttgttttggtcctattgaaatagagatgcctgtcagacatccttgtagagatgccagataaacagttggatacatcagcctggagttccaggaagagactaggcctggagataagagatttggtagtcatctgcatataaaaaagcaaagaagtgcccacacagttattttaattaattccacagagccttctaaagtataatttggagaactgaaaattgatgggtacttatttattgaaacatttgtcttgaaaatttgttgacaacacaattgctgagaaattaattgatagttcatgacaagcagtgacggctcatttcctcaaagtttccctaaaagacaaagaaagttttatgttattagctttggcttgctttgaaaatttgtttttgcacatcactgttttgggttagcaataaaattctctgcatttgcttcataaatcaaacaaggacacaattgttaaatagtctgtatcatattaattaggctctgaaacaaagcaagcattacagccatttataacagggtattgcataagttgctaatcaatgagaaaagcaactaattaacaagcaaccagtcagcattttgagcagaagttggtgactttcagcttaattaaaccttgcaggtgtcagtgatgatatgaaagaatctttaatctgtttgtgttgaaattcccccagatcattttcacatctgtacatgtttaaagcccctatctactttcatgtaggtaaagggaattcagtgtcttaaaacagttcacatttttaaaagccctattcttaattaaatcattaagatttctcctggattaagacagtggaatgaagttcatcatctatttcactctaaaaaaaaacttagagggctaagcagctttattgaagtataatttatataccctaaagtatacttgtttcaagggtaaaatttaatgattttaagtaaatgtatagagttgtgcaattatttccagagtataattagaataaaggaaattttaaagtttggacaaatttatccatgaggtatcaaaattagcttgtgagggaggctagatatacctagcctttaggaatgacctataaaagcactgatacatctttccttctagccttcaagtgtttccaaccatctgctacagctaccatcaaaaacaggattctaaatgggatgaatcaaggattaagagtaatctattccttaaataacttttaaaataccataaattcctctttaattacagtagattatttggcaaaattaagaatactagttcctcaggctgccttttttttttttttaacattaagttccggtatacatgtgcagaatgtgcagtttgttacataggtatatgtgtgccatggtgccttgctgcacctattgatccgtcatctagctgccctcccctaaccccccatccccccaacaggcccagtgtgtgttgttcccctccctgtgtccatgtgttctcattgttcaactcccacttatgagtgagaacatgcggtatttggttttctgttcttgtgtcagtttgctgaggatgatgctttccagcttcatccatgatctcattcctttttatggctgcatagtattccatggtgtatatgtaccacattttctttttccagtctatcattgttggtcattcaggttagtttcatgtctttgctgttgtgaatagtgctgaaataaacatacatgtgcatatgtctttatagtagaatgatttatattcctttgggtatatacccagtaatgggattgctgggtcaaatggcatttctagttctagatccttgaggaatcgccacactgtcttccacaatggttgaactcatttacatttccaccaacagtataaaagcattcctatttctccatagtgtcaccagcgtctattgtttcttgactttttaataatcgccattctgactgtcatgagatggtctaagaaaaaagaacaaagctggaggcatcgtgctccctgacttcgaactatactacaaagctacagtaacgaaaacagcatggtactggtagcaaaacagacatatagaccaatggaacagaacagagacctcagaaataacacccaacatctacaaccatttgatcttcaacaaacctgacaaaaacaagcaatggggaaaggatctcctattcaataaatggtgctgggaaaactggctagccatacgcagaaaactgaaactgaaccccctccttacaccttatacgaaaattaactcaagcgggattaaaggcttaagtgtaaaaaccaacaccatcaaagccctggaagaaaacctgggcaataccattcaggacacgggcacgggcaaagacttcatgacgtcaatgccaaaagcaacggcaacaaaagccaaaattgacaaatgggatctaattaaactaaagagcttctgcacagcaaaataaactatcatcagagtgaataggcaacctacagaacgggagaaaatttttgcaatctacccatgtgacaaaggcctaatattcagcatctacaaggaacttgaacaaattttcaagaaaaaaacaaccccatcaaaaagtgagcaaaggatatgaacagacacttctcaaaagaagacatttatgtagccaagaaacatatgaaaaacagctcaacatcactgatctttagagaaatgcctttttttttttttttttttgagacagagtcttgcactgttgcccaggctggagtgcagtgacatgatcttggctcactgcaacctccacctcccgggttcaagtgattctcctgcctcagcctcccaagtagctgggaatacaggcacacgccaccatgaccagctaatttttttgtacttttagtacagacggagtttcacaatgttggccatgatggtcttgatctcttgacctagtgatccgcctgtctcggcctcccaaagtgctgggattacaggtgtgagccactggtggccgacccgagaaatgccctttttttaaagggatagttctctcatggctaattcaaggaatacaaggattctttcataatgataatgtctctatttcttctcggttataatctctgtgcaagatgatgtcattttcaaaaagttggaaatgggcaaacacttgtatttgagatttaaataagtatgcatataaaaaatatttgtcatattgagcacattacaacaattatttcaaatttccaagagatggatgatgatttgttgaatggaagtagaaaatattaagtaaaatagcagccatcactttctatgtgccagaaactgttctgagcactatccacacacttaggacagtgccttaaacactgtatatgtagtagttagaacagatacatgtttacatgtaatatgggataggtatgggggaatggataatgcttagaaccatcctggcacatagaaagtgatggaaaacagttcttagaacaattcctgggacatagaaagtgttgtaaaaattaaatgtgggtatatatatatatggaatatgcatgtatatgtgtataaataatatatgtatatgtgtgtatgtatgtataatatgtgtatatgtgtaaatatgtgtgtatgtacatatatcattatacattttgtatatatacatgtttacgtatacacatattattacaaatgtttgctctatataaataagctatatgtgggatatccaatataaatatctattctataagattgttgtaaaaagtaaatgagcatccatatgtacatgtatatacacactcacttcatttttacaacaacctatgaaataggtatattgatcctattccagaaactaagaaactgagcctcataaattaaacagtttgctcaaggtgccccaaatagtagcacagcggggataattaacacagaaagtcaggctctggagtcattgctcttatttaatcagtatctcctactggaaattttgattatcaatattgttcatatcatatggcttcaattgtttatcattagtgaaacctacaatgtttcattcagtgttccaatctaataaaacaatttgtgtctgctctgacatacttctcttaaaaatgtcaggtattttcagacacattggcaacctggtattgtggaaggagtggtaagtttggaatctggagacttaggttagaagtgatagatcttccaacagatcattgcagagactgggaaattatttaggctcaccaaaccagttatctgtaaaatacaggatatgttccttgaccttatacctctctgttgtgccttcataataatgagacagtagcacttatattgcctgagagtttctgtttacttgagtatctcttcataaagtgtaagttctttaagggcagggaccctgtcttttttactttgtgtcttcagcatcctttaggctactccctgtcgtctcagaagcacatactaaataagtgcagaagcaaactataaaagaagagaaaatatcatgattcccaaaacagttttcatcaggatcaaatgtaaatgaaattccgttcctgggctcttgctaccagctggcctatgactaaaacaccaggctggtgctgcttctagtagcaatagacattgactgaaaggcatggaagcaacctagaaattgcattgattgtaaatattttcaaatgaatatcttgaagaatggattcaaaacattccattatccatctatggggaaaatatttgcagcctctgtatatacctttattttgtgtttctgttatctcttagagtctttcaaaattgttgatcagagacaaagggtggctgttggatcataattgtaaaatgatggacatcagaagaactatttagttaagtaatgagagaaggagcaagtcctgtagaacttagttctaggatatcacacagcacatttcaggactcttctttaaatccttaaggagaggtcttttcatttgcctgacgaagaacatgagggaacaagcactttttccttgaaatgttttttgtactgatcagatctgctaataacgcaacatagacagactaccaggaatgcaactgcttatatcctctctgttcacaaaacattgcagtgcatttgttgtgccttcattttcctcatcagaactcagagctcatgactttaacccttttcagttttggaatcagttgtttctaagataggggctatgctttgtttctgtacctggtacttttttcccctggcataaatgaaaatatctcttcaaatatgtacccaagtagtagtaatatactctgtcccagtccctggagagctgtacaaactggaggtaagccagtcattcatttgattatattaagattcaatgtttaaaagcaggacaatgccataccatatgaaatcatattttacttctcacttactttagctcagttactttggtgatgcagaaagtggttttgaatttaagataggcattcaggctggaggcaggggctcacacctgtaatctcagcacttgaggaagctgaggtaggtggattgcctgagcacacgagttcaagaccagcctgggcaacacagcaaaaccctgtatctatgaaaatacaaaaaataagccaggcatggtggcatgtgcctgtagtcccagctacatgggaggctaaggtaggaggatcacctgagcccagcaggttgaggctgcagtcagccatgatcgtgccactgtgctccagcctggggaacagagggagaccctgtatccaaaaatatatatatatatttattaagggtccatagaaatctaggttatagaataggttatatcataaaatattagcctcataccttcattctactcataaaagacttagctgtataaaataaatattgccacaggttgagtttaatgctttctaattgcttggctttcagtgaagaatctctttacacaagaatgtccttgtgtgcggaataaatcggactttagaaaatctgaaaacctcatttacacagaaatatgcacatccctggactctatacagcccccctcctgtgtaattattcttcctttgacacaaagcactctaattccagaatgcctgtgttaaaaattaaagttggttaggtgtgatttttcctttcggatcctcttctggacattgaacaaaaggagactatacatttaaaagacacaaacctaaacatgaagtaagaaagacttgaaatttggctctagaaagtacatatttgaggctgagtaggttattttaactcaccaaatcttaatttcatcctttgtaaaatgaaatgatgaaaataatacttgccttataagcttgtctggaaagttgacttagacaggtcctgcaaaaatcttggcatgttcgtggacacatagaaagttctcagttaacgttaagcaccccctgttctcgcgtcttcctcctcaccttctcatcgctgatgtatatgaaagtataacatgcagcaagggaactagactgagtctgcctcaacacattctggaaggaagtattctgttctgcctatgctcctttccacaagttttattctaatcgtcagatgtgttctacttcatctgagtaattgtttgtgataacacctggagaggtcttaacttttgtatcttataaaaacaccaaacaccacatgttctcactcataagtgggagttgaacaatgagaacacatggtcacaggtcacagtaaggggaatgtcacacaccggggcctgtcggggggtggggggctagtggagggatagcattaggagaaatacctaatgtagatgaccggttgatgggtgcagcaaaccaccatggcacgtgtatacctatgtaacaaacctgcacgttctgcacatgtaccccagaacttaaagtataataaaaaaattaaaaataaaacaccaaaatattaagtggggagtgacttaatgaaccccatggaatgagaacgaaatacaatgtatatgcatttaacttgtacagttgtaagcagcatttttcagtgggctgtgatattaattccatttcacaaaagaatttgtgagactctcaagcaggtatggccaagagaatgatcctcattctgatttagcttctcagaagattgatgttctctctgggatcttttgtgtgtccagcatggtacttgcagcagaccattatgtgctgtcatgctgcttcttgatatccagactcggtgtgctctgcagaactgcagcctcgctacatgtttcagtgcaggaaattcacattaagggatccttttccagagagattgctcaggcaatttcagttccatctctgttttaaatgttggaaaacaccccctttctctcagtctacccttgctctgcatgcctatcttttgctttgctgtttctagattctgcgtttggttatgtatcctgtactcactatggcagtaggaggagatttaatatttattaccttttggtgggaagaataacttccagatgaaagtccagctgaaaacatagtctcctttggacaagaatataaagacttcagtctgccagagtagcattactagacacctggctgcaggaaatgtgatgttacttttttgacatctctgctcactgcaacttctgccacccgggttccagtgattctcgtgcctcaactccccaagcagttgggattacaagtgtgtgccaccacgcccagctaattttttgtatttttagtagagatgggttggacaggctggtctcgaactcctgacctcagcccacctcggcctcccagagcttgctgggattacaggtgtgagccaccacgctcagctggacaagcaagttttgaagcagaggagttgtctgcaaaatctggaatatgggggcagttatggagaaataataattagtactgttcattgaatgttttaatgtttgccagaccttttgagttcttcatatacattatcttagcctacctaaagcaaccatgtaaggatgtgtgttaatatatccatttacagatgaagtaatggaaactcagataagtagatatttcatgcaagatcacgcagctggtgtggaaaagctgagatctgagactggtgcactctgactcaaaagccagcactcttagggattagatttccttgtgtgaaaaataggtcatatgagaatgatggaagcatatagctacttttctttttcaccaaatactaattctgcatatacacataataaagtagtttttctgtagctatcaaggacttacctgaaaaggaaagggtgacatcagaaatccatgctgtgttgtgggggcatatttactctcaccttaataaatgctgcaaagcattatagaaaactacttccctgctcatggtaatatgacaaaatcctttcatcttcacgtttttcaaaagtgatattctggtgggcctgcaaatagtaaatattagcttcttgaaagatcctttatggagactaatttttttttttttcatttttattctcatggtttttttccctgattttctaccctcttgttttgcccattcatggtccatatatttttgtcattttaactcctcatcctgaagcacagcaatcatttctgagttttatggatcaccgcacagatattctggtggtaggcgattaatccttatccaaccacacagcagttttacctaggctttgggatgatatttagctgttactgtggagcttcctactggaatctagagaacagaggggcaggggaggtcagaggataggtaaacataaatcaggtttgtgcaaacaagcatgatgaatgctagttcccaaagtgctctgccttttgtcaaacttatatattaggagagagggttgtgtggcatgaatgatgaatcataaaactgctctctctggtgaaagggcaagcatagaaaccactgtagtaacacggtagcttggatgcatcatagggcttgggaatacagagtggaaaacagtaatatgtgtatcagcctgaatgaaacagtaaggagaacagagcagagtgtcccctgactaggaaatccagatcagtcaaaaggaagtgagtttggagaagcaaaacaagatacagtacgtcagggtttcttaaccaggcctcacacatagaaaaaaacaaaacaaaacaaaaaaaccctgtctgttcatttaccatttactgaaatttagctgtttcttcaattattaatgagataatcatggaattttgatcagctacagtggctttaccactaccagaagtaactgattgatttcttcatatatatctcaaaatattgtttatgccattcactactttgaaatttcagtagctattacattcaccactagaaacatatattttattacaaaatttaaaaatacttttaaaattgttcttcagtataaattgttgtctttgtaattctgtgtatgttattttatgcactagaaaatactatcctgaaaaagcattcataggtttcaccagtacactaaaagggtccaggaaagaaacaaaaagtgtgaactcttatggtcgatatgctgtttttaatgttaggtgagattcagctttttaagaatttaatttttagaaagcttgagagagaaaaatttctactttgatatattcagtacaatatattttgccacaagtcagcatctaccatgaataaaaattaatttggggactaatgccttaccttctacttgtcaaccttgcaacctgcctgtcaacatgagaccatggcaagcttttcagattaatcagtgctaattcagctcccatttcctttacttgtattatacagataaagtttgcaatgagattaagagtcttggctcttaattggaatttctgattctttttttttttttttttttttcgaggctgagtctcaccctgtctcccaggctggagtgcagagaagtgatctcggcacactgcaacctccgcctcccgggttcaagcaattcccttgcctcagcttccccaatagctgggactataggcgcatactaccactcccagctaatttttgtatttttttagtagagacaggatttcaccccattggccaggctggtctcgaactcctggcctcaatgatccacccacctcggcctcctagagtgctgggattacaggcatgagccactgggcctggcctctgattcttaattttagctgtactacttaattatatatgtgaaactagatatattattttatctccctaagcctcagtttactcataatgtgagtaataatagtagctaccttatagggatgtggtgaaggctaaatgcaataaagagaacttaaaacagtaaaaatacatagtaagagcttaatccataattgccagtattgttttcagtacatactgtaatcgtgcttaataagaattgtaacccactgccatcttcatcctccaaaaaggtagtgggtctctaaaaatccatgcacacctcccacaacgccacaagagcagacttctgggaccctggacatcttgggacctcttcataggatggcttgtatattctattctaaaactatttgcattaaatattaggtcaatatacaagaatacttacaaagtatacctaaggtataaagaataactatgtaacagatacttaatgacagtttaagccaattatcatttaccattagctctgaaatttccagaatgctcctctgtgataccagtctcttccctcccaagtgtaaccatgatcctgaaatttgtgtttattattccactacttttatggttttgccacatgtatctcccaatataaactttgagtgaatagagttacgttgaaacttgtgacttgcttctttcactcagcttaagttcctgagattcatccatgctgctataactagatctgtttatcttattttcacttttccatcattatttgtgaattggtattctataatttgctatccacttactattgatatcctctctttttttgctattatcattaatttctgctatgaatattgttaaatatgtctcctgctgcgcctgattctaacaagtagagttgactcatgaggtatttatatcctcagcttcacgagataacactaaattgtttttcaaacaatttttgttgttacatttgttctaccagtatcgaattgttcctgttctttcacattctggacaacacttgacagtgtcagacttttgcctgtttgacaatttgttgagtttgaaatgatatctcaatattttaatttgcaattagacgtctccttatttggagaagttctgtgtattctgggcactatcttttgccagttctcttgagttgcacacgtattctcccagttgcttgctggccttttcactcttatttggagtcctttgatagagcagaagctcttaatattaacatagttgagcccattaagttttttctttatgattgtactttgtgtcttctatcttaaaaatccacaatctaaggccgaggtgggcggatcatgaggtcaggagatcgagaccatcctggctaacacggtgaaaccccatctctactaaaaatacgaaaaaaaaattagccaggcgtggtggtgggcacctgtagtcccagctactcgggaggctgaggcaggagaatggcgggaacccaggaggtggagcttgcagtgagccgagatcgcgccaccgcactccagcctgggcgacagagcaagactctatctcaaaaaaaaaacaacaaaaaacaaacaaaatccacaatctatttttcatatgggtaaaaaggactaaataaaatccccttatatcatttaagagggaaaataattacccaagaggagaggaaagaattggattggcttggaagtggttatttttacattttttcatctgtagctacactgtgggtagaaaaatagaaaaattacttgtgataacccagattacttagcatctttagataataaaagtttactcttactgtggcattcacctctaatttaacttcatgagtctgttttcttagtcaactgtactagatgctagagatacaaaaattgttacgaggaggaagcaagcgtctaggcctccacatctggatagccattctcacatttaccacatcacagggatgccatgcaagggcagtacacagaagtttatctgtgtttcattttataatcttagtattttgtgtgtccatactcagtctgcccttggttcccactccccactttgctcttctttgtatataatttgatttgtgcctcatcttcttactagtctgaacatgttgttgaggtaggatatccaaccatcctggtttggctgaagttgggagacctcctgggatgcaggacttttagtgctgaaaccaagccccaggtacctgggacaaattggtcaccctactttgagggcaaggactatgtatgttgcatctttgcaccatgtacaactcattttacaatgtttacacatagacagtagtttttaaatggattttgcattaagttggaaggcactcagttctgacatggatccttccagtcattcttgcaagttatgtttattttctagcatctgatttcatgaagctgccatttttcttagacaagttgactcttttttcttgaatccactgaccttagggtagcagtaaactttgtttaccaacagggctctgtcatccacatgagggatgttgccattaagtgtctttttttttttttttttttttgagatggaatctcactctgtcgcccaggctggagtgtagtagcgcaatctcggctcactgcaagctccgcctcctgggttcaggccattctcctgcttcagcctcccgagtagttgggaatacaggtgcccgccaccacgcctggctaattttttgtatttttagtagagacggggtttcaccgtgttagccaggatggtctcgatctcctgaccttgtgatctgcccgcctcggcctcccaaagtgctgggattacaggcgtgagccaccgtgcctggccaactgtcatttttccccacaaatgcatcaaagcttgtttattaaaacaaatttattatgaatcaggattaattaacagattaacatttaacatactttaattgaagatattcatttagattttgttctgtcgtcaagtaatcacaaaagttgtagttaccaagttttctgccattgttgaattatcctggaggtcacatttttgtgtacaaattgatgagggacttgcttcgtagtataatttgagaggtggctgaactggcttctatagctagacatatttccccttttgggctagtgagtgcctccattagttgtcaccccttccattgtaagccgtttttcctcccgcattaccttataaaccacaaatgcctggaggagcctcagcatattaagacagttttgatcggtaccccttttagcagaagttattttttcagctgctttccaaagtaacagatgagagggaatttgaccttgtgaaagcaattgtgaggcagccaggtaggaggtgccgcaggaacactgagcagcaggggcaggaggccgtagctgtgtgtgtgtgagctggagtaggacaccttaagggaaatggctttagggatcaactttgctgttccacagtgctgtgaccttgggcaagagaaaagtctttaacaggtttgatttatgagaatattttctactctcgatagaatgcagtggatatctgatgcagttttgtgccatctaagtgactactgagagaagatttccaaatttctctgattgccatcagtagggagtgatgaagtgggattttcttttctagttgcctttatccgtgtcggtgaaatgagaacaaagctctctattctctcaatttagaaagaaatcagatctgaatctccaaaatcagttgaacatccttcaaccagtagttccgtgtctgatgtgtagacagtggtaactgccatactgaaagaaatgtagtcttgtgataattcagaactggacgtaaccaaaaaagtggtttttaatcacaaaattattttctggattgtaacaatttggaactggatataacccaaaagggtttttttgtttgttttttactcatgatataatttgtctgagaaaagcttccccagttgtgtggcaaataggttaggaggcctatttgagtaaaaatccaactgctgttacagtggaccttcagaataatttaatttggtcaattgtccatagctgtagtgaaattttgtcttaagaagcggtatctgaaaggaacttatgttacagactgaatgtcccccctcaaattgaagccttaacccccaaatgtgactatgaggtcataagggtgtggcaccaatccaacaggattgccgtctttataataaggggaaggaacatcagggagacatacacagaaaaggccctgtggggacacaaagagaaggtggccatctgcaagccaagaagagagccctcaccagaaaccaatcctgttggcacctcagtcttggacttacagcctccagaactgtgagaaaataaatttctgttgtttcagcaacccactagctggaattgtgtcacggcagcctgagcagactaatgcagcatctaattttaaaaaaatacttttcaaatattcaattttcccaagtccggtgatcaccacttggtttctgaatttgattttctattttctagtgaagaattttaccctgttccttcccgttctaggttcacagactgacttctggtccttgctgggggtgctgccagccttggaggctggtgagttgactttataagaaaatagaaaagcctaagttacagcaccagctttcttagttttccacagttcatggttctcctgtaggccactaatattcctgatacatctctctagcttttgtcataatcaaaatcggttgactgtataatacgtggtgcctgcttgcactgatgctgtgttattctgtttgtttgtttgttttctaaaggggaatcttgtagattactagagagttcatgatactctggtatcagttatgccacaaactagtattaatccatggacatttcccgccagcccaacctgccgcagaaactcaatttgagggttttctctatgtttctcgttaatataactttcatcctctgctaagttatcatttctctttacctggagccagaaaagtaggaccctgagccgaatctgcctctctacctgcttttgtaaatgaagtttcattggaacacacaaccatattcattggtttatgtgttatctatgactgttatcacacaacaacagcagcattgagaagttgtaaaggagcaaaaaaagacacagaaccatctgaagtctttgtgcagtggctcatgcctgtaatctcagcactttgggaggccaaggctggcggatcacttgaggtcaggagttcaagaccagcctggccaacatggtgaaaccccatctgtgccaaaaaatacaacaaaaattagccaggcatgggggtacacaactgtagtcccaactactcgggaggctgaggtgggagaattgcttgaacctgggaggcagaggttgcagtgagccaagatcctgccactgcactccagcctgggcgacagattgagaccctgtctcaaaacaaagaatctgagcctaaaatatttacaatctgtatatctatcttactaaaacatatacttaaggaaaaagtttgctgactattgctttacgttacctattggcttgacaagcccaatacattcccatttcttattagtacacgaatcataaataatactgagaaactataacttaatattgttaaatcttcttctctgtaattatagtaaaatttgagaggaattagtatggtatatccctatctgtttattaagggagtgtgtgtgtgtgtgtgtgtgtgtgtgtgtactatatgtttaataaaatcttaggaatactaggatttgttgagtagcgttcttatttaaaaaatgtgtaaaatttaaaattatgtaaatattcataatacagaagtcttcttagctttaaagatttacctgggtgaagacaggcattgtctgtacttgatcaagtaaattttcagttcattcaaaatgtttattttgcttgcatcttaccaaacctcaacttatagtcagttgaccaagttataaaagttctctttcattcccatgagatctcaatctatattggtggaggtgggagtagtaatattataaggcaaaatctctcatctgttctccagaaattaagtcttaacaatgttttctaagagcaatagccctgatgcagtgcttaatgctttatttccatatttgttatttctgactgctagaaagcaaaggtcactaggtcaggaaattagcttaagggggaaaaaggaaagtagttactcttaaggttaaaatccatatagtatgatgggttattgtgatgaatatttagttttgaaagacttcatttattatgtaatagccatatgcagttaacagaatgcttctgttagtgaacctcacaaatgatttagtaacccccagagattagctggatgttcatatgtagtagaagaagaaagcaaatttgacattaaaaacaacacataatgcaatgaaaacaaaataccccttaagagttaccatgtactatacaagacccaccagtcatccccagtaccattcagagcatgagattgattcagtcatgtccaccatctggttctataccggttttcaagtcccaatgatcatagttttgataatgtaccaggtaccatattaagggcttcatatgtaaataattttaaagtttttttttttaatttgaagaaacagaagtcaggttaacaaatatgccttaggtaaagtaaaattcaaaccaagtaagtaagagttcaaagtttatgcagtattaaaaatcatttctggccaggcatgatgactcacacctgtaatcccagagcttcagaaggccaagatgggaaaatcacttaaacccaagagttcaagaccagcttgggcaacatagggagaccgtatctctacaaaaaaaaaaaaacaaaaaaaaacaacaactaaaaaattagctggacatggtggcgtgcacctgtaatcctacctacttagcaggctgagtgagaggatcgcttgagcaaaggagttcagggctgttgtgagccatgattgcactactgcacttcaccctgggggacagagcaagaccctgtctcaaaatacacatacgcacacacacacacacacacacgtgtgtgtatgtatgtatgtatatatatatataaactttgtttatgtctctcctgatctgtaatctcttaaaagacagagactgtatttttctaattgtttaattcccctagtgctcatctggtacattttctacctagtgcagtcgtatcttatttagagtctcatttctaaaaactgtgcatagacaaaattggttttcaaaaccttttaggtaaagcccatgttggagactgacatatgacatttcggtaaacccaacacttctgattttcttcataacactggaaaaatatggctgtttttcagttgagcattagataaaggacttttcctatcctcaggggtcatgttgtacgtaaaatatattctttcatacaccagaattacactcaacatgacattgagaggcatgaagagatcaagacttactcaaagagttgcacatttatgtctctcttctcatgctcactgtggggcatagtattgacattgagagaaccctgaacagtattatccttgagcctcttagggcgtgatttaactcacataagttaaattcaccaatggtgccaaaatattgtaccaaatagagataaagacctcacattcctttagcacttactatatgccagccacattgaatgaactctgcacttaataattctcatgacactgcacaaggtatatgtcatcactgtctttgtgttatgagtgatgaagctcaggtgtgcctcagaaaagctgagtaaattccccagggttgccctgccagtgaatgccaaaatcaggatttaaagacctcaaatgcttttaactatctagctttgcattttccttaagaaatgttgattgaaaaattacaagtaatagtatatataatttatattttgtatatataatttatatatacatttatataatatctatttataacatatataaattatatatacaatctaaggttgtacactatctgcctttcgcttcaagttgatttttataaatagtcttctccatgttgtttctatattccaaagaattatttaaggtagtaaaatcatcagccatttgtaaataggagtccagtcatgcaaaccttagctatagccccacgaaggctacaacagctgggagcactgttcacataaaacacaacataaatgatgcccccacccaggatgcagaacaatcactgcccttgcctgctagctaggcactggattcatcaagaacattttaggaacagataaactcctaaaactctttatcacacttcattagttacattcagtgctatgcgtccaaattctgctcctgtacatgtttaataaacagagatgtctacacattgtctgattgtaaattgtgaggatttcagcatggtggactttgggtccataaacacataggcttctcacgtttatacagaaagtcaagcttgatttggggcttaaatccattgtgaaaatgcagtagatcttttaattaggtgaggatatttctaaagacatctttaatgtctattttattagtgatgataatgtaatcacaaaaacagctaaatccaaaatatcctctccacactcatagtagtccaccgcctataaaggtctttaagaaagcagaagcacagtgttcataaccttgctggcatgaggttaattcagaaagtcacttggtctttgctcttgacctcaaaatctacctcctgttaagaaggagaaaaaggaagaaaagcatttgctcgtcacttgtcaggaaataaaaggaagaaatgggatactgagagtaaagtagtatagtggaaacacgcattttctattttctacttaaagttccattacctttcaacattgttgatattgtagatgaagaaatgcttgcctactctctacaaatgatatcctatcccttacaagaacagataaacatagtggttgggaaacaatttaaattgtttctgagttctttggaggatttcatgtaaattcattagtaactctggaactatctactatgcatttaaggaattaaaaatgtattagtttcactacacaaatgtattagcttccactctgtagttaaatgaaaaatgtattagcttatatgtataaatatcttaacattcagtctgtagtattttctcttagatattactccatttgaactagtctataatgcaaacactgcttaaagtctcaatgctggagaattacactttttaaaaaattttcttaagtagcagaaaatatttgtgtatgcggcaatatttgtttaatatagcaaataagtattccttcctaaaaatgctctttcagaacttattcaatgctataatagttttggaaactgaagaaggatattactttttgaaaaatttgaaaaaatgctttcagaacttactcaatgctataatagctttggaaactaaagaaggatattagtttttgaaaaattctagggccgggcacagtggctcaggcctgtaatcccagcacttggggaggccaaggcaggtgggtcatgaggtcaggagatcgagaccatcctggctaacacggtgaaaccccatctctactaaaaatacagaaaaaaaaaaaatatatatatatatatatgttagctgggcgtggtggcatgcacctgtagtcccacctactccggaggctgaggcaggagaatcgcttgaacccgggaggcagaggttgcactgagccaagatcacaccactgtactccagcctgggtgacagagtgagactccatctcaaaaaataacaataaaataaaaaattctataaatgattacatacattaaccacttgaaatctaaaaaaaagaaatccagtattggggtgaagattttattcttagtagaaagacctggtatgtgccactcagttattgaagggattcgtttcatgtagtaactaaatatagatcagcaagacagatatctcggaaccatctaggggaatttgtaagttttcatcgaattttttttttctagtgagcgatgttgctgtattacacttaaactgaaacctattcactctctacgcacctgttcaatgccaccactctggataactgttaaaattcctttccctctatatctccttgaaaaatagcctgttacatctgatgggtcaatctgacaatctccaaagaaagataaaagtaaagtcaaaaaaggacagtgtgagatattgagataccaaactgtaattggaaatgaaaatattttctcttcatttttctggttctcccacactttttcctctattaacaattttagccatgccttatctcccatttaactgtaatttgaaagtgaaaaatctgtgagtaaaaaaggtgctgtttgtgtatatctacataaacattcatgcatctctatcccccatgtccagtggctccttcaccatggaataactagatcccaattttctgttcctttgtctttcagttatttttggaagctttcacaagggcgccttgaatgtgcccacagcaggacttgttagttggaggcaccacccagcatctgccctgctcattgcctattgtggctttttctggccatgttcagagcttgctcttggatcttgatgaaattgaaactggccagattgtcccatagcactgatgtttatggtttctttagaataaacatagaaactgaccctcccagtcttaaaacttgagaaagttacgtttgttgagttcctttctcaggaaaccaaccatcaggtctcccagatagtttcaaggaactgaaacttaccagatcaccacctctggacaatgagacaccagacccctcacgcatcattattgcctaaccgagcacctgcttcctgtggaccaacttctcttccttactcctccctaattcctgttttcccacataaggttacatttcttccctgctatataaacccctaattttagttggtgagacagatgaatttgagactgatctcccatctccttggctgcagaacctgattaaagccttcttccctgacaatacttgttgtcccagtgattggctttctctgcagtgaaaagcagaacctagaccaaaccccaaaccttggcattttggtattggtaacaaaagcttccaccacctattaggaggaagaggacaatagagctaattccacatactctaaaaactttacgtcatcaggcatcagaatgtacttcatcccctctcttctttggcccctctgttactattgaggaacactaattatgcttatgtaaattagacatagaagatagaatatttattgcctataggggctgtgtaatcattttatagaagtcagacacctacaacctgctcacctggggaaaaaaacccaggaattatttatctctactctttaaattatctgagttaataaacacatctagaattgaagtgttttagaaaataaataaaagtcctccttaatgcatttttttattggataatctccaaacttcccaacccaaactcatatctgtttattactttataactgtatccccactcctaatatgaacagtgaagtccaaataagcttataaaacccaaacaaaattacaaacaccaattaccaatagaggtagataaatttttataagcatcaaattttatgaagagtgttttctagtcatttaaatgtatttgctgctgaaggacaaaacagtattaactatctcaaaggcagtggctttagaattgacaataccctttcatatacatctctatatcagtttttaattatttgtaattatagtgcatagtttccattttcttttcctctttctttctttctttgttttttttttttttggtttttttttttttttgagatagcgtctcactctgtcacctagtctggagtgcggtgagtggcatgatctcagctcactgcaaccttgactttgagggctcaggtaatcctcccaactcagcctccctagtagctggatctacaagtgtgcaccaccacgcctggctaatttttatatttttagtagagacagtgtttcaccatgttagccaggctgttcttgagctcctgggctcaagtgatctgcctgctttggcttttcaaagtgctaggattacagtcctgagccaccgtacctggcctccattttctttacatacacaaggtgcttaaaccatttttttaaataagctaattgtagaggtacaatttgtaagtgaatggattaacaatttgcccatagttacaagtttaaaagcaaaatggattctgattccaggtatggcttccaaattctggcttttttaaaactgcaaaccatgatcaaagttagattaggcattcgatgaagagtcctcctttcaaaaggagccctcctttgccttatctctgaaaccagcagagtacacacacttcagttgctgttcttcaggttgtgcaatacaggggcccaagtatgtcaccccgtgattggtccctgcctcaacaagaaacatcactgagctctgaaggtacctctgctgtctgtgtctcttgggatttgaattcatcctcttgattattactgccctgcttattcaactcctataaatcctataaagcctgtatgttttaccatagttgtcaccacgcatgtgacattgggttatctgcctaacctctgatgtccctctagatctgtcatctaatactcatgcctacccttgcctaaatgtattttctacatttctaacttccgattacagacgcttcccttgattgactcttcatcgaatgcctaatctaactttgatcatggtttgcagttttaaaaaagccagaatttggaacccatacctggaatcagaatctattttgcttttaaacttgtaactatgggcaaattgctaattccttcatttataaattgtacctctacaatagaggtagataaatgataggtctttaatgagttacatgtataaactgccaaccacagtggtggaatttataggaatttaacaagtgataattattgttctcctcttgcttgactttaacttccaccttattggaaaaatttttccattaacttctaccttaatgcccattctcacatggcttcagattcatgaccctgtgcagattctttaaacctgttagtgctcttttggatccttgataatagcctttctctgtttccagcctcaccttcaaactcctggtttcatgtgattcagtgttgtgcccctgtccccaacagagctgtagcaataaaaggtttccctttcaggaagatgtgaatatgccttaaacctctttaagcccttaaaatgtaaatcgaattttatttgtattataaagaaagttgcggtttacaaattgaagatttctgtaatgaagaaacatttatctttttttttttactttctgacacacattcagacatgtcattagcttttttaaaactgcaataatcaataaactttgatacttacctattttaattctattcacaactcaaaaactgtatcagagtgaatttctttatatgaaaactaatatcgttgatgaaaccatttagctagacatatacagtgtgatgactaacaggcatctcgaagtcaacttgttgacctgacctcctctttttctcccccaaacctgtgtcacctgcacatgtccccatttcagataatgacaacttcatctttttcattgctcagaccaaaaccttaaattcttttaaatttgtttgctttctctcatgtccctcagccaatatgtggctttacctttaacatatgttcagaacccaactattagttctcaccaccttccatgctaccattctggtctgagacaccagcaagcatctttcttctggaatattaaaataccctcctcattggtctgccttttactccctacaatctattttacaatttggtctcactgcttttcccctttcctcctacactgtattttcaacacagctatccgagtgattcttttaaaaagtaaaccagaacacaacattcttttttttcttcaaaaacttgcattgactctccattttactcagagcaaagccaaagtccttctcttactctgtcatgtataacctgcactgcatccctcctcaactatctaactcctctcctcctaattctattctatgatattttcttctattcctatttaattctgtcctagttccactggtgccctgccccacctgttaacatgccaggcttgcacctgccatcaggctatggtctactactccctcagatcagtgcttgcccaactccatctcttcctcaaaaatttgctcagacctcaccttcttaatgaagctattctaaacacctatttcctactgcatcttacgcacttccctccacattcatggagctcccttaccctgttccactttttctttttttggtaacatttataaacttctaacacactatgtattttgcttattatatgtttaataaattcttcaagggcatgcatctctgttttattccctgagaatagtgcctggcacacagcaggtactcgatgcatatttattaaatgaatgaatttttctttgtctgaaataaatttatttggaaaatatttaacacatttgtgttttgtttagttggggttttgttactactgctatttctataaaaggttgaaatacagaagggaaaagaaaatctcaccagctatctggccttgtacagataaagccaaatgattgaatgcttgactgaattgactggttgtttggacatattttttgtaatagcttaaggaacaactaagctatctgacttccaccccctttccccgtgctagggctagaactgtcaaaaaggcacataatacacatttgggttttaaagaatttagttaattgaattcaatgaaccaaaagtacagtgaaaatcatcaacatttatatgtaaaacaaattctgtttttgtctggcttaaaggggatgtagctgggggctaaaggattagaaatgagtaagagaataatctgacattgctttgcttttcatgcaagctttgtaagctctcaaatggcaatgttggagaattcattacattgtggtaaagtatgacaagttgaagagtctaaattgagtaacaaaagcaaacaccaacatattatacatgaaaactgctgttgaaacaacagatcaaaaactgtactctaacactgtagcactttttatatttttctttattcagagattttgtaaggctgtttatgggttagcatggaaggaataaggctttctaccaaaagcagacacacagtttttgtacagaaatatgtctaccagggattatatactgaggaaatggtgaattgatggaaagaatacgataaacaaggggggaaatgtagtaaagaatcagtggttacctgatgcagttctttaagaaaaggatgattgggtagtgggaacacttacaaagctaaacagtgactgtgagataataactggacacaagaacagctctttaatatctagtgagtgtgtgtatatgtgtgtgtgtatatatgcacacatatatctttcacacactgtgcacatacacacacactttgtatgaggaaggtctatgatcagaaatactaacatcactattcaagccttgatgacagattttccactcctgtgataattcctttgtagctgattgactttggaaccagagagtcccttctaacaatgcagctattcctaggattataggttctcatcaatacctctttttaaatgtgtcacatttgtcaggtcacttttctctctgaaggaggcagtatcagagtgctggacagaggataagaggggaagagaataaggatgattaacaggaagagaaaaaaattggagggaggtcataaagattttccttgatttctcaattgtgccttggcatggaactaagacaaattctgccagatcacccattaaaagtcagtgtacttaataccctcaaaattaatgctatatacaacttcaactgtatgtttttttaaaaaagaaatgcaccaaacgcattacattttaatgatggatagaattaaatgctgtcatatgcttggcctttgcaaattgctccattaattattataggtgcttccagtgtgacatgtgagtattaaaaaaaactgtattgaatttatctgtaaatagatttgaaatgattggtgtacattctgttgaaacttcccagggagtacatattattcacattttttgtagacgtgaaagcaggaaacacttaaattgtccagaaatcagcctttgcattaaaacatctgcattattttattcctcataactgtaggaaatatctcatttaagcaatcttataagtcaactaaatgcaaataaattctccagtggagaatgacaagttcatcaacttgattccctcccactcccaacattttctgtcttattgtcaactgcttcacatggtctgttcagtggatgtgtttgtgcaccatcttcacaatgaccctagtctacattcctggttatatatcattactctaaatatcccccccaaactgtggcaaagctttgcagcacaatgaattacaatgcaatttggtatcatggaggtgaattttttaaattttgttctttgctgttttgccagagctgattgatgccagaaaggaagattgcttagaaactaggattctatgatagcctgtattgacagatgcaacttttaaaaccagtcagattgcaagccatttttacatcatattgaatcatatacttaattatgtctgtacttctttcacaccttaactttggtgaatctcaaagtatttcatgaaaacttggggaagacatcctccgtattagtcagggttctctagagggacagaactaataggatagatgtgtgtataaatgagagtttattaaggagcactaactcacatgatcacaagataaggtcccgcaataggctgtctgcaagctgcggagcaaggaagccagtccaaatcccaaaacctcaaaagtagggaagccgacagtgcagccttcagtctatggttgaaggtccaagagtagaacttgcagtacaatgtttgaaggcaggaagcatgcagcatggaagaaagatgtagggtgggagattaagcccgttcagtcttgctacactctgcctgcttttattccggctgcactggcagctgattagatggtgcccacccagattgagggtgggtctgccgttcccagtccactgactcaaatgttaatctcctttggcaacaccctcacagacatacccaggaacaatactttgcatcattcagtccagtcaagttgacacccaatattaaccattaaactctccttcctctattaaaccacataaattatatagactatctcacatctttagtgccattgcctgcctgcctgaccatgttttttatatgtgtgtacacatatacaggtatgtgtatacagaaacaggtatatgtatacattcttgtgtatattggtattatagccaaatctaatatgtgtagcttccctgtatttgatgaatcccctccttaatgtctctccctctgctcactgatcacacacatatttatttctgcacttaaaagatagatacttacatttttctgtccttctgtctttgttcctgctattccttcctcactcatctccacttgttgaaactttgtctgcccctcaagacccagggggcatattttgttctgattgtttgggtctcaattcaaaatctaccaacagataggctgtgtgatttgatgcaagtgatctaaccattctaaaccacagtgtcctttacagggcagtggggatggtaataaaatatacctcatagggcagatgtaaggctatattgaaataatctttttaaaacattatacacaactcttgccacaaaggaagggcttaaacaatgcacgctaaactctatcatctctatggagccccttttatctctatgtattaatctcttctcaagtgatctcatagtgatttgctcttagaaagctttttgtttgtttatttgtttgtttgagatggagtctctctctgtctcccaaactagagtgcagtggtgctatctcagctcactgcaacctctgcctcccatgttcaagcaattttcatgcctcagcctccagactggctgcaactacaggtccccaccaccacacctggctaatttttgtatttttagtagaggtggagtttcatcatgttggccaggctggtcttgaactcctggcctcaatgatccacccgcctcagcctcccaaagtgctgggttacagtcctgagccacagtgcccagccggaaagctcttattgaacgacgttcactagtctagtgacttgtgtgcatgtccatcttctgcattactgagcatgtatagatctacaataacaaaactgtgcgagatgctgaggatatagcagtaaaaatacaggtaaggaatccctgattacctttcaggtggagaagacacataaacaagccaacatcagtggcatattttcagatagtgataggagctataaaggagataaaagtggtgatgcgatagtctccattctgctttgtatgttaggagctacattacaaagagtagactgagaccacactattgctttagtttctctttcaaaggctccctgactccctatatgtgaggtcacaggcaccctatataaagctgccagagctatgcttcatagcttctctggcagctgcttcctccctttcattcaaatttatttgctctcatcagatttaaacgcattttctccttgtatctgatcaccccaccgtgtcttccattttactcagattaaggccacagtctgactggtgttgatttcaggttcatgccaagacactgtaagtaactctcattcctccttatgattccatttactactgcctaagagcacaagcgcagagccagggcatctgtccccatgtcctgccccccagtgtgtgttcttccttaaataaccaggtagggaagggcagataaggaagcccctacaggcaagtcctaatggtcttccaaagggaaaggaacttggtcatagatgctctcaataatagtaccaactcccatcgccgagttttattttagagtctcagaatgggtctagtgacacttgctctcataataaagtagaagaaacatttcttttggataaattgcccataggcttcattatcagaagctccatacatctaggtttctaacacttttaccatctttcaccatgagctcctttcagaaactctcttgagtctcagagccaagaatgaatgctgagggaaaagggagatgatatctatcttgccatgctttaccctgtatctctctgcctgtctatccatcactcaattcagatgtatactttatccttccttttttctgcaaaatacctctatctaaacctgagagcacaagactatagaagaactggatttcctaagtgagtccatggattagactcaccatgccctatagggtctgtctatagaggagtcacagaaactaggacatttgggctctctgaccaagaatcactgaaaatgggcgcaggctttttgtggctaaccctgagcatactagattaatatatctgtttgaagtgtatgttagggttgcatctagagataaacgcagtgactctaactgatgtcaagaaaagcaactaaccccttgtcttgtattctgcaaacatctagtattattctgcttgttcccaagacacaggcttcatgaattaatgcctcctttcccagttaaatattcaaaactcatttgcctaaactaagtggcaaagaaaaaaaatttaaagatgggtgtggaggagcattgcttgattgtaccaaaagcatttgattaaattgattggagagctacagccaaattaacgaagactggcacaccttacctatctctttctcttatttttcagacatgaaaattgctcaggcttcaagtctagtctgtgtgaaagcattaagtgtttcagaaatcaacatgtcttatcaatctattgtgctctggggaaaaaaaaagccagttagtgacattatttccttatgttctagaaacctgataataccttattgtacatcaggagtataagcaaatttcattgtaaagaggttcttctgacaagatctgtgaagaacatgatgttattaacttagacgtctgcacttacaatatagcttttccaagacaatttttgctgggctacaggtggttatttaagacaatcaatttacatagaacaatttattcttttttcatgctgttaaagcaaattggtatgtaattagatttatatactgaataatctcatttgcatatccaattaattcttcctgttttaatttgctagggttgaattcacattagtagtaaaaataacacttaaattataaaggcctcaaaattttctttgctgtaatttgttcaagatgttgcatttaaaaattggtccccagcattctttacaaaatctactgggaatatgtgaaagattttacttaaaagtgcccttagccaaatatcacacttgaggttcactctttgttcatgatgaagaggttaatggatggtagaaagctagtccttgcctcaatacccaataatattcaaaacaaggaaaactcaggttctgttttcaccctctgacctttcatgctttgagtatgtttaaacactgagacatacatgcacagaaatgaaatctgttcccaaataatttatatttattcttcaactgtatcacttcaactattgttgtttaacacagtgggaatatatatactgtagacaaatattattctttttggattcagatacaccagagcttagtatttgtttgtttcttttgccacttctgatattgggaaaccgattttgtctatctaagagtcagtgtcctcatccttaaaaccaaaagagaaaaatatgtgcctttctagaatgactaatttcacatggcataacatataaaagtatctactagtgtggatccaacaatagaagatgttcagtcagacatggtatctggtctgtaataaacatatataaacactatcaatcaaaatgaatattcaatttctaggacttcatagtatttttattaagttcagtgaatgtttgttagtggccattttcattaccagactttagattcaaatattggctaagcattttgtgcaaattatttagtctctctatgccttagtttcttcgtgtgtaattcgggaataataaaaagtatttttacctcgtataatcgtggtcagaattgaaggggttaatacataccctcagactattccctggtgcatagtaagcactcaatgaatgttaaccatggctatcattgttaccatgttgaaagaataggcacccatatcagagtttctttattgttatctattagtaagtgtaagagtgttttaggactaccttaacaaagtaccactgactgtgtagcttaaacaacaggaattaattttttcatagttctaaaagctagaagtccaagatcaaggcttcagaagtttagattgttcctgaggactctctccctggttttcagatgatcaccttctccctgtatcctcacatggcctttcctctgactgtatccaaatttcctcttcttataaggacagcagtcagattgggttaaagaccaccctaaggtttcatttaacttaattacctcttaaaaggccctgtgtccaaatacagtcacattctaaggtaccaggggttagggcttcagcatgaaatttggggaaacataatttagctcataatgccaaggttgaatttcccttatatctggtagagaccctgaagctctgttttcagaactgatattaaatgtaagcatatctgtgtacttaaggtatttaaaaagcaaggccaggcacggtggctcacacctgtaaccccagcactttgggaagccagggtgggcggatcacccgaggtcaggagttcgagatcagcctggccaacatggtgagaccccgtccctactaaaaatacaaaaattagccaggcatggttgtggacgcctgtaatcccagctactcaggaggctgaggcaagagaatcgcttgaacctgggaggcagaggttgcagtgagccgagattacaccattgcactccagcctgggcaacgagagcgaaactcatctcataaataaataaataaataaataaataaataaataaatagcataagtaacctatgccttatctcaaggtcttggcccattttctgcagctacagccatgctttcaaagctatacttttattttctcccctcagatttttatagcctgtgcatcagattcatgtaatagaaatgtcataacatttatattaggtctctattccagagacctaggcttacacctcatatttgttgtttgttgtataaatatacacatacaaattacctaaactcaggcaagtgattttacctccatgagacctccttttacttatctgtaaaaggggacatatttcctcacaaacagatgcaaactaagacaggatagggaaaagaattttgtaaattctaaattgctgtagagataccagctgtctctgcttactgaaaaggcaatcttaattccattttctattttatggtcattgttagtttacagttactaatattaaatggctttagtggtcactttaggagagacatttactttgttgttaaaccaatatgtttacaattagatataagtttctttctggatttgaagataactgtaatttgcagttgacgcttatgcaaattgctatgttctgctgcatacccattttaaaatacaaatccttcccagtcatcactgagtgtatataacaactgcaaagaaaacgctctgaagatttttttttcctgtcaaaatgccactttgccttcagaaccaccatctaaacattatcttaatgacacttactttatttggaatgccagtatcctttgtgtaattttcagatagcctgcagatatttgaaaaactttaccagcttcttcatcatttcagtctgggaaatgagcatcctattactggcatgccttgtgttattgtgctttgctttattgcacttcacagattttgagttttttttgcaaactgaaggtttgtgccaacactgcatcgagcaagtctactgccaccattttcccaacagcatgtgcttactttgtatctcagtgtcacatttttgtaattgtcacaatagttcaaagtttattcttactattatatctgttatagtgatctgtgatcattgatgtgaccattgtaactgttttgggataccatgaaccgcacccatataagacgaagaacttaatcgatcaatgttgtactctggctgccccactggctggcctctcccccatctctctcccttctcctggggcctcccttttccctaagaaacaacaatattgaaattaggccaattactaaccccaccgtggcccctaagtgttcaaatgagaggaagaagcgtacatctttcactttgaataaaaaactagaaggaattgaccttaatgaggaaggcatggtgaaagccaagacaggctgaaagctatgcctcttgcgccaaatggttggctaagttatgaatgcaaaggaaaaattcttgaaggaaattaaaagtgcaacttcaggcaacgcatgaataagaaattaatacagtcttattgctgatatggcaaagtttgagtagtctggatagaagatcacaccagccgcaacattcaacattctcttaagcgaaagcctaatccaaagcaaggccctaattctcttcaattctgtgaaggctgaaagaggcctggaagctgcagaaaagaaggtggaagctagcagaggttgcttcatgagatttaaggaaagagatgccacctccttaacataaaagtgcaaggtgtagaaacaaatgctgatatagaaactgcagcaagttttccagatctagctaagataattaataaaggtggctaccctaaaaaacagattttaaatgtagataaacagccttatgttggaagaagatgccatccaggactttgataagtagagaggacaagtcaatgcctggcttcaaaacttcaaaggacgggcttactttcttgttaggggttaatacagctggtgactttaagttgaagacagtgttcattgaccatcctgaaagtcttaggacccttatgaatcatgccagatctactctgcctgtgttcttttatggaacaacaaagcctggataacagtacatctgtttacaacatggtttgctgaatattttctgcccactgttgagacctactgctcagaaaaaaagattcctttcaaaatattacttgtgtttgacaatgcaccttgtcacctaagagctctgatggagatatattaggagatgtatattgttacccttccagctaacacaacatcgaatctgcagccaatggatcaggagtcattttgactttcaagtcttatttaagaaatgcattttataaggttatagctgccatacatagtgacttctctgatggatctcggcaaagtaaattgaaactcttctagaaaggattcaccatcccagatgccattaagaaaatttgtggctgggcacggtggctcatacctgtaatactagcactttgagaggctgaggcaggcggatcacttgaggcaaggaatttgagaccagcctgaccaacatggtgaaaccctgtctactaaaaatacaaatatatctatctatagatagatattttacatataaatatatatatttataaatatatataatataaattcatattatatgtataaaatatgtatttttataaatatatatatatatataaaagggaagggaaaaggaaggaaggaaatttataattcatgaaaagaggtcaaaatatcaaccttaccaggattttggaaattgattccaaccctcacggatgactttgaggggcttaaagctttcaatggaggaagcaactgcagatgtggtggaaatagcaagagaacaagagttagaagtggagcccagagagagaagtgattgaatcgctgccatcatgataaaacttgaatggatgaggagttgcttcttatagataagcaaataacatggtttcttgagatggaatctattcttggtaaagattgtgcaaattgttgaaatgacaacaaaagagaatattatgtaaacttagtggataaagcagtggtggagtttgagaggattggcttcagtttgaaaagaattcctactgcggataaaatcccagcattacctgctgaggaagtctgtcatgaacggaagactcaatcaatgcagcaaacttcaatgttgtcttattttaagaaatggccacagccaccccagccttcagcaacatccaccctgatcagtcagcagccatcttaatcgagggaagactctcccccttcaaaaagataacaacttgctgaaggctcagataatcattagcatttttaacaataaattattttaagttatgtacattgtgttttttagacataatgctattgtacacttattaaactgcagtatagtgtaaacatgactcttgtatgcaatggaaaaccaaaaaacttgcgtggctcattttattgcagtatttgttttattgcactggtctggaactgagcttaagatatatctgtatagataagactatgaatgtatgaaatttcataggctggaggtatcttaaagaacatctaattcatttacaatcctgttataaaggttatagactctttactatggaacgcaaggatattaacatcttttactagcagacattgagtgaacaagtttatatgtcaaaaagactgttacggtcttttcctttctgatgccttctaagacatggtggacctaccagggtaaagattcaagagtggccattgcagtctatttaacagctccattctttcaccacctcctttgatctcatctttttgagcctctttccttgcagtgaagggacaagcagggtagaaaaaaatattcccttaggatcctcttgcttcctttgtgctcccgatgatccctttgtattttcaatctgtgggtctctttaatgcctttattctctccttctcccaaaaatagtgtcagttcaccaaggacaccacataggtagtcagtcatttggttcgatcagattctcatggaacctacaagacaagcacccttttcacttttctaggaatggcctcctcttagcatataatctgggtgttacactgaaaaaagtctagctcttcctttgattgagtagcattatcaaaattaccaagggccaggcacggtggctcatacctgtactcccagcactttgggagactgagccaggaagatcgcttgagcccaggagtttgaaaccagcctaggcaacgtagggagacctccatctctacaattttttttcttttttttcttttttttttttgagacggagtctcactctgttgcccaggctagagggcagtggtgctatcttggctcactgcaacctccacctccctggttcaagcaattttccctacttcttactctcgagtagctgggattacaggcacctgccaccactcctggctaacttttgcattttttttagtaaagatggggtttcaccatgttggccaggctgatctcaaactcctgacctcaggtgatccacccgccttggccttccaaagtgctgggattataggtgtgacccaccgcacctggccaaaaaaaaggtgttgtttttttttttttaaatagccaggtatggcggttcatgcatccagttctagcaacttggtaggaggattgcttgagctcctaccaacatttttcgattgctgaggcaggaggattgcttgagctcacaaggtcaaggttgtagtgaactatgattacaccactgcactgcagcctgggcaacagagcaagaccctgtctctgaaacagacaaacacaataacacaccaagaaatttgggaacagaagggaaataaaaacctcatcccaattacacattcacttacaaaacagatacttagaaagtgcctaaataagtactagtaatttatgtagtaccagtggaaagtggtctaatagtcttattatttcaactactatccttatggatctgctaatctaaacagacacctctctcccaaaatacagtaagtgttcagcagataatgaaaggggactgctgtgcagctgctgtggggcatggcattgaaactgaatccaaagcccactgggtctgtgaggtagatggaatgtgacagggagagaagagagaaaagacttcctagagaaggtgccaatgtttctaggcacacaggaataacaaagaaaactcagcaggggcccagagcacagggacttgtccaatgagatgagagaagcaaggaagtagtagtacaggtctcagtggaatccttgccttagtatggtatgtgattttttatagtgcagagtggatctcgtgtgtgaatgtattctccatcgtagacgtgtggtcgcttatcagtgtggtcacttatcaatcacatttaagctgttgtttaaaatacttatggatcttttcttttggaattttctttacggctcctattttattcctctgaatatttcaagtgcttgtaaatccttgtcctttgaagttagatttcatttttggcaacagctaagctttccatatttagaaacttgttcagagccatttcatggtaaatgttggtgttcatgctgggtaatactgttttttggtcaaaaatgaattgtgactataaattaatgaagctaatttttttgtgtggcttataaatcagttctctatcatttttaaagggggaattttaaaacatacgcgttaatacatgtgaaagcttttttaaaaattgtaaatctccacaatttttaaaaattgtaaaaaaagcaaggactttttttatttttattaatcattaagttatattacatttcaacatactgctttaaaactcaataaataagttttaaattctcttttaaactactagtttcttaagtaattgttcatttgatgttgtctaccagttgagcaactggtacattaaccagagctgtagattgagctcttttccaaatatttagattttgggttcatagagaaataccttaagagaattgtcaaatgaggaaactgacattcagaaaggagaaataagtaaggtatctaagatcacaagggtagtaattgacttaccaaataatatagtttcaaatccctgacattaagtcaactaaagattggtcttttcactgatgtagatctagtcattttagtcagaaatactcttctttctcctattttctctctaaaacctctgccttcaacctttgttagtctccccatctctttttgtattgcttctatctgtgtgagggtttggataacaagaagatagtcttctttcctttatatttcctttatttttcttcagtgactactcaaaaatcttacccagaatggacactaaatgaatgaatttctaattgttttgcagctttctcttctgttaggatcaagtgaccagttcgtctctaccaaacccaggatgtgtttttgatttatgtgatttgtggttttgagttataagtggttccataaggccaactagcagctagaaaacagtaagtttgggactgtaaacagttacagggaagtggaagtttttggttgttttattgttgttaattctttgttttgttgcccttggtagacaaaacttaagtgatgatagagcttacagttgctaatttacccaattccatgctttgctttttgaaagcaattgctgtgtttcccttcaggggatgagctttatttactccttctactccaaagctgagctataggaattcaagtggggtctggaaataccattgaaaaaaagagtttttttgaccaccttggcaatggccagttgtttctttccatggccagcctctttgttgtttgttgagaatactgtctaagaaaatcccctcaaaattagaagtctctgaaaactatacagatctcaagggcctaaaagggaatgttatcattttaattattgtgctactttcaaaattatactgtttgtaatcatgggtattgaaaaagcccagacatttgagtttaattatgtgctttgtaatcctaagatacaatccttttttctcatgcttttatataccgtgtttctctcttttctccaacacttaataaggccaacccaagggtattaattccgggaatgagtaaaaatggtgttattctttctcaaagcctagtcaggtcagtccacaagcattcagccctgctcacagtatgtatttgaagaatgtatctttgtttagaaaagaaaaggaaggtttgggaagagtgtggattaatattatatgctgcttccctttgggcctgttttttccccccagtcctttcttaccctagcaaatacagttaggagtcctggattgcacattgtaagaacaaataggaatctgcaggccttcctggaaggtctgggtcatagcagcttctttgcttcttcttcttatcttctgcgtggcactagctagtatgccccagataacacagggaaggaatttgactccttgacatcttacatgcagccaaacacttcagaatgtatagaactttctgaatccaggtagcatctcactctgaatgtcagatggatttttaaaaaatttattccccaaataattgtttatgaggaaattttttgtctctctaaggtgcagccacgtagagtcacttattctctgaagggtcccaccctataagtgatataaatcctgatatttcaaggaatttagaaaatatgtttgttttattcctcctccctccagtgtgatacagaatcttaataaggagcctatgttgccttttgaatcattaactctgaagaaagttcaggaatgttagacttgggagattaataactgtaactgcaaagagaagtcttgtctgttaaagaatttgtgtgcactattgcatcactcagtatgtatgtgaggctttctatttttaacatttttaatgacaagctgcctccttggttctgtatgcccttcacctttgtcagaatgagattgatagtgaaagtttctctgctgttctcataaaagttgaattaagggtcttgatttcggtttactgtactgcagcattatctctcattcatctagtggtctcttctctgtttctgtttcctgctctgcctgtattctagcatgcagggcagttggcagggactggccatgcaaaataatagctgtttccagaataagtcattgagtcatctgaaagtacaacattatagtgacatacctgacttctctataatgcagaaaagggagtcataataacttaaagcattgcacattgccagagctatttgaaatgacggaacatgaatattttgacatctagtagtagcctagtgcctctttgccagaagatgctaatgaaacaaacatggaaatcactgcgggattaccaagactgttttgactttctttcaggataatcccactgggtttttaacttgcaaatatctgaatgcccatcacatggaggaggaagctgatttgtttgcaatagaacttgaaaaaatggtgaaaactaaagatactttctaccttggatttcggatttgctttctgataattagagatatctcaaaaataaaatggactttctggaatggaaaagataagaatgttttattgtcctcgaggcattagaattgtaaccgtatttggcgagaatgttgaagagtagcaccatgcatcctagggaatttttaaaacaattaaaagagaataattataagtcaaagttatcaggaaggaaggacagatgtaatctcatttcgctgcatgatagtaaatgaaggtacatataatatttccaagagagaaaaatttactcaaagtccaagaaattcagagtaaattcaaatggataagaaggtaaaaatgtagtctaaggattataactacttctgcccatgcaaaaagcagttatgtttataatcccagattaaattgcccagaagtatcatcagatcccctatctggttctctttagagcatgtttcaccaactgtaatcaaagatttgtttttatgactgattgatgtctgttttctcccagtacattgtaaattccatgaagacagcaactatgtctgttctctgtttgaatcccaagctctagtacagtccctggagcataatgcggactaacttaacatttggtgagtgaattaatgaatgaatacattgtgacaattataatgtgacaataaattattgagaggtcaagtctcaaaagggaggtctaagctaattaattttctgaatgtgtatgcagtactagcttatgtacaaaaatctttcttcagatgtgtatgagtcagcagcaactggaacttggaggtggtctttagaccccaatgtcggtatctgttcaagtattctattcgtaccttatcagctgtcttccttttcctgtggtggaaggactgccagtttcatctaagtggtttgcctcagagttcaggagaatagctcattgggagttctggtcagatattttcaaactcaaatgagtaagctctctgaaaaacctatacataatgaaaaatagtttaagattacagtggtgttttgatgtgatctggaacagttcacccactcctacttggcaataaaaataaattatgcaatgggacagccaactgttacagcttggaaaactgttaaaaactcaaaataaatacgtaggttaatgtcatgaagtacttgaccggacaagcatatttttccaattctaagggtagaaagtgtctttgtaaacattcctacatgtcagaaaactaaataaaaatgacctctagcttcgaggcacttattggaaacctattttacattgaatacacaagccaagataatacagactgtttgataagaaacattagagaaatctgtaacatgaggctttttattataggtttattacatcaatctctccagtgggtaatggaacttgtaaatatactcttatgtaggagtctccttgtgggctttttattcatgctgaagtaagcacagcaaacttatttgctgtcagggtacattgaatttaagattagtatttattttggttctaaggaggttttgcgtttgtgaattgaaagttggatcagctgcatgaaaacaagatgggactacagggagcacaggaagtaaattagttttttctaaatatgcattctgtaaacctacgtatttagctagcatggggtgcgtatgcgcagtttctcagatgggtgagtcatgcatcggatgtgtatgtttatggctctgtggtttgggtagagatagatattcaaaatggcatattgcagttactgttttctaatgcaaatcgttctagagaaaaaatatatatgtttataagaaagatttcttaacctctttttgaccagtgactttcttaatttcagtgggggcatatgaaataaaaccctcaaaatcatcagccacactgtaccttccatatcattgacagataacactgacaaattattccggcttgttctgacacctgaatagaatgtatcaggtggtaactgaagccatgaggatgagttgcccatacagaggaaaggattataatagtaaatagctatgttttatgaatgacatactagatactgtgcgaagtgaactagatgtgttatttcatttaatgctgtgcttatgagacagccaggtcggagggggtacctggcaaaactccagccagcctgtgccctggggtggacccacaggaagttcgcaccttttgcagcggggaggagcctggctgctcctcttcctgtgtggaacctgggattcggcagggtgggaagtgctctgtcagggactctggcccagcaagagtccctgttttccttttttcttcctttcacccaataaaaccctgtcttactcacacttcaaaccgtctgtgagcctaaattttcatggccatgggacagacaaggaccccatcattagctgagctaaggaaaagtcctgcaatacttacatcacatgactatgaaggcaggtaccatggacactctcatttgtcaaagacggaaaagtaaagcacacagaggtaatacgatttactgaaattcacacaaataaatttaaagtctgttccatctatgttgtgttgttaccttaggatctcacttcatatttgtgaagaatcatccttcccatttccttaaatacccaaaccatgagcatttgtaccatcctttattccttttggacatttgcagcagaatgtctattttgtttaatattagctcataatctgggaagtgagtagtagtattcacattttatctgaagtaagtgagacttagagaggtggagtgacttgcccaggcctgatttactgggtcttagtttcaagcctttttttataatgaagctcactctatctccaatagagcatgttcaaggttctaggtccagaaagggataagctgcaaatcatgaatccataagaataaatacctacttgcatttttttatgtggacatgcaaataacacacccacacacacaaacagacacacacacacacacacacacacacacacacacacacacacacagaactaacctaatatttcaggtctcatgaattgtatttggtttaaaaatacagtgagatcagaaagaatgctctgttcaaaaaaatcacatactttgtctcattagagacagaattgatactctttattgaagagtaaaattcagtaagaaccttcttaaaaataggagcaggccaggtggtggctcagacctgtaatcccagcaatcttaggaggccaaggcgagcagatcacttgaggtcagagttggagaccagcctggccaacatggtaaaaccccgtctctactaaaaatacaaaaattagccaggtgtaatggtacatgtctgtattcccagctactcgggaggctgaggcaggagaatcacttgaacccaggaggtggaggttgcggtgagccgagatcacatcactgcacttcaccctgggtgacagaggagactccatctcaaaaaaaaaaaaaaaaaaaaaagaagaagaagaagaagaaaaagaaggaagagagggcaaatgtgtattatcttataggtattaccctagtctgcagtgaggtttttgttctcttatgtcctataaagatcagtgaattctaacgacttttacactaatgttcaagttggtccttaattttattatttcccttttcacttatttgacttggctttctacataccagatggtcacctgagcccagagccacatcttttcatttgttatgctttacaatttgtcataatatctggtatatttgatatggacaaatatttgtttgattgttttcttttgatgtggtgatgtttgaactcatcctaaatgtacacaatagttttgagagacattttaaacccaataacatgtaaatttcttaaaacattgctcctgttcagatacatcgaactggaaacctggtcagggattgtgtgaacagcttcattttctcactataccttgtacatgaaatcctatttctgtttgtcttttattggcttttaaaatagcatgacgatctgatgcacagtcactgggctttggcaaatctctatttcctcccagccacagaaatttacatttcttcccaagctactctgactgtgaataatctatgtgaggagtgacctcagttcatttgaaagcatccaacatcctgaaaactgtaaagccacagcacgcactgatttctcaaggtctaagagatggtttataaatgattaaaaaaaaaactctaatagtatactcaaaacattttttaaaaaaagaaatagagttatgagtctgcaaggacttatttaagaaagacgtcctaatattgggggaggtggattcactggcactgttatatcaaccaagtatttcatgtgtgaggagataaagcagcaaactacgcaaaataaacagcgtgtgttcaccttagatatctaggacgcttcactttgaataaattttctctgcttttttgaatccagagcaatattgtctgttagacaagttctgggttttgtctgcttcaggcctgtcttaaccctgccattaattggcatatgtccaggcaattaaaactgtggtatggagcaaattaaaaaagagaatttaaagcaccagagtcatttgaaattccaaggtcaaatggaaataacattgaattatcttcttttggggattatacctgcctctatttgtctccaccagaggtgataatctagactttggttacctactctttgcatcctcaaaacgggaacacacaggaatgcttttttccgaaggccagaatgacagatataagattgaagttaaacacaactgatgcccagcacgtcagagcaggacaaagaatcagaggcaatttaatcccacctttatgcttttgaaagacaaaaggaactcaagcccagaatggcaaaatgatttactaaaggtcatcacaactaggcacccctctaattctggtaataattaaaatcaacaatatttattgaacactgacctttgccaagcactgtttcaagctcttcccatgattttttggtattatagttaaggagcggaggtaaagggacagtgaaataagtatcctctatatcctactactaccaaacagtttttcttcagctgagccaatagctaccatcttccaactaattcttagccagactaagatgacaaaggaaatacactaagcatgatttagctttttcttatgtctccagttgttgttttgaaagtgtattcatggcagggaaatatcccaaagccaggcagccccaaggaggagtgcctctagcatgagtattccagaaagtcatcaacctctgaatacttaagttgaccctgtgatttatgtatctaggactgaaataaaacatttctgactttctatacaagattttgcaatgtttatattagtcaagatcagctttttccaaaacatgctcgatggatcactcccttctcaggatgctgtataagaaagaagcaaaaaagctgtgatcaaataatttttgtttaaaaaaaaaaaatcctggccaggcgtggtggctcgtgcctgtaatcccagcactttggaaggccgaggtgggcggatcacctgagatcgggaattcaagaccagcctgaccaacatggagaaaccctgtctctactgaaagtacaaaattaaccaggcgtagtggcgggtgcttgtaatcccagctgctcaggaggctgaggcaggagaatcgcttcaacccaggaggcagaggttgcggtgaaccgagacgccattgcactgcagcctgggcaacaagagcaaaattccatctcaaaaaaaaaaaaaaaaaaaaaaaatcctgcatcatcctgatgatgttcattatcatatagaaattttaagaatacccgtaataaatgttttttaagtcagcatttcccaaattcagacaaacacagaacccaaccccctgccaccttttgttaaaaaattcatgttaaccttcctgcagagcagatatcaagaaagatgtgtgagaggaaatttcattcaaaaaacacttatcaagtgctgatattatagctgatgctgggttatagagatcaaagacccagttccagaattcatagagctcacaagctacagaaagagataagcttgtaaatcacagttataatacagtttagtaattagtgtcatgcacaaaaataggggatgtggagctagaaattaagatatttcccatcaccttgctgttgaagagtagtactgactgctatattatattatccctaaattcagaggcttaatttactagaaatttagatctcactcatataagattcaatggaggagagtggcagcaacaactatggttcatacagtcattcagggatgcagattaatcttcagtgtgtgactttccagatgtctttggacatcaacatccagctgctaaacaggaaaagagaaaagttaaaaggaacactgtgcaagatgcttttatgatctaggcctgagaggatacatttctttcacctgtggtccaatggttcattcatataactacaactaactgcgagagaggctaggaaatgtgggctacttctgggtcctgcaaggatggggaaagggtttggtaagcagctaactagtctcaacctcaatgggcaatatgaacttaggcaacagaaggtatagggaccttccaggcagaagtaatcaactatctgttgacataaaggaagggcaatcatggcactattgacaccctacgaaaagtatgatatggcaagagtagagaccacctgcggaagagtgtaggagacaggatggctgggaacagtggctcatgcctgtaatcccagcgctttgggaggctgaggtgggtggatcacttgagatcaggagttcgagaccagcctggccaacatggtgaagccccatcttcacatttgtattttagtatacaaaaattagctgggtgtgatggtgtgtgcctgtaatcccagctgctcaggaggctgaggcaggagaatcgcttgaacccaagaggcagaagttgcagtgagccgagatcacgccactgcactccatcctgggcaacagagtgagactctgtctcagaagaaaaaaaaaagaaaagggaaataaagacacaagatcatgtgagctttttgtactatgttaaggagcttgtattttactttttcaatgatggcgatttattaaagaatctaaaaatcattgaactagaatcaaaaaagtgagttaagagattaatggtatataataggaatagataatgagctaacaagtaattgatggcatagaatagggatggattcaagaagtactgtaggtaaaatatacatgacttggggacccagtgaatgtaaaaagtgaggaagagagaaggtacagtcaagaatatttcctgggcatgtctggctagttagatattgttctgatttattaaaaacaagagacattgggaaaggaatttggtaagtgggaggaactcataagggtctgaagtataggaaggaggttgaaacttgagggtggtcagcatgtaggtttccttgaagcatgtggaatgaatgcagtctaaaggagaaagaaaatcgaggcatgcagagagcttagaacaaaaccacacaccagaatttaaagggctcaaagaagaatttgtccatgaagaatctaaaatgataaagagaaccaagggaagaaagaattttttaaaacaaggtaggaaacaacccacatgtccatcagctggtgaatgcatgcatacaatgtgatatgtctgtaaaacaatactattcagcaataatagggaataaagtactgatgcatacatattacaacaaagatgaaccttgaaaacatactaagtaaaagagtcctgtccaaaaagaccacatattgtctgattctatttgtatgaaatgttcagaatatgcaaatctattgagatagaaagactagttgttttctggggcattgagaggtaggtgggggtggttgggtagtggggaaaagggaacaaatgctaatgagcacaggttttttgcaggaattaggaaaatattgtaaatttgattgtgatgatggctatacaactttgtgaatgtacttaaaactattgaattatagactttttaaataggtaaattgcatggtgtatgaactatatctcaaagctatcagttaagaaaaccaaaaaaggaaagtagaaccagtgaagtttggggtaatagaaatacatacgtcttctaagccagcttctggaggcaaaattcaatggcttctaaaccaatcctgtgattttcttttttggtccagaattgcatttgcatttttctgtgggaaacacttctactttatttgcagatggtcacattcttaaggcatttagatcatcacctatattttttttccttaagtaagtctagattttctgtaaattagcattgaattttatgataagtaagttggagaagttttatatagtaaatttctttcaatatcaaaattatcttgaagataatacacttagctataaacatgtaacctcccattatccagggttatatagtcaatatctagactttcagccatgcctgggacccaaagtgagcccagccacatcttatcagaggaaagcatttgtcattttacatttaaattcacatctgaggtattctccaggttttcttggaactgcagaaatatcaccgttatacattatttagtaaccagcttgctttgcaaaggtcaggttcgtgttattcaaagcgtgatgcttagtatgcgatgacacaaacagatttcttgctttaaagtaatagaatgcgatgagtgaaaccaactttctttggaagaaagatgtctcctttccacgacatttgatttgtaagtgggtttggcttcattaatatttaattgtctttttaatctgtatgtcagttcttattgcagactgcttctggggaggttttcctctgaaataccaataacaaccattcttcactctaacatcaaaacaagggctctctccgggacacctagttgtatttcatctctagggatataattattttgtcgttatccacagttcctcaagggactgatgatgtaggacaccctccttaaagacctttatatgtcaaaagaagaacctgatttgttaatgttgcaaatactaattcagatggtcttgcatcattcttgtgagttgccttttcttaaccaggctatacagaatttgtacttttttattagcacgttagtggagtttgaagctgttagttgatcttttcaggatattttcatgagctttactagtttaggaaacagtgctttttctgtgggatgcattttgaacatttaaattcattttcaaacacaaatcagaatagggaatgaaatgataaacaaccctttataaattttcaacttgatcacctatagcaataaagctacaaaaagaactcagaattagtatctctggagattgacatagagaaattgagattgacatctctgcagcaagttgagcctctttgtgaactggtcatttttatttcctggtcacttgggagaaacctgggtgaaaaaattggacatctgtttttgtttgtgatagcaaattccctatgggatgagcctcaccctaattaggggaccactcttggccctctcaggagagaatataagggtagataaggagacttaggttaccctctcaatcaatcacagtggggcaaaatggaataatttcacacattttcctttagctggatacttgatatatgagaaaaaatatggggtatccacatcctaaaattttaacacttccctgtgcttaccaacgtggcgtgtggtatcagtggaacggatgctttcatctgccttttttcgaaggttagttgtggcattgccttgattagtcaaagattttatctcttggtaaaggatattatcgatttagatagacacattttgaagttagaatacagcttgtaattatgaatgggcgaagatatctgacccttaaaaaattcagactccctaagttgtctacgcagcatgcaggttcacctgcactggtatcacacccaagctagcaatagaacaaattcatttgactttattttatgacttttcctagaagagacataacaatgaatcatcttgttatccaagccaataaatatgcttccttttagatttcttaattcagtttgccagctattttgggtattagaataacgggtttcatgtccttggggggtttaatttgcttccagagtcttgtttttgtagaatagcttaagtcttcatagtcatggtttatgattcttcaaataggtcattataagtaagatctgattttgaactggtattaagaaaatagacattgaaaaaaactgtttcagggaaaaaacattttcctttctagatcatagtgcaataagtggctcttttatgatcactgttgatttttccaaagtaagacattactgatttattttatctatgttagctttttcttccaaaacaattccttgatgtaattttatcataaggaataaaatgttctttttttatttttattttttattatactttaagttctagggtacatgtgcacaacgtgcaggttttttacatatgtatacatgtgccatgttggtgtgctgcacccattaattcctcctttacattaggtatatctcctaatgctatccctcccccctccccccaccccacaacaggccccagtgtgtgatgttccctttcctgtgtccatgtgttattgttcaattcccacctatgagtgcgaacacacggtgtttggttttttgtctttgtgatagtgtgctgagaatgatggtttccagcttcatccatgtccctacaaaggacatgaactcatcctttttcatggctgcgtagtattccatggtgtatatgtgccacattttcttaatccactctatcattgatggacatttgggttggttccaagtctttgctattgtgaatcatgtctcaataaacatatgtgtgcatgtgtctttatagcagcatggtttataatccttggggtatatacctagtaatgggatggctgggtcaaatggtatttctagttctagatccctgaggaatcgccacactaacttccacaatggttgaactagtttacagtcccactaacagtgtaaaagtgttcctatttctccacatcctctccagcacctgctgtttcctgactttttaatgattgccattctaactggtgtgagatggtatctcattgtggttttgatttgcatttctctgatggccagtgataatgagcattttttcatgtgtcttttggctgcataaatgtcttcttttgagaactgtctgttcatatcctttgcccacttgttaatggggttgtttgactttttcttgcaaatttgtttgagttccttgtagattctggatattagccctttgtcagatgagtagattacaaaaattttctcccattctgtaggttccctattcactgtgatggtagtttcttttgctgtgcagaagctctttagtttaattagatcccatttgtcaattttggcttttgttgccattgcttttggtgttttagacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctggccatttttcctagcaccatttattaaacagggaatcctttgcccatttcttgtttttatcaggtttgtcaaagatcagatagttatagatatgtggcattatttctgagggctctgttctgttccattggtctatatgtctgttttggtaccagtaccatgctgttttggttactgtagccttgtagtatagtttgaagtcaggtaacatgatgcctccagctttgttcttttgactcaggattgtcttggcgatgcgggctcttttttggttccatatgaactttaaagtagttttttccaattctgtgaagaaagtcattggtagcttgatggggatggcatggaatctataaattaccttgggcagtatgaccattttcacaatattgattcttcctaccctggagcatggaatgttcttccatttgtttgtgtcctcttttatttccttgagcagtggtttgtagttctcctggaagaggtccttcacatcctttgtaagttggattcctagctattttattctctttgaagcaattgtgaatgggagttcactcatgatttggctctctgtttgtctgttattggtatataagaatgcttgtgatttttgcacattgattttgtatcctgagactttactgaagttgcttatcaacttaaggagattttgggctgagacaatggggttttctagatatacaatcaggtcatctgcaaacagggacaatttgacttcctcttttcctaattgaataccctttatttccttctcctgcctgattgccttggccagaacttccaacactatgttgaataggagtggtgagagagggcatccctgtcttgtgccagttttcaaagggaatgcttccagtttttgcccattcagtatgatattggctgtgggtttgtcatagatagttcttattattttgagatacatcccatcaatacctaatttattgagagtttttagcatgaagggctgttgaattttgtcacaggccttttctgcatctgttgagataaacgtggtttttgtcgttggttctgtttatatgctggattacgtttattgatttgcatatgttgaaccagccttgcatcatagggatgaagcccacttgatcatggtggataagctttttgatgtgctgctggattcggtttgccagtattttattgaggatttttgcatcgatgttcatcaggtatattggtctaaaattctctttttttgttgtgtctctgccaggctttggtatcaggatgatgctggcctcataaaacgagttagggaggattccctctttttctattgattggaatagtttcagaaggaatggtaccagctcctccttgtacctctggtagaattcggctgtgaatccatctggtcctggactttctttggttggtaagctattaattattgcctcaatttcagagcctgttattggtctattcagagattcaacttcttcctggtttagtcttgggagggtgtatgtgtcgaggaatttatccatttcttctagattttctagtgcatttgcatagaggtgtttatagtattctctgatggtagtttgtatttctgtgggatcagtggtgatatcccctttgtcattttttattgcatctatttgattcttctctcttttcttctttattagtcttgctagcagtctatcaattttgttgatcttttcaaaaaaccacctcctggattcattgatttttttgaacggttttttgtgtctctatctccttcagttctgctctgatcttagttatttcttgccttctgctaggttttgaatgtgtttgctcttgcttctccagttcttttaattgtgatgttagggtgtcaattttggatctttcctgctttctcttgtgggcatttagtgctataaatttccctctacacactcctttaaatgtgtcccagagattctggtatgttgtgtctttgttctccttggtttccaagaacatctttatttctgccttcatttcgttatgtacccagtagtcattcaggagcaggttgttcagtttccatgtagttgagcagttttgagtgagtttctcaatcctgagttctagtttgattgcactgtggtctgacagacaatttgttataatttctgttcttttacatttgctgaggagtgctttacttccacctatgtggtcaattttggaataagtgtgatgtggtgctgagaagaatgtatattctgttgatttgcggggagagttctgtagatgtctattaggtctgcttggtgcagagctgagttcaattcctggatatccttgttaactttctgtctcattgatctgtctaatgttgacagtggggtgttgaaatctcccattattattgtgtgggagtctaagtccctttgtaggtctctaaggacttgctttatgaatctgggtgctcctgtattgggtacatatatatttaggatagttagctcttcttgttgaattgatccctttaccattatgtaatggccttctttgtctcttttgatctttgttggtttaaagtctgttttatcagagactaggattgcaacccctgccttttttttgttttccatttgcttggtagatcttcctccatccctttactttgagcctatgtgtgtctctgcacgtgggatgggtttcctaaatatagcacactgatggatcttgactctttatccaatttgccagtctgtgtcttttaattggagcatttagcccatgtacatctaaggttaatattgttatgtgcgaatttgatcctgtcattatgatgttagctggttagtttgctcagtagttgatgcagtttcttcctagcctcgatggtctttacaatttggcatgtttttgcagtggctggtaccggttgttcctttccatgtttagtgcttccttcaggagctcttttaggacaggcctggtggtgacaaaatctctcagcatttgcttgtctgtaaaggattttatttctccttcacttatgaagcttagtttggctggatatgaaattctggtttgaaaattcttttctttaagaatgttgaatattggccccccactctcttctggcttgtagtttctgcggagagatcagctgttagtctgatgggcttccctttgtgggtaacccgacctttctctctgtctgcccttaacattttttccttcatttcaactttggtgaatctgacaattatgtgtcttggagttgctcttctcgaggagtatctttgtggcgttctctgtatttcctgaatttgaatgttggcctgccttgctagattggggaagttctggataatatcctgcagagtgttttccaacttggttccattctccccgtcactttcaggtacaccaaacagacgtagatttggtcttttcacatagtcccatttttcttggaggctttgttcatttcattttattcttttttctctaaacttctcttctcacttcatttcactcatttgatcttccatcactgataccctttcttccagttgatcgaatcggctactgaagcttgtgcgttcgtcacatagttctcgtgccatggttttcagctccatcaggtcctttaaggacttcccttcattggttattctagttagccattcatgtaatcttttttcaaggtttttaacttctttgccatggtttcaaacttcctcctttagcttgaagaagtttgatcatctgaagccttcttctctcaactcatcaaagtcattttccatctgctttgttctgttgctggtgaggagctgcgttcctttggaggaggagaggcgcgctgatttttagaattttcagtttttctgctctgttttttccccatctttgtggggaaaggtctacctttggtctttgatgatggtgacatacgacatacagatggggttttggtgtggatgtcctttctgtttgttagttttcctcctaacagcaaggaccctcagctgcaggtctgttggagtttgccggaggtccactccagaccctgtttgcctgggtatcagcagcggaggctgcaaaacagcaaatattgctgaacagcaaatattgctgaacagcaaatgttgctgcctgatccttcctttggaagttttgtctcagaggagcaccggccatgtgaggtgtcagtctgcccctactggggggtgcctcccagttaggctactcaggggtcagggacccacttgaggaggcagtctgtctgttctcagatctcaagctgcgtgctgggagaaccaccactgtcttccaagctgtcagacagggacatttaagtctgaagaggtttctgctgccttttgtttggctatgccctgcccccagtggtggagtctacagaggcaggtaggcctccttgagctgtggtgggctccacccagttcgagcttccaggccaatttgtttacctactcaagcctcagcaatggtgggcgcccctcccccagcctcgctgctgccttgcagtttgatctcagactgccgtgctagcaataagggaggctccatggatgtaggaccctccgagccatgcgcgggatataatctcctggtttgctgttttctaagaccgtcagaaaagtgcagtattagggtgggagtgacccgattttccaggtgccgtctgtcacccctttccttggctaggaaagggaattccctgaccccttgcacttcccgggtgaggcaatgcgtcgccctgcttcggctcacacttggtgcgctgcacgtactgtctgacaatccccagtgagatgtacctggtacctcagttggaaatgcagaaatcattcgtcttctgtgttgctcacactgggagctgtagactggagctgttcctattcggccatctataaaatgttttaaatatgcaactttccattgctcaaggcagacaggacccttaattggttttttaacattgaaattcattaactagtttagtaatagttataagaaattttctatgaaccatccagctactggtttaaggccctggggattaagaatctgtccttgcccagtaggagcttacattcgagtgggctagagaatcacgtaaatagataattgcattgcaatttgataactacaataatagatattcaaagtacaatgacagtactacttaccggtttccaaaatatttttgtacttgtctaatggcaagtatgttattttgcaaagatttgtttttctctccggtcaatacaatatacagggcagtggtagaattcttagatggaaaatacgcaatctatggtcaaactatttgggtttaaatgcctggccttaataactggaaaacaatgagaaatcatttcatctccccaagctttatcccagaagcagtaaaataggtataaaagggagtgcttttgggtggctatgtacagtcgatttatgctatcaccttacatctgggtctaagccagcttctcctggcccaactagatcgctcttgcagagactgattgcaaaatataaccctgaattcctcctatacagaaatgcacactcctttgcaatgtggctttcctgctcttcccatcaataggtggactcttacttccctatccccttagtctgggctgggcttgtgacctgctttgatcagtagaatgtggcagaagtgatacttctgaggctcagttttttgttttttgttttgtttcgaggtggtgtctcattctgtcgcccaggctggagtgcagtggcgtgatctcggctcactgcaagctgcacctcacgggttcacgccattctcctgcctcagcctcccaagtagctgggactacaggtgcccaccaccacgcccggctaattttttttgcatttttagtagagacagggtttcaccatgttagccaggatggtcttgatttcccgacctcgtgatccgcctgcctcagcctcccaaagtgctgggattacaggtgcgagtcgctgcgcccggccggagggtcagttttaagaggccttgcagcttccacttttgtcatcttggaatgttgctttgagacctccatggcaggaggccagtcttgcctaccagaggatgagagcccatgtggaagaggacagaggcaacccagcagactgccagcaccaactgccagacatttcagtgaggccatctcagaccttccagcccagctgatgctccagctgaatgtagccacgtaagtgagcccagatgaaagaaccatgagaaataataaatcattattgttttaaccgctcagttttggagtagtttgtgaaagcaatagataattgaagtacttaccgcatacaatccatatgcctcataataaaagtagcctttttaaggtagcctttttaaacacaaactgatttcataaatctgaattcctcatcacgtttttttttatattttttaattgacacataattgcatatatttatggggttcagtgtgatatttctattgatatatataatgtacaatgatcaaatcagggtaattagcatctccatcagctcaaacatttactgtttctttgtgttgggaaaattttaagttctctcttgtagctatttgaaaatatgcaagaaattgttaactgtgtccaggcatgctggctcatgcctataatcccagcactttgggaggctgaggcaggtggatcacttgaggtcaggagttcgagaccagcctagccaacatggtgaaatctcgtctctattaaataatacaagaattagctgggtgtggtggtgcatgcctgtattcccagctactggggaggtggaggcaggacagtcacctgaacccgggaggcggaggttgctttgagctgagatcaggccacagcactccagtctgggtgacaggatgagacttcgtctcaaaaaacaaacaaacaaaaaaacaaaaaaaaaaaaaaccattaactgtgctatagagcactagagcttattcgtcttatgtagctgtgaatttggatctgttaaccaacctctccctatccccacctgcccctatagttcccagcctctagtagcctctattctactctctactttcatatgattaattgctttagtttccacatataagtgagaacacgtggtatttatctttcaaatattttatggataagacctcaaaagcacaggcaacaaaagcaaaaacagacaaatggaattatgtgaagtaaaaggcttctgtacagcaaagaaaacaatcagcagtggagagacagtcttaccacatatatatgtatttttttttttcagttagcttcctcaggttgaaaaacacccatattttttaaaagttgtcttccctacatgatctggcccttcctgcctctcctcaccttatctccttccatctcctctcttatctctattctagccacactcccagaacatgccaagccttttcaggctccgggacttttgttctctctcttttctctttctggaattattttccccagactttaacatgcctgactctgtctcacatataagttctcacctaaatgccactttctcagcaaggtctttgactttctaaaatagttccaccctctcagccagccaaaacttacccaatttccctattttgatagcgcttatcactatctacaattatcttgtttatttatgtttccatttattgtctgttttttccaccttcccaagaatgaaagctccacgaagaccaggaaaagactgatgggccactgtgtgtccagctcttagaaaaaggtctggcacatagtacatgcttagtaagtacacattgaatgggaggaaatagctgttctgaataatgactcaaaataacagagggaaagcatctaacaggggacccaggtcttgagagcagcaccagcaactcaaatacgaacacacgctgctcttcctactgttaccatgtctgaaatgctttctttgtgctggacactgctaagcctaatatgtctgttatctcatttgtttctcatatcaacctcaaagttctaggttctagatttattatcctccttctaccaacaagaaaactgagtcttagaaaagttaaacaactcagataaaatacccatgatttaaattcatgaagtttaactctaagttccattttaaaataatataatgatactctgatttcttttcagattgtataaatctttcaccttttaaaataatacactggactattactgcctgaacaaattactgtttatattattattccacttttatccctccctcctacatgatgataatattttacttatgtttagatcctgaacaccaaacatccagtgaatacagctgaagatgtaaccgactgagtggttttttttttgtggtggggggcacagagtcttgctctgtcacccaggttagagtgcagtggcatgcctttgggtcactgcgacctccgcctcctgggttcaagcaattatcctgcctcagcctcccgagtagctggaattacaggtgtgcaccaccaggcctgactaatttttgtatttttaatagagacagggtttctgtatgttggccagactggcgtcaaactcctgacctcaagtgatccggctgcctcggcctcccagattgctgggattacaggcgtgagccactgtgcctggccaagactgattattaatgaactaattctacctatacaatttggaggtatgggagacagcatcatggagaaacctcatttgaagtgcaccttgatgaatggatgagcaagagttggccaggtagaaaatagcaattctaggggaaagaaacgacatgggaattttttcagtgttgtttttgaaatttacagaatttggaagaaaatgtttcagtaaggaaaacttcctgatggtctttatactgttttcaagttctttggaaacttcagaaacatataaaaagacacagtttttgaaaaagtggaggggaaattattagagagcatgtatcatccagcgaagactaactggatgacattcttaagtagtacttggtgtttgtccttaattgaaagatgtttgtgtggactaggaacatctaaatagacttttcaatctgtaaatgaaatcttcagagcctgcagggttctggttttttaagtaagtatctgtccgaggaatactctgcacatcaaataacttaaatccagtaacatgtgataactgttcagggattagcacactggattctattctctctctctatagatagatagatagatcactcttttagatagatagatagatagatagatagatagatagatagatagatgtgtatatatatagatatatctctctctatatatgtatatatatatctatatagagagatctatatacctatatatctatacatctatgtatatagatatagatcctgaacaccagacatccagtgaatacagctgaagatgtaacccattgagattttttttttttgtggtggggggcacagagtcttgctctgtcacccaggttagagtgcagtgagatctatgtatctatacatagatatagagagagatctatgtatctatacatagatatagagatctatgtatctatccatctatccatctatatctatctatctatctatctatctatctatctatctatctgtagagagaaagagcacacacttacgactggtttatcttaacaggagctttaggatgtctggaaagtaatacagtcttcataaagagaggttgaacattatcaaacagcatggttcattgtgagtttttgttttaagcattttaaacagttgacttcaaattcccagcagatggtggtggcagcaggcaggcactctagtcaatgagaagtcaaagtgaacttttaaaatagttgattcttaaacttggaagaaaaaggagtgaatgttagaaaaaaaaaataacaggtttcctgcaatgcatcttatcatgcacaagtcaaaaaatgagaaacggtacaatttgcaataaacacaagagtgtgtattttacactacggaaatgtaaagcatttaatcagtctgttagcagaaaacttgaatattagctgtcaccaaatccctttagtgtataataacctcagaattgcggaccaatgtgttttcctcccagcaaagcttaccagaagtgttttcttaaagactggcattcctattaataatttaaggtaggaaaaaaagggggtacattttcttcttagtagtccaatccacaatataatgatgatgatgatcttactatacttaataccactcttattgtagtgatttttcttttaatgctatttttggataagaggtaattatttttaattgttaaactactttctatagattttttgagcacttcaaagtctagaattccaggattctgtgaagaaattctttttcagccctgtcgtaaaaaaatttttttgatccttggtcatgtttatatttatcctgtccttaataatattgattataacttctcttttcagtgaatatattatacatgttcgactttatcttactaggtagctgcttaataacagccaaactcattatttatgtcacttatcttccccttttagttatctttgtgtttaggctcctactctatggcggtgaaagcaatggttgtgggagggaaggggaagttgcttgatgtaagtgaccggaaccacaagaaatattcccagtataaagtgaccctgtttgcagattacctttctgctttatttcctatgctgtatcttccattttctaggattcctcaggccatctttgcatggttggtttatcagaatgaagtaaaatagctccggatagaatttggcccctccaaatgccaggcccatgagatagcaaggaaacttcatcaaatgccaatgacaggaaaagagctgtatgtcttacgaagcaggcccacattaagtctgtaggactgcatggcttttctcttgccctagaaagtcaacagatgaggtaactccccacccaactggttccttttctttacttggatgatcaaggggtaaaagtacagctgtcattttagctacaaaggtacctttttacattaaactgaaaaagtgcacatgtgttctgttgaaatgccccctatatatctgttttgaatttcagttcactgaatgttctgaaaattaaataaacacaaaacaggacatgctaatatcttcaatgaggtgcttaattccccatcttaatcagccgttttccatcctgtttctttttcctgcctatctgtcaaatgtttcttaattaagaattattcttaattacaaagtttatgtgtcattttattttagaggtagttaattaaatttaacactaatcattggagatattgccttttctgcacacacattgatgcttaattattggaataccttgaatctcttgactgagggggagtagggcatattgatttgtgtctggtatgtggcagctcgtactgaatagggcagagactcagcccatcaaccagacaaagaagtaggaagctcattttttcttagttgataaaggacagtgaacaaatgcactctggtcattcagcgcattatgtgatgtctctgaggggcatggaagtgtgatgattatggatgacattcgatcctaaaaagaatagccagaataaagctattctttaagagtccttggatacttgttagaatggatttgccaatttttgtatgtatgggattatactggggtcaccctgagcaggtcatctggttggatgagaagcgagatccagtggccagattagaaaaaggatgcattagctcttggttccttctacccaatctttcccctccaacattctcagaccttatctcctgggtcacttcttcagagaagtcttccacaactatatattgcatacctttccttgacatcattcattctcactataattgcaatttatgtggttggatttttattgtctgcctcacccaataaatgaagtatccttgagggtagttgtcatttctaattttgcttatcatttatttgtcatttgcttaactagtatttgacactaaatatattttggaatggattaatgaatgaattattaaatatttttagaagctataagttatttgactttttaaaaaagtattaaatgttcattacgtttgccagcactgtattattaggttctgggagtaagggatggttgggtgaaagtgaatccctgccttcagcaatttataatacaatacaaaagaaactcatccaactaaatataatataagctagactataatatgtggtgtaatagatacatgaacccatctctgtgaaaacacatagcaaatcagccaagcgaggcaaggcttcaaaaagagggagattatttgaaatctgccttgaaggtagttttggacaaataagaactggggaaagggcatgctgggaagaggtaacaagatgagcaagagtcagatgtataaatgaatatgatgttagcaaattgtcaaagattggaaaacatggtggtgctcagtcctggctcggatacagtgaggcaggctttctgtacactgttggcaggactgcaaatgggtagacacttttggcaaaacacgttagaagactcactatttcctcttctagaaatatatttcataaccggagatgtgtgcaattctttatattcaaaattgtttctcacagcatatttgacaaacttcattaacggtctacacacataattgtagtccaatgattacatgaattatgtaataactataggatgaaaaactatgcatccattaaaaattatgtttttgaagaatcatgacatggataggtgcttggattgcagtgtatataaacataatgaaaatctcaatataaagttggataccagttttatacatgtaaaaatacagaggaataaaggaaataacagtaacagtaatttactaatactaattctctttggtggtagattgacaagtacgttccattttcttctgtatgttttctgttttctagatgttctacagttgtaaatattggttgcataataagaaaaacagatttaaacttggatatgttatgaagaaaatgcaatatcatatctatggctaaaatacaaaatgtatagggaatgcttttagaaaatgagtcttgagttttaaaaattatttagactctaatgggggttgtgccttgtattaatcattctgggtaccaggaaaacctgcgagatacggcccgccacccaaggattttaaaacctggctgagaagacaatacataaatatctaatttaataacaatctcagataatagttctagtaataccatggggcaggatgctacagattgccaaaacatggcacataagctatggcctagaagtttagagtagagattagcctattgagtaattatacagaatttctaaatgttttttgtcatctccctgccacacccctggagcagcgtgtgatctcaccagcagtgcaagggcacatgggctctcaaatacctgccatagcaacaggatcaggagatgacttagagaaggtggagaggagggttaagagaccccagaacttatatggctagaggtccaaaaacaagtagatgccactcactggcctgcctgaattacgtatctttccaatggaccccaacctaaatacctagatatgtaggttgtaccttttctgtatatgatgaacttgatatatgtgcaccccttacgtatgtatacacatgtatgtatattctgtatatatttgtgtgtgtgtttgtgtgcataccccatatatattcatgtataaatatatatatatatgtagaaatattttctaataatcactcagtttctattgcaggtgattatataaactctcttaaatggatttgccattttcattatttgttgccataaatttgcttcatcctaaaatactgcttaattactagattggtcaacaacatgtatcttgctataattgaaaaatgacttacattttggaaaagaataagatgaatatttttccagataccttgggaacaaataaattcctccattttgagtgttactgtaaacataaaatactagaatgggatattttttggatattcacttaatgtttttgtgtttgatcttccaatatgaatcgttatccattcacagatatttataaatcctctactaggtgcaaagccattgataagtgttgcaagaaaataaagtacaagttaaagaacatgagtacctgttgtctacagatactgagaattctagaatatataaataacactccttgaccatgaaacatttatgatctcttggaggaatcttgtgaggaaaggtgttgattttgccctcaaggcggttctgtcaaccttttctacctgtgggctgaagagatcaaggacctcttcatggaaaaggtggctcgttcactaggctctaggttacaattgttcttaacttttttttactgaggatgtcagagacccctttagtcatgtgatgaaaataattgtttcttacctgcaaaatttacaagcccagcatcttgtatttaatttcagtaatttatggattctttctaaggtaatccacgtgcatttagtttacagacccccacttcaatgagtagttagaatttggacatgcactaggctaaaaacaaaggcaattttaggtaacaatacagaagcaaagtgtataaagtatatatagaaaatggagagtagctccatttgaatacctggaatgggttaattaaagatctagactgaaaggtaggaattggttaaataaagatctagacaaaaaggatcaaattcctaattactgaaaattgcaccctgtatcatatcatatcatgagtccatttccagtggcctgccttttagctattattagtcatcacttaatccaacaaaagtgcccaatcttcccagtttcatttcaggacaagcctttagcaacaacaaattttgcccttatccttcacggagtagattttctctgccgccagcatccaaatgtgcatttgacactctgaaactgaaggagagactgggacagaccataccaatcactgaccccatcattcagagtgattgagatctgtcttgtcactttcctgtgtggagacattttctctccttagattctctataagacaaaacaatccaccaccattatttttatagcatgcccatctcccagagtgtcacaaactctttacaacaagaaatggaatagaaagacgatgctttgcagacttgggtatagttattttcagacagaaagggaaaatgacaagaagagattgagtggaataaaagtaaagataaggctgctgacttgaaaaaacagtcatgacaagattgatagaccctgcccaaatccacatctctcacctgcacacatgtacacacacacacacacacacacacacgcaggtggatagtctcagcagcttttatcgaaagttttgttgatgatgtggtcttcctgatactagttttcaatgatagaattacatgcttattcttgaatataagtcagtttggtctctctgaacacatgtccacatgttgaagttgaaatgagttaatggatgtaaacatttagaccagtgccttacacaaatgaacacacttcgaatgtttttccattattattgatgttgataatggtgatgaagatgatgatgattaacagtagtatagtattaacttgtttatcagaaaaaaaaaattgtggaacagaacaagaacccagtaaggtaataagtctttttaattattttgacatttgagcaaaggtaaacacatataagaaatctaagacttgcattctgttccttccctaggagtgttccaatatcctttcaggtagtggttatttcttaaaacgtccttttatcaccacctgccatagaatcacttgtgttacttcttaaaaacatggattcctgggctctaccttaaacctaccaaaaaagagtctctggggacaggtcccaaagccagccttttaaagaaattccccatgatgagtcttaagcctacaaatttgagaaaggtgtttacctatcgtttaaagaatcaaccttacaggcagggtttaatctgattaggaatagtggaggggaacactggctctgaaacatctttcaccactttccctgcaattcacactattaaatatttattcctttggtttccagtgtatatataggagtctccatttaaaatttaaatacaaggggaagccattaacatccattagcacaccatgtgagttagggatttgaaagccaatcatttagcaaggcttcaaggggagagtaagatgaatgaatcccattgaggaaaaaagagctaagaaggcagggagcagaataggccagcctaactgaagcattgcagctgagaatcctggacagctaggggagtaaggaaacaatgaattctgcagaccagctgctggaaacaaaaaaaaggagaaattatacaaagtggtataaaatgcttttcaaatatgtttgtggtagaggtggaccccaatgaccagttttgtctgtttctctttaagtgtggcctacagtagagtctaatgctggacccatgcatttgaaggtctaatactgagttaaagatctcggcataaatcctggggctaataacattggaccctgagcaagtcagacaaaattgcacctagatttagctaaagagtatcagctaactttgttttaagaataaacgttttttctcttcacttataaatactagttctcctaaattatttttcaaagtacttacataagcttcaacattttttccttgtctatggtcatatttaaaatagtttaacaaaaatttgttgcccatgttgttttgttgtaatctgtatgaacatctcattgtacagattaaaatgataaaaggaatcgggagtgctcaagcaagaagatttagggggagacaaagaagagaatttacttaaaagtgtaattagccaggccagggccttgttcagggatcagtgtgataatttatacttatctgaacttgtgaaacgtaaagattacattcttgtgaaatgaaaactacatttacttagcgattagcttttttttacatggcaattagctttggtcatgtgtatacatatacattaagatcagtaatatttatctgtcatcttttccttgtgtctacattagctaccatctggtctttaacctaaaaatgtccacatcaggaatcatctttatcagggtcaagtaatgggaataaaaaggcaaggtaacttttattgcagaactgaagaggagatttgaagagaagtaactttggcatcaagaatagagaagtaatggggagtgaatacttgaggtgtcctaatccactttctattaccttcaattggtgataaaaatgttaatgatgatcttcaaattcaagaatacacgtaaatccccaaggaaaccaaagggagcagtataattctttacctgactttcttgcatctagttttatttcagtttaggagctagcactgtcccatacaatacaagagcatttggtcttgtactaagaaaagacttagaaaaattgaagggtccttccaaacaaatgtggctgttttgacaattatgcaaatagtgtgaagattaaaaacccaagtaatcttcataggtcatggtattgatttaaatgagaaaacctaactgctttttgttttttgagttgtgttgggatttttctttttcttagtgtgttttttttgttgttgttgttcttgttgaagcatgacacttatctgtttttccttgctagattaaagccttgctttccctttgttatttaaatcacatcagcaaggaattaaagagccttagagcaggtggctgtggtttgggtttacattagtggactttttgccattatgtttctattccaatttccagtttcagttagcaacattatactctgtgattttgggcaggagaaaacccaaaccacagactaaactgatttttgtttggagaaaatgcacaaccaattcccaattacccaagttgtatttcaatcccagagtgcatggaatgaaaataattgcaagtgtgaatacacacaaaaagaaatacatcctgtacagaaaactagctccctcactgttggtaggagaagaaggatatttgctctggagtggtcagggagtcctgttactgaataaggcccttaacttgagagtacctttattaagaaagcagatgagtgctgtaggggaagctagcaacatgcatgatgcatgcagcctgataatgagatgcccttctagcaatatttaacccttacattaatccaaatctacctccttataactcctgctttttggattaaaaagcaaagtaagcccagtgcttctaacagtatgagagatcacagcaaatgtttaaaggcagtgaccacgtcacccactccacccaaccctacccccgacacacaccccatctcctccaggatatagtttcccggttactgcaatcattcctcagctccaaatctctatgccctttttcctttttctcttttccttcttctcaataaacagttttattgagatataattaacatataaaattgtttgatgtttgcttttgtgcatacattatacaatgatcaccacaatcaagctaatgaacatattcatcacctctacatggttactatttgtgtgtgtgtctgtgtgtctgtgtgtgttacacccttttctcttgatggtctctgctttcacatttcactaaagctgtagtaccccaacttctaagtcctgtgctctgagcacatgcaaagtttgaccatgctatcctctgctgtggactttcttatcacttctataagccagttttagtttatactgacatctgcccactctgggttgaattcctacctgctgtgggagaaaacaaacagtgtacaaatcattgccaccaaaaagtgatggtgtccaagtggagatgctttggaggtcattaacaatatgacctgaggtttaggaatgagagccaagctaaagatttaggtttgagattccttagctcagaggtgttaatgaagccacaggtggccatgacttggtctgtgaaaagggcagactttaaatagggaacagtgatttttcttcagcctagtaatgtttgtccacacagagtttcaatcatttaaatatcaagagatctaacagaaatgtctgtgtttctgatttccgttggtgatataaaaagagtggagttacatgtctgcagtgcggcaatagcctaaagctgagcagacattgccttctataggcagggcacatgctctttggttccctgaagttcccaccacttgctgctcagcaacttcacccatttacatgccagcctgtcttctgtagacattttaatttgcaatatctgatagacaaggccaagcactgtggctcgtgcctgcaatctcagcactctgggagaccgagacaggtggatcacttgagcctggaagtttgagaccagcctgggcaacatggtaagactctatgtcttcaaaaaaaatacaaaaattatctgggcatggtggcatgcgcctgtagtcccagctacttgggaagattgcttgtcctcaagaggtggaggttgcaatgagccaagattgcactactgcactccactccgaacaagatcctgtctcaaaaaataatatctaatagacaatagtaaacatatatctatgcctttgatttcattctctcctgctgatcattcagtcaattttttgtaatcgaatgggaatttaaagtgtgcctttttgatagggttttcatcaagttattagagagatgaaagccatctaatgttagtgtaggaagaaatcttaccaattatttattcattttacaaatggagagaatgaaactcaaagaggccagggcagtgaaactcagagaggccttgttcagagttgacaataagttaatatcacagggaggatagaactcaggtcacactgttcttcctaagtcttagaatctttagctattaacataggtactgactggtatatttgctctcaattgaacagaaaagttgagtacttgtatctggaagggaatcaaaacaacaacaacaaaagataaaaaataaaaatctgtaactactttgataacttattaaaatatgaaaatacagtatacagttattgaaggaattataaacttctttattgcagttgtgtttgaacagtgccttttaaaaaataatctgcttatttctacctattgagagaaatagctattttttcagtattttcctttggaccacattgagttttttccccaaacacagtttgtcattcaaccaaatgaaaaggtcctcaggcaccaccctccacccaagaaccaaaggaatcatttgatgtgaaaggtacgagtcatgccaggctcggcaccagccaattaccgattacacaagctgtattttatcactccaaatacatggaattaaaataattgcaaatatgtgtatacacacaaacagaagtgtatcatatgcacacagctccttgatggtggtagaaggacagggatatttactctggaatgagatgtgattcctgttattggacaaggcccgtaacttgagcccacacttattaacacagcatatcagtgcagacagcttgataatgaggaaacatccagcaaggttaactcttcagcaaggttagaggcgtgaatagtctcatccagttaccagctgaatatttttcagagaatgcccatttccctagttaagtgtttctcaaacttagctccctacgtgggtctttgtaaccacactgggaatgcatggagccatctcctgaacccaggccagtgagctaaacatttctgtggcccagtcactagtgacggttgagcattaagaacattgcaaatggtgacaatctaggaaccattaagctacagaacaggtccaagatgaggagatacgtccttacagaggtctaatgtagcacctgagaattacagaggtctaatgtagcaccagtcatccacagttgagactggaatctagtctaacacgacagagagttcgaaaggttgcagacataagaaagtaacagcagtgtgtgaaacatcacttcctgatttccttgaaagcaacttagttctgactgccaacctccatccagttcttgccaggttgctacggaagttgctttgctattcttatgggagccaacccaacccctagcattgtacacagaaaatggggaaggagatctaaattccagtcaaagttgccactgacattcccattgtcacatcccaagtggttccttgaaatatggctgctctcagctatctgccactagaaaaagaatcctcactgaagttataacatcagtagcttggatagcacctccctaggcacatcatggagcaagcctatggtagagggagcattttggctccatgcaaatgcctgactcccacagaaccacattttcctcccagtccagaggaaacttgccattcttttttgtgacttgcctcaacccatttgtctgcatcttgccagagaccacctgcttttcaatgaccttttaccattccttacaggagaaagaaacagaggcagagagggaaggagggaatggataccagaaagcaattaatctgcaggagagtagtggttcagaaggtcagaatggagcaaactctctgaaatccactctagaattagcagtagagcagctgatataagagacctacatttttcatgtagtgctctggccccagtttcccccacctcctctctcctatacaccacaatacgaatccagggcttctgtaaggtcacagagcaatccttgcctatctccagcacatacataaaaattcttaccggttcactgtttcacatatattctttatgaaaacccagtcatatcctgtgaggtaggggcgtgtgtgtttgtgtctgtgtgtattttttcattatgcccaaaaactaagatcatatgtcttctcatcactttctatttttgttgctcaggggaaaactgaacacataaacttagaaaagcagtcataccagcctatgaggtccagatgagctaataaatgtcctcttgtctttataatctccaattcctgtgataagatattagggcaataggttttccaaagtaaatttatattctattagcaggtagtgtgtattctacagcttctggatattttgctacaagtaacatttcagttaaattatattctctgggacaggtaattagaggtaaaattgctccccttttgggtacatgcatccttccccacgaatattctcatcaagaggcaaaggtggctggagtaaagtcccaagtgtgttcgtttctaagagaagccgtttagcatatcagaatgagcatgatctttgaaattgtccagatacgtagccccacactagctatgggaccttaggtaggttatttaactctctaacccttattttatcatcaataagtgtggtaataatggcaacatcacaatttaggcaaataatcagtatcccatccatgaaagaggttgctgttgctgcctttaccatccttaacaatatcctctttatttatggggaagggtcattatccatcatcaagtgacaaagcttgtctgccttacctcctagagcaggttcagcagactatagcctatgggggcaaatcctgacagttgtctgtttttgtacagcacatggactaagaaagacttcagctgtaaaaaatcaaaaggagaatattaacatttcataacacatgaaaattctatgaaattcaaatttcagtgtccaccaataaagttttattgcaacacagccacactcattcctttgcatattgcctaaggcaactttcatgctataggtgcagagagttgaatagctgtaacaaaaacccttgccccacaaaacttaaaatatttactattgtgccctttacagaaagagcccgtcaatgccctagccctagagaatacagtatagggaagaccacgtgagaaactgcttcatcacaaataatcagctttgcccttgtgatctttggtgtaggtcttgcatttggaatcagtgtttagtttttatatgtgctattttttaatatgtatggcttgtctctgcattggcagttaccccggcatatctcagtttcagttctgagtgaacgtgttgatgtctttgaggcattcctcaagaacgtctcaaaattattagttatattcctttattcctcattgatcatattataaaccaccttacctataatatgccctcatcgtttgttgaaaatttacccagcatttctacagtggtgtaataacaaagagtctgaaacataattttatgtataatatatgatggttgtggtggtggttctgaagaagaaagaggaagaggagggtagagggaaagaagaggaaaaagattcagttttactcccaatgtggaataatagcaggaagtctgttgtgtggctccaggacattatctcagttccaagctgagtgaaatcaaggtgggagttttctccactaggatactgagaatgaggaactcacaggaaagtaatagaagctattaattgcaggatctagtccttgcacaataatatttcatcacgctatttacctggagccattgcctcaggggaatatagtaattagcataactatcaacaacaatagcatgtatgcataagttaaaacatatgtattttgactagcaaattgtctcactaacaaaagagggttagatgtagtttcttggtgctgcaaaaatgtgcaagcaaaataaacaattattagagcttttttctcctgctgtttataattgaactgagctacaacccatgctttttcccattacaaatatatttatgacctttgttcgttagcacagaaatatatgtcaacatatgagacaactggatacctacctgctagggacggtgacatttgttcttactgctttgcagagtatgcaggtgtgatgaatgtcaacaccctgcgtccttgttattgttaggcagcagtatgcaatccacttgattttcatttagtgtgttggataaattaaatctcagattcttaaacttaagtggcacacttggacccatgagaagtattaagtttcttgctatgcaactggcaattctatctgcttattcacaaatatttgaaaatgcgatcccttgactaagtatttttgcaaatagcaggaggaaaagttggcaagaagcagctttgcttctaagagagtttgatgttctcctttcggaaaagcgatgaaaacctacagtgcccggtgctttacctccgctacctatgccctccctgcaggcagttccaataattttccttttcctgccagcctactttctccttgatgaagttcagtgaatatttaagccttgaggattggggctggagagagggagcattgatttcatcagttgttttggaacacgtgggatcttttctatttttccttttgcatcttttttagtatgataaaaattaggattaaatttatctttctgaggcctgttgctgtttatttctttgactaaaatatccggcaacagtatatcatgaacagctctctttcttaaaattatttcgtaaatattttttgtcgcacacacactggcgcatgcaaacactatttcgtttaatcttgtggtgactctgtcaagaaagggaaatagctttatagaaaaattctgaactaaagtgtgtaaaattaagatctctgtgtttcattgtataaaaattttagctcaaatgaacaaaagacctctcatttttatttttattttagcatttctttaccataaggttagagtaactttttaaaaatatggtagcctaaaaaaactaatgactaaaccttaaagactaatttaaaatttttatcaaatttttttctattattttcttaggaaaattctcaaacctattaaattcaaaagaatgttatggtgaacacctgtatgcatgtcaatgagatgctaccttcatgattttattataaccagctatccattctccatccacccatcaattcacctttatttttgatacattgcaaagtaaaccgcaaatatccatatgtcttcctaaatacctagtctgcctatcattaattagtatttgatatttggtttacagctttttgtttctttgagctaaaatttatataacctgaaacacacagatcttaagtgtccatttcttgagatttgaccagtgcatatttctgtgtcaacgaaatccccagatatatcaagatatagaacagagttatcacaaaaatctcctccggtccctgttaagtcttagttgctttaaatcaaatatcagttcaggttgattttataaggttttctttaaaactgtttagatgcaggcagaatacaaaagatgaaaaagacatgatccctaccctctaaaagcatatagatggtgacaaaaaccaccaaaatagaaaatttcaattttcaatatgttttaaataataacatgtggtagatgctatggaagcacctagcagtgtctgttcatccatctggactctcaggaaagggttttggaggagaagtcagctttagtctggagagaaaaaatgaataaatgttagccaggagaaaagaatgataagagaaattgctccaagaaatagagtacgtattttaaatcagtttctgctgttctagtgtttgggagaatttatgaatcagagcacaccgaggaacttgcatcgtcctctcaagaatactaggaaacacatcacaagaattcattgataaactgagtctctgtaccccaagggtatttccactgccttccaccttccgagttgctgggccccaacttctaagaaggacacttctcaaaccttcagtggctcctgtttgctgctattattagacacattcttcttatcctagcatttctaggtgcctttcatcttcccagtatagtcctaatctgactttgccccacttccccgtttacttacatcttatactcaaattatattaaactctccagtcctcatactttcctgctaggatgcctttgcccaagtctttgcctgtttctggaatcctctctctttaatgtctacctttcataaccccgttcatctgccaagtctttccccctgcccatcagaagccatcttgtctaaaaactcccatagttccttgctcctaccattcccacttttaaagccaaacacagctgttttgttctgctgtagctgacaatgtctagcacagtgctcagcacaaagtaggaaattagtaagtatttgttgaataacagtgagttctatcttatgtcagtgtgtacttatagatctagagtttctctaaagcagagtctgtgttctatacttctttacattcccagaaatcataaaggacagtcaagaattgaacaacattggccaggtgcggtggctcgcacctgtaatttcaggactttaggtggatcactttaggtcaggagttcgagatcagcctggcaaacataacaaagccccgtctctaccaaaagtacaaaaattagctgggcatggtggcagatgcctgtaatcccagctacttaggaggcgaggcaagagaattgcttgaactcaggaggcagaggttgcagtgagctaaggtcgtgccaccgcactccagcctgggcaacagagtgagaccctgtctcaaaaaaagaaagaaagaaagaaattgaacaacattaaataaacctacaatgctattctaatatctgagctgtagcattacagttctatttatatttaatacaaatttaaagaacatgtagtttgaggagtagacctcacaacgtttgtttttgtattagtatacttcaacccctctcttactacccctgaaggcttataaatgaaccgtttggttttaaattttaaaaaggaatcttataaattaagtgcagaaagaaaatgggaaagtccttgatatggtaaatgtttagttttggagagaatatcaatgttatttatgtagtcagtgcatctgttgactgactacctattacatgccaggggctgggcaaaaagcacctgtcctggtgtagcactgtttccagtataggaatatcttacagcagaccccagagaaagagttggactttgtatatttgggccctttgatttgtgtatgagaaacgtattactgagtgaatggaagccttctgattgcagataaccccaattattggaaagttcttctttatagtaagctttgtactgcctctctctaacatcttccagccagccctatttctgtcactggagcctccagaaccaagtaaacccctcttatgcacagcaccttttcagtattgaagatttacattacacaccctacccccaagcctcacctttttcagaccaagtatatagaactcaaaatactttttcaaaggaattggtttccaaattgctgtttgttttttcttaaacattttatatcagttccaacatctgatgtcagtttgatgtcctcctcagtttattctgtaacaggttttgtgatagacaccagcagagggatattgggggttgtggggaagggatgttatagagaagacgaacagagcataatctttgttgtcctaaagtatatacatggcaggagaaaacaatcactttgtcagatcatttcaatatgatgctgcaagtcatgtcagagataagcaatgggtactgtgggagcactcgggtaatctagtccaatctgggttttagggaaagaattttagaagtgtcaccagagttgagtctgaaattatgagcaaatgttttccaagagaagaatgataggaagggagacaatagaagttaaggcactgaggtatgaaatcagtatagggtggtaggggtgggggtaatgacactatagttacttatgtgaagtattagctcgagaatggcagaaaatagggcttgtgaggtatgtatgtatatacacatgtatgcattatgtgtatatgtgtgtctatctctgtaagtgtgtatgtaaatacattctgattttctaattcttagattttgccccaattctcttgttagaaattagaattttggctctacggccaaggactttattcagcatattagcttttcaagagatcataaataatcatcgttgataactataatgacctgaagtgttataacaaataatttctgcgaagtggagttttaggtaatacatatcattaaaggcattgctatgagttgaatgtgtgttccctccaaagttcaggttgaaacttaatctccatcatggtggtatgaagagatgaagtcttttgggaagtgtttaaatcatgagggcatcacatttatgaatgaattaatgcacttataaaagaggcttcaaagaaagtttgctgctttttgctgtttggctcttctgccatgtgaggacatagcattcctccccttcagacgacacagcctcaaggcaccatcttggaagcagagcaaggcctcaccagacaccaaacttgctggctccttgatcttggattttccagcctccagaactgtgaaaataaatttatattatttgttaatgacccagtcttaggtcttatttatagaatcccaaagggactgagacagtatagttataaatcaatgtcaagtttcttccagtttcttaatatggaggtttgccatttgaggatgcttcattgcttctctgacctgaataaagtagcatatatgattctcattatactattgatatttaagggaacggcttacatccatttcataagagttgtgtctcatgaattatttgtattccagaaaccaaactttgtctggagcatcccaatttaagatagccatttgttaagttaattgccatgaatgggtgacatttaataaagtatgtgaatacttaggaacggaaggttgcgaattaaaaaataaaattattctcctctttattcagtttcgtatatcacttaccaaagctcaccctgcctattctatggtgtttgagttcatgcatccagacttgtgttaagaagaagggtgacaaatttagaattcacagtgtgtgttgccatgggaaatacaacaagctattaagaaattgtcttttcaataactttttagtgtaattaaggagatcatgcatatgctcctggaaagagagcctgtagtattgagtactagctaagtgctgtgggctgtgtagacaatgtctgtggtatgcctgcccagtgactgtttctcctgcttttgcaatagcattttaatttttctttggagaactatacctgtcctattttcagcagtccatttgtttttttctgagcatccgtctctgtctcccagacttaaagagatccaggttggaatactcaaaatccaccctcaaacttgtgctgaatctatgtggaaaggagatgtgcctactcattaccatgtttgtggtggcagaatgtcaggttggggttgccagtgaccatgtttgtccccacaaagaagagcctacctgaaaatacagacagcaaaagacaatggatcttaagtctttgcaattatatcagacaatatatattttttcttaggctagttaaagttctccatcacttgaattagtcatggtttattcagagaagcaaccgatacgatgcatagagagagagaaaaaaaaagatacttattttaaggaactggctcatgcagttgtgagggctgtcaagtctgaattgcacagggcaggctggcagtctggagattcagggaagagttgatgttacagtcttggagtccaaaggcagtctggagggagaattccttcttcagggatctcagtcttttaagactttaaactgattggatgaggcccacccacaggttccagggcaatttgctttatactactgatttaaatgttactcacacccaaaaaacaccttgtaacattcatccggactgatgtttgactaaatgggtacgatagccaagccaagttaacacatgaaattaatcatctcactcctaaatgaaaacgccgtggctaatctatgcagtaactactatagttgctcagatgttgcagaaattatcacaggactgatgtagtcaggagaggttgtcaagagaacatactatttcatggtaagttataaaatccatacttttactattttgtaaataaggaatatcttttatggctatgagaaaattgaataagctgatacacatgggaggcacctaaatatttaattttctctcccttttcccttccatttatatatttgagtttctgattaagcctgtgttgtacctgagtctggaactttgcaaggcactttatgttgaggatttatgttttagagattaaatgacttcatgcggaccacgccgtaatctaagggtctagagctcagagtgaccacagcgaaggcactgagccttgtacttattttacaaataggaagctgttctctgtggtgattaattttttaaaaattaagtttcagtgctagtgttctttgccagtcagatgtctacatatgtttctaagtccgtacagctagaaagtgtgtgtcaaataaaagagttgaagttacttagctcctggcctcatatctatttcatcatgctatttaggcattcttttaagatataaaaagcaaaaatatgtaaaaatagccatttctacatggcagagtctgttttaagagcctggccaacactttgggaggccaaggcgggcggatcacctgaggtcaggagttcgagatcagcctggccaacttcgtgaaactctgtctctactaaaaatacaaaacaaaaattagccaggtgtggtggcaggctcctgtaatcccagctacttgggaggctgaggccggagaattgctggaacccgggaggtggaggttgcagtgagccgagatagtgccattgcactccagtgtgggcgacaagagcgagactctgtcttaaaaaaaaaaaagaacctgggattgttagattgttagtatacctgtcccaggtattttatttctaattgggagactagcttaatgcttggaagaatttgatgatgatcttttaaaatgtcaccaaatctaatcactcagccctaaaatacaccctcagggtataacttcagattaatgaggactaagacttgttgggagggctttggagtggaaatttccaccattgttaatttgcaggaggacatgtctgatgtgtttttgtgatggtttcacatctgacagtctgtctcctaggcacctggctgttctccactcggttccttcctgaatgttgcgctagattgtcaaatgccacttcagactagatctgtgcccccgaaagtcatgtgcaacttcatgaaaaaaatctacctgacattttcaaatgcaactcacttgaacttgtaaaagtcaggtgtaaattgagaatagatttgcacctaagtcttctttggttgatttcagtatttgcttggaactgacatttggagaataactcagttgccctcagaattggtcccctgctcactccaaagtgttgtcagggagcgcttagtgtccgaatggctagtacagtatgcttcaggtgaatttcaggcacttttatttactgggtttggaccagtttggaatggaaattaacaatatgtgaattcagtggtttcaccagtgtagcctcttgagcaaaccttggacactgaatcatatttgttgcctaaagatattaatgattatctggcttagcctcatgggcctgattcttcttcaacagtaatgtgttgattattggcattttagacatggttggtattatacagctgaatctctgcacaaattcagagcagctatgcaggcttctgccactgggtgagttgatgaaggagatgatgtctcctctcataatgctgcaccaaacagatggaatggcaagctgtctatgactctgagtatctctgaacatgaacctgtccttctgcctaccctaatcattccactttcacgaagtgcatgcactactgagccacagagaaattacacagcaagcagtagacatggtgcctgaaggcaatgcaactcttgaactggaaatttagcacacatgtgaaatccttcgcagatacaaagccgttcttagactattattttcaaaggtaaaattagagatgtaataaccttatgagatcatcatgtccagttctctcattctagagatagtaaaactgtgatccagaagttaagtcccttacttatggttatatatttagaggaagagatggggcaagaattccaggtccttgcacatcacagtattatccttctaatagagggtgaccaatgaatgcatgatttggtttgtaagcaaatgtgaaatccagagattttcatcatttccaacaatgcaaaaatgttgaatcttagactagaggctctttgacctcttcctggatttattctgtttctctttttacattcctgcaaggaaggactcttgatatatttttgccttgtagaaatattcatttctaagttggtttgaaattagcctgtcatctgattcactgagatagagttaaaataaattcccctggcaaaaaaaaaaagaaaggattttatcatctatatggatcaattccaagagttcgcttcagtttactgatccgttttccctacagtataggatattcaattaaaccttccctcaaattggccatgaattttgatgaaaatgaaagaagtttcgtttagcaaacagtttctatcagggactataataatagaatgcaataagaattattttcacctatgcacctgaacgaacatgttttgtctggtttttggtttgatttctatctgtatctttatttttctctttttgtttttcacccagattttgtgtagcttgtccaaagtggttgagatgtgggatcaggtgaaattgctcatagatacaataatgcttcacaccagtgttttcaccactgatttagtagtgtctttgataaactcttataatattccatacttacatctttctgttttaaatagaactgctgggatatgagttatgtctggtactcccttatttttattaaagcatatatagaaatttttcataccctttgcttcaggccttccttgccccacttagcatctgtagagtggacataggcaggaagagcccactctacaaaatgcatccagtatattttgagtagagactgattatggttactgatcttggtcctggaaatgagaaatgaattagatacagatggtacctctgtggaactttagagcaggagatgaagcaaaacgagggagaagacataagtgaggataacagcacacaaagtggtgagcattgccagtgaaaatgcagtggttttccccccagcgtggggtatcatagatgaaagggcgtttgagctgcaattcagaaggttctgaagatccacttatccaatttgtgttttgctttctctgtgaatggtttgagccagagctatacagggaggtgggcagtggggacagcgcatgcgtagcattttcacaaatgcttcatagggctagacagcagtggtaacatccttagccccaccccatgttttacagatgagataactggggctcaacaaggttaatgacttaggaagtcataaacactctgagctttaagccctcatcttgtgatttctctttcatggctgttttcaggaatccttaattattagattgctgcaaaagtaattgcagtttttgccatttaaaagtaatggcaaaatccacaattacttttgcaccaatgtaaacaggatttttatgatacaagtaactgaaactgactctagataatttaagtgaaaaaggaattgattgaaaagttagcatgagttctccaaaattatggagatcttagccagattcagaggaaagaagccagggtagagtgaaaggtattaggcaacaataagatcaacagcattctcaggaaaacctggccagtagaatgaatgggctctaagctttgttgttttctatctctgtattattgctcaggatccaaaatcagagagaacaatgtctgattgacttactttgaagatgtgccagtggccacccgtttgttaggggagagctaggcatcttgatttacaccctactgtgacagcacccataagtgaagaggtaatgccaccaaaggaaaccagagtggatgaccagcaaagagcatatgtccactgtgggaatacaggcacatgtaggtaaaagaacaaacgaacactgcaagtatccgtatggataaagcaacaaatcattttgtaggcctgagttaacaaatgtgatgtagcatattttcattataatattaagtctatgacaaatatattctgtgctcagccaaagttggtgaggcataacggcacttcttccataagctatggctacttgttcctccttgtgccctctggcatgcagataattaggcaaaatttaaaacagcttgaatgtagtagatgctctctatcaaggtgtgagggttaggatagcatttacccccaggcttaaagtgttctaggacatcttttgggtgagctccctccagaaagaaaaagtgttcctgagaaagggcagtatgattaatcttacctagaggctgaagcacatggtgcatattcacgcaatcgttcatgtgcacgtgaactgtatggaaggatatagctaaggacaaaaaggagttttccagcacaaattgagcacattaggctattatgaaaccattagagatttcttttgtagtttgttccgtatacagcagtctcttgcctgacttttcaaaggaaatgtggtaccaaagtagattccaagggtaagacccagttatcttggttagagtgtcctttcttgatattctcaggaatgtgttcttctggtaatttctgtaagttttcaaatgaaatgggagttactattccaagggttttacaggtagtatctaattcaattatcacagcactaggcaatagttattcttattatcctaattctacagaggacgaaacggaggcacagagaaggtttagtaaattgcttaagatcatcccttgtgcatttcacaagagcagagcaggagtagtctccccttcatatttacgtcatgtatgcctaatatagtacctggtgcagagctaagattgaatgaatgagtacataaattagacatgttatggtacagtatgagtatatattgcaatgtttgtgcatcactgaatataatagcttacatgaaatggaaaaaaactacctagccttttaaaatgtgtttatagttttcatatccattagctcatttgatttttataagacatgtatttagttggagggtataattattattcttttttaacttaaaatcaaatctcagagaagatggaacttgcccatgtgaaacaatcataacagttcctcattataaatgatatagggtactatgggacaaagaaatcttcagtaactttcagtatctaggaatctagaaattccacatattagcatagaaggcccaaactagaaactatagataaaaaataaaaccataaagaagttattaacttaaataaacattaaatgaaagaagaaaacaaaattgtaatcatagttacttgtaaaccagtgataactgcacaatacatcaaaattggcagaaaatgcaaaagccattcttagggggaaaaaacatagccctatatgtgtttatttgaccaaaaaaaatgaaaataaaagagctaagtattacactacaaaatgtgtttaaaagatgatagtgtaaatataaagaaagcaggaaaaaggaaatttgagtctagaaaatctccatataattattagggaagaggagaagagatgagaaaaaagaactaggcttctttccaagattaagttgatctgggctaggcatggtggatcacgcctgtaatcccagaactttgggaggctgaggcaggcgggcggatcatttgaggtcaggagttcaagatcagcctgggcagcatggtgaaaccccgtctctactaaaaatacaaaaattagccaggtgtggtggcatacacctgtagtccccagtactcgggaggctgaggcaggagaattgctggaacctgggaggcggaggttgcagggagcctagattgtgccgctgctctccagcctgggtgacagagcgagacttcatttcaaaaaaaaaaaaaaaaaaaaaaaaagttgatctggaacacatgccctcttatacataataccatttcaagacccctttaaagtaaataacaataaaatagatactagaaattgaaagtacgatatggctctaaaagtaaaatcaatttaaaaaatacaacaaaaatgatttccaatggcagaagaaagaagagaaaataagagaaagaggacaaaacaaaggataaaatgggttatctaatgcagtgacaaaactggcatccttttctggaagaacttcatagggtacaggctggaagagtggttctcttgaacaggcatcagaatcacctgcaggacttgttcaaaaacagattactattcccactcccataaaatatggatttagatatagaccataagattgacttttaaaatacatgaataggttcacatttttataagacaggaacatttacagaaaatgaaatgagagatgttcaatacaatactttaagatgtaatgtatcttattaaaagtggccatagatgacagttgaagtttaagtcttgagaaaactatgtttcttacagaacattaatatacattttccttaaccatctcaacttacagtctaaacactgcgtgagtgatgataggatcaaagataactggagcattgtattaaacatatatttaatctgagtcctcaagaaagtgttgcaatttaaatatatatagacagacatacatatgtgtgtatatatatatatttattaattattaatttgttatttattaattccaaaggcatggtacagagagctgcataagaattctcagctggctttgggaggccgaggcaggcggatcacgaggtcaggagatcgagaccatcctggctaacatggtgaaaccccgtctctactaaaactacaaaaaattagctgggcgtagtggcgggcgcctgtagtcccagctactcgggaagctgaggcaggagaatggcgggaacctaggaggcagagcttgcagtgagccgagattgtgccactgcactccagcctgggcgacatagccagactccgtctcaaaaaaaaaaaaaaagaattctcagctggttaatagcacagccaggtgtacatttgattttcaatatatatatttatatctatatatataaatatatatatataaatatataaatatgtatataatatataaatatatataaatatataaatatatataaatatatataaatatatataaatatatataatttataaatttataaatttatttatatatataaaatttatataaattttatatatttatatataatatataaatatatatattatatataaaaagtatattatatatatttatatattgtatattatatataaataaatatataaaatatataatatatacaacatataaaatatatatgatatatatgatatataatatataatatatatttattatatataatacataatatatatttgttatatataatatatataatatataataaatatatataatatataatatataatatatgtgtttatatataatatatattttttatataatatataaaatatatattatatataaaatatatgtaatatataatttataaataaatatataatatataaatatataaaatatatattatataaaatataaaataaatatataaaaataaatatatataaatatacatatttatatagatagacacacaaacatatatatataggcttttaaaacactaagtgtaaagttctcatcttctttggtagagattagacatctattaatctagcagaatagccaaatgactacagaaaatcatttttaaaatacgctttatagaatagggggaaaacccagtgacataatgcataatgcctggacatcacaatagaatgtattttgtgttaatacattctgtggtttatgcccaacactatgatcagtgaaatctgcctggtttccatccactcagactacactccattgtcatttctgagaaaatagtagcatgattacataaggaaaaatgatgcatgaggatgtcttgttaactttaaggaaggtgctctaaaatatgaatcagcatatagaggtggttgtattgatttttagtattataatttgactctgaagtcacatttgcaatttgcgatttgcaaaagagagtgatatcttgcatcatcacatcagaccacatagtttgcacactttatgtaatattggggaggtagagtggggtggatatttcatcgcaaatgaaaaatgcaacagtttgtttctcgggtgagctacctatggttatttaatgtcacctgccatagcaaaatactgcttaatctatatgactgggtagatgggtgctaaagaacaattctcttttaactttgctgcatgtttaaaaattttgataacaaattgctagggtaagaactaaaagatcacgtagattccagagccaacctaccaaatttaaatttcatctttcctggtatgaccttggacaagtctcttaaggtctctgtgcctcagtttcctcacctgtaaaataaacactcattaaattgtaatgaaatttgagttaacattttcaaagtgcccagaagtgtaactggcatggggaagcactagattatgtgtatgtgtgtgtgtgtgtgtatgtaattataaaataaaacttcaagtcccacagagtggctcatgcttgtagtcccagcactttaggaggccgaggcaggtggatcgcttgagaccaggagttcaggaacactctgggtgacatggtgaaactccatctctatagaaaaaaaatacaaaaaaattagacgggcatggtgatgcatgcctgtagtcccagctactcaggagcctgaggtgggagagtcactggaacccaggaggttgaggctgcagtgagccgagatcacgccactgcactccagcctggatgacagagcaagaccatgtctcaaaaaaaaaaacccaaaaaaaacagaaaacttcacctacaatttggtaaatatccttgtggtttgtttttacttgaaattataggaatttaaattcaaaaatcttttaggactatttaattcaactcttaattccaaaggggtagtacagatagctgcataagaattctcagctggttgatagcagagccaggtgtacatctgcttttcaaattgaaagtcccctaatattgctaacacactagaatttatcttttggcagtggcagggaagagaagttagcagtttttgttattttaacttaattaaatattgtttgatgcttctttttcttttgttttatttgttttttgttttgaggcagggtcatgctctgttacccaggctggattgcagtggcttgatcatagctcactgtaacctcgaactcttgggctcaagtgatcctccccctttagcctccctaagtgctgcacataccaccacacctggctctgtttgatacatttaaataagttaaaatatgtttgaattttcacaactctgactagatgtcatgtgctgaagcatttgcgagtaaggtagcaaatatttagctataatttaagctaatgaaatgagtctgaaaagaatccaataaattataatatgttactattacttcccataagtcattttgatatatggtagaattttaaaaatgattacttgttttatataataccaattcattctattattggttcttttggatgctgagaaaacaaaatatgaatttaaccaattgccttcagggtaggaagctgatcaaatacattatctttaagattggcctgtattatatttcaaagtttcaatgggttaatctcatagttatttacttcaaaatgaaggctggtgacatgaagttaaaatatataattctgagctttactacttaccttgaaaaactaatgatgacaagatatcttcatttgctgatgatacaatggcattttaaaaagaaatggggtttccaacaaaaagtaatcatttacatccaaatacgacttaaaaggtaacccatatggaccacaagaaatgattataattatctggaaagataggaataaaggattaccgtaagagactctgtccattcttggaggggatacgttctctagattttagagaattaggttatctctagctgctgtgcggaagctctgggagataagcaatcacttcagtgacaaaactgtgaagttttaataaaggagcccattggtatgggactgaggctctaaaactgtggcctgatgtcccacatcatgaatattcaaaaccttaaatctggagaccttcatgtacttcctagagaggcaatccattccctcctacccagagagcacgtccatgcacgcaggcacgcgcacgcgcgcatcacacacacacacacacacacacacacacacacacacacactgcccagaagaaaatgataggattttttcctagcatgaaaacattattattctataataagtacacaaatgcagtttttatgttgaagataaatcttttttaaaaaggaaactctccattcctttgtaaaatattgtaataagagaacttttaagtgtatacccaatcatgtatggatgatctcctgtgtcgatatcgcattgcagaaatccatgtacgtattttaatgggcgttgctacttggatcttcagaatacatgatatatctcttctcagatatctcatagaccatcccccctctgctgccactgaatttcatttagacctcggtggctgagtttttaagctagatcgttacaaatgaagccttaccatttgatgaaaatccagcaaaaatgcatattgcatttacaacagacaaaaccaaattttattggtaaaaataactatttcttttagaataaagaatgtatttatagttttgttttgtttttaaatcttgaaagagacctgaatttataattagtacagtgtgattctcaaccttggctgcatattagaatcatctgggggtccttaaaaaatactgatgcgtaggtctcacgcctggttaggatttgattggtaagggtacaacctgtgcaccagggattttcaaagttccctcaggtgatcatcgtgtgcaatgggggatgggaactactgaaacctaatccccgcaattacagggttttatatcgtttgcctcaggctaaagatttatgccagacttctagaccagtctcctttccaattccataaaatgaacaatttcacatattgaaaaatgtttttaataattaatcatttaaattccacaatgtggctgggtgcggtggctctcacctgtaaccgcagcactttgggaggctgaggcaggtggatcacttgaggtcaggagttcaaaatcagcctggccaacatggtgaaaccctctctctactaaaaatacaaaaattagccaggcgtggtggtgcacacctgtagtcccagctacttgggaggctgagccaggagagcccgggagtccagcagtgagctgagactgcgccactgcactccagcctgggtgacagggcaagaccctgtctcaaacatataaatacaaaaaaaaaataagaataaactccaaagagcatgtttccacacttaatgcttattgctgaaaccctcctttgttaacattttaaattgtcgctctatagatgtcattagttttcctcttgaaaaggcactgattaaaaagtaaattattagcactaggtataatattagttcgaaccacagttagtaaatacagaacatgctatctaatgaaaatgtcttatgagcatttcggggcatcactttacatgtgagcaattttggtttttagttgtgcagtctgtgagagtgattttgttagttttgcaggcctcagaaaactccagataatttaatggcacccatcctgtataggatgtgtgtaaagcacttcacaggttgcctatcttggccaaatgtaagaagcaattggagaggcaaaggaaaaagcagtcaggaataatattaactgtgcattattgtggcagctttattctggcttttgttgtattttaatagtgacagctgcacccagaatttcttgtttccataactagtgcaatttccttttcctgaaagctctgtgtagttataacctggtcttttgttttcctgcattgactaaggaaactaattttttttgttactagacagataaaagacaagtgttaaaaggtgtcaattgcattttttttaatatggagaaagtgtccaatcttgtggtctgtcttcaactaattttagatatgattttatttttctggccacccgtggacttgtcacaaattaattaaatgcttcacttcttttatctaattgaggccatttctacctctgatgaataatttcataaagtttgttacaaaggaaaatgctttctgagtgatagtttatgcaaagtaaacacacagaacagctctatttgaacctttgcttgtggcaaaggctttccatacactccacaggaagttgttccctctcaaagaaggccagtgtcttccttttttaacgtacagcatgaaaatgtacttgaccccaagcttcaaagcagagaagtcagctttatctagcagggacaatgcgcattaaatcaataaaatggcaggggtatgaaaccagtggaattgggaattggattccagtcagggtcaatcagcccaaagtagagatctaatattttctgaatgaactgtttgaagcactggccttcagaatcattgtcagtttttgatgacttcctcaggcaacatagtgtcacacacagcaagagggtcacaaacccagatgcctacaggggccggatacagaaaagaaataagtgaagctggctaggtaggagatcatagacagtgatggagactcggtcaggactttggtcagtgcctgggtaatctcacacagtcagcacatagtgagttccagccagtttctgcctcctgggaatgctggagtgttacaaagcctcctgattttttaagagccgctatgaatcttttttcttttaaatgttagaaactcatttaaaatatatgaaagcagacaccagccacaaataggtatttttggagtcagagtttgcataagactttagatatgatatattccaaattccctacttttctgaaggaagaaggagggaagaagaacatcaagaattggaggacatttaggatgatggcaaggcctctgaacgtacaaaaagggggtttccatcagcaccactcttcaaaccagaaatgctaaacgcagagaggattaacatggcagaaggagaattactcatttagtatcacctctttataagcaaggagacttgtctagtcacccaactgctgagcatcagaactgggaccaggcaatactcatagtaaaattagaaaacttgtgaaaacctcagggagaatataaattccagttcattctataataaagtctcaaagaccaccaagggtaacttgtacaagtcctatcattagttagggacagagcctatctaccagttgtatatggtacaaatatttttgagcatatgaatatgcaacaatttttttaaaactcttccttcattatattaagactttttaaaaaatgttatttatgggatagtttatttatcagagggctgctgggttcatctactctggctgctaatgacagatgaatcaccattcagcatttactgaatatacattcattaaaaatgcagtctatggaggctctgtagaaatatggaaagttgttatcagtgcaaaacttgaaataaaattgtatgcacattgttataactatttttatagttgaattgcaaaaacttggaagggaaaacaccaaaagtatctgttaaagaggtgaaattagaagtgattttttaaaaagtcttctgcattattatatggtgatattaatttcaatttaaaaatatatagccacgaaaataaattattacttgaacaactattgaaagtccagcaatgtgctagttgccatagggagataaaattctattagctagtatagaggagaaaaggtaacatctttttctcacccattgcagggttcatgattaagatccctgtaacagaaaaccagattaacaacagaaaagcatacagatttatttaatataagttttatggaatactgaagcctacagaaatgaagacctaaataaacagggtgtaatgttgtaaaatatatatttggtcttcatgccatgtcctggcatatgatttctaaaatctttggaatctccaaagtgctgtttttctgtatgctaatgttgactgaccacttcaagatgggtctggtcaccagaaagacaaagtcatgcttagaggattggtactttcaaccccaacctttggggaaagaagagggactgaaggtcaagctgatcaccagtggtcactgtcttaaccaatcatgcctatgtaaagaagccttcataaaaacccaacaggacagggtgcaaagagcttccagaaagctgaacccatggaggatcctggagggtggctcacccaagcagggcgtggaagctccacgccccttccccaatacctcgccctatgcatgccttcatctgtatcctttgtgatatcctttatgataaccagcaaacattgcgttcccctgtgttatttgagccactctagcaaattaattgaacccacagtgggtcatgggaacctcaacttgaagccagtcaggcagaagttccagaggcccaaatttgcaactgatatctgaagtgggggagcagttttggggactgagtcttcagcctgtgagatctgaccaggtatattcaaaatgatatagaaggacccccaagtggtatctgctgcagaattcattgctcacttggtggtgggaagaaaccccctcccacgcacacacatttggtcacagaagtcttctgtgttgatgattgctgtggtgtgaaagcagagggaaaattgtttcagttttttctaaacacaaggaaaactatttttatgtttacatttgatgaagagtggaaagtcgtatagagatatgattgaacaaaaaggggcatgatctaaaggaaataaacgggggaacttagcacggcctgtttgttcagcttctccttagagtctctaccttcattcctttcctctggatatagggaggacccctctggaatgcaggtcttatgacctactttagatgaaggtcagaaaatcttttatgtcctgcttcaggggagaaccacaggaggagattagaaagaccttcctgcttctgctgtttgctgaagtgacaatatgccatattttggggtagcgtgtcctgaacctaatcaataggctcacttgtaaaatgagaatgttgagagataatgaaataattatagaaagaaagaaatctgaaatgaatgtacaaacaataggctttagattctcacagacctggatttttgttctcagctctgtcatttaggcatattgccttgggaaaggaacttaagtgttcacaaagtctcagatttgtgatccgtaaaatccagatgatgataataccttcatcatggttgaaatgagacaatgcatgtaaagcacttagtgagaagcctgtcatggagacatggccgttaaatgttagctattttcactaccattgtggattttatccttctacagaactagtaataataatcataatagcactagcaatctagtaattatagtagtgatcactcattattgaaatgggctccccctgttggccaggcagtgttgggacttttatctgattgttctctaaatttcacaacaatttttttaaaaaaatcagtattattaataaatattattcagtactatttataaagcaggtgagactcagagtgtaagtaatggttctaacatctcatagctagacatagaggagctgggatttaaattcagacatgtatgattccaaacagttcttcatactgttctgtagaaaaatctatgtgtagccctaggaaatgatgtgactttatataagcaagagcaagtggggaagtgttggggttggagatgtttcactggttgggttgcctgggattggatgctatgccaaaaaagaacctaagagtgaaagaggaagatagcacctgtggagtaagccaggctgccaatgccaaggaacccatggtccaaagaccaaaccaaacaagtactcagccccaaagacaaggcaattataggcaagcagtactcaatgagaaaaccaaccagaacagaaccagagacagccagtgggagcttactcagcctgtgttcattcccgtcggggttgggagtggtataggaaaatgtcgtcgtttatttatgtatttttatgttattttggagacagggtctcgctctgtcacccaggctggagtgcactggcactattacagctcactgtaaacttgaactcttgggctcaaacgatcctccttccttggcccccaaagctctggggttacaggcatgaggcaccacgctgggcccagttcgagagtattcataacattggttgggcaacttgctttggaaggctgtactatcttgctttatctgagatattcaagtgcttttaagatctttatcaactccaattagacttcaacagcatttggcagctttctacatatatcgtgtttcaaggttgttgatatctcttgtttttatctatggtagagctttcacttcccttttacattctacttgttgctttagggtgatctccaccaggaaaggaatcaataattcgctttatgtacccagtagaaaactgtatgtttctaaaaaccttctaaaggaagcagctactgaaaaacaacataataaaaggaaaatgaattgtgaaaatacatatgtaaagggataaattgtatatgtaaaggaaagtaaaagccaggagcctattttacattatacagccttataatttggaaatttcttcatagcatcattataatgtgaggcagtatggagtatgattaagggcatggatttttaaatcagcaacctctgtttaagtcctacctgttactttagcaaatcagttgtcttaaccctttatgtaaaaaagggaatatcagggggatttatcttacaaaattgttttaaggattaagtgagctactctatgcaaagcacatttcaagtccctgtcttagtcagttagagctgtcataacaaaataccataaactgggtagttcgaactatagaaatttgtttacttagagttttggaagctgaggaatacaagatcaaggtgccacctgacttcctttctggtgagggctctcatgctgacttgcagacagatgcctttttgccgtgtcctcacatggctgagacagtgcgagctctttggtatctccttttatgaagacagtatcatgtcagacaaaggctctaccccatggcctcatttaaccttaattacttccttactttagatataggcatactgggggtcaggatagcaacatctgaattttaggtgaacacagttaagttcacagcagttcacagccatccccattacatgttttaattttatttgtttatttctttttcgagaaagggtctcactctgtcacccaggcttatagtgcagtggcatgatcataactcactgcagcctcaacctcctgggctcaaacgatcctcctgcctcagcctactgagtagctgagaccacaggtgtgcgctaccatgcctggctactttcttcactttttatagagatagggtctcaccatgttgccccagctgaccattttttaatataccaattaaattcaccaaacatatacttgtttaaatttaactcaaagatataacttctattaacatttcttaatatattgtaattgagataaagcacagcattatcatatatcattattgtatattatatgatatatctaatattattatattattattatgggatttatcttacaagattgttttaaggattaagtgagatactctatgtaaagcacattgcgtagtccctgtcttagtcagctagagctgtcataacaaaatactgtaaactgggtagttcatagatgtatgattatgtatgtgtcatgtatcatgaaaatgatttacattttctcccattctctgtggcccatggcattttaaggacttcataaaaattggctataattattatttttattggagaagagatacactccatatgcctcttctattaaattttaccattttagtagttttaaaatgtataaatcagttctttttagcatatacacaattttgtgaaactatcaccactatccacttccagaatatttccattacccccaaaaagaaaccccttaccacctagtagccctttccaacaccttctttccctcatatactgggaactactagtctgctttgtgtgtctatgtatttgcctattctggacatttcttatgaatggaattatgcaatatgtgaccttctgtatctgcttctttcacttctcataatattttcaagattcatctctattgtcacatgtatccttttcatggatgaataatattccactgtattgatctatgacatttgtttatccattcatcagtcaatggacatttgagctatttctaccttttggctattattaataatactgctatgaacacttgtgtaaaagtgtttatgcagacctgtgttttcaattctcttgggtattgtgcaaaaaagagttaacaggcctgactgctgcgctttgaaaagcctggtttaaaaggttggccctttattggcatgtggaaacctggatttcagtagggtgcccactaccctaactggtaagagtggctcactgttcctaaattgtgcaaataatatggttttttatgaacaccttatttccttctgggaatctggaattttggtatatgtcaagcagaggctgcctacatgaccagcccccagtgaaaaccccgggtactagtctttaataagtgcccttggctggcgttttcacacgtgttttcataattcattgctgttttatgtgcatctcctgggagaagacttgggaatcttgcctctgatttcctccagtcttcactccatgtgtttcttccctttgctgatttttctctgtatccttttacattatgatctaataagtcataactgtgagtatgaatatatgccaagtcctgtgaatcctcctagtaaaacatcaaacctggggttggtttcggggactcctaacacaagtatatacctagggatgaaatttctggatcaactttttgagcaactgcaaactgttggccatagtatctacactattttacattaccactagcaacatttgagccttctgacttcatgtaatcactccaatacttgccatcatttattttctgggtttttttgttttggtatttggtatgtatttctttaatagccagtctactgggtatgaagtgctatctcatttgatttgcatgtctctaatatctaataatgtggagcatcttttcatgtgtttattgaccatttatacatctctgtttggagaagtgtttattcaagtcctttacctattttttaaattgagttgttttatcattattgagttgtaagattcttttcatatgttgaatactagattattattagatacatgattcacaaatattttctcccattctgtgcattttaagcacttcaaaaaatttggctataattattatttttaatcaatgatccttcaaatcactaggcttttctcattgaccaaaatagcctcatatatattatcaccatatgcatacattttcttggttttttttttaaccctttaacgtttgctatgttgatagcatactgatttctctatgttgggaaagtatatttcacacattttggtaattatctatggaatatttataaatatctctattatgtgctggatattttgcccagagtagaagcatattaactgacaagggccaactcctgaattcccttttagaaaatgttaacaactgctcagatcctacttcaggatgcttttcgtgtcaagatcccaaaggtttgataaagaatggttggttttcatttgagatagtcattacccagacaaggttggttatatttcacttaatgtttttatggcttctaacacaaccagtagttttctatttatttcctgggagtagggaaggatagttgtgttgcttgaagtgtattttttattatttttgctattaaatgagaacaacaaaaattcactgtaattattaactttctttcattttcacatttatttctgtaatttctcaagtccctgaaataccctgaagagacttatctagttaaatagttaatattttgttgtgaaagttttactataagccaaacattttactttttgtttttaaagtaaatgtagacatatgcacattcatatgcaaaatgatgggcccaaattggatcagggatttttaacctgaaatccatagattatcttcagggaggtgtctgaagcccctgaaattgcatgtacatattaactccccccatctacttatcaatgtgttctctaatttaaaaaatgattaagaactactggactagataagtcttagatctgtccagattaggttatttttaaaaattcagttactaaccatcagcttgtcagtgaagatatgttcaatgaaggaagggagggaccttgtcaatcttttttcactattgtatcctctacatgtgaaacacggtacgtactcagaaaacatttgttgaattagtcaatgaatgaatgattaaggaacaatttctccatagagtgacctaacattagaacattagaaacaaggttcataaggacaagacttcacttttttttttttttttagacagagtctcactctgtcgcccaggctggaatgcagtgtcatgatctcggctcactgcaacctcgcctcctgggttcaagtgattcttctgcctcagcctcccaagtagctgggactgcaggaatgcaccaccatgcccagctgattttttagcagagacaggatttcaccatgttggtcaggctgatctcgaatttctgacctcaggtgatccacctgcctcggcctcccacagtgctgggattacaggcattgagtgaccacgcccagctaatttttatatttttagtagagacggggtttcaccatgttggccaggctggtctcaaacccctgacctcaggcgatccgcctgcttgggcctcccaaagtgctaggattacaggcgtgagccaccacgctgggccaagacttcacttttgaaatagaatgaaaagttaatttacatagaaaattcaaaaattgactttcttggtgggctaagcctcagctagttctctcaaagaccttccagaagaaccaggttctattataaacaatagttgacaagtaatcaggatatgtagtgttcagccctagttctgctatataccagcttattctacattccaagttgttttgtttgttcattaactcattcattaaggatggatcagatatccacagtgtggcagaaagaatgataaaagctggggaacaatgaccacattaactcaagtgtctatcttctaagagcttgcaagcaatagacaagtaagtaaagtattataagtgtgactagggtaagtatcatggtgtacagaatgctttgaaagcagaaggaaaggccatttcattatagggaattttttgttgcctgacaaaaatacagatatttcctattttttgctacattacactttgcttctttttgatgtcaatgagatagagatgccatgacatcaaaagccagaaaccaaccaaagggatttatactgcttttataccctattaaatgcaggtagacattacctaccctctttccagccctgtctgaaggtggctttcttttatagtctaaactattctgagcctgaacattgagcataactcgttcagagacctggggaagattaaaggtaggttttctgggacttacacctgaatttttatgtacccaactgagccatcagttttgggaaagagagggcaaaggtggaaagatgtgcttgctcactttattactctcctagaggcaaaaaatttgtgtccatggtgatttatgttcaaaaagatcttattccatctagaccacagaaagtcacatgtgtcttcctatctattagataaacactaaacagaaacaagggtgcattctccttcctatgccaaacacttcccctcccccagcattatagactttaaagaatttaaagacattttgtgtttacatacttgtgtaagaattattaggtgccagaaactaatctcagcactttaaatatattaagggatttaacacttacatcctataaactgggctccatttcacaaggaagttgaggcacaaagtctaagtaactcactcaatgttgcatagtggtagagctgagattttgaacccaggcactgtggttttgacccctatagcttatagacattagcatattctttttttgtttgtttgtttgttttgagacagagtcttgctctgttgaccaggctggagtgcagtggcatgatctcggctcactgcaacctccacctcccaggttcagcaattctcgtgtctcagcctcccgagcagctgggattacaggcatgtgccaccacacctggctaatttttatatttttagtagagatgagggttcaccatgttggccagactggtctccaactcctgacctcaggtgatccacccacctcagcctccccaaatgctgggattacagacgtgagccaccacgcccagccaagataattggtttagaatcagttttctaattctatctgcatcccttaagagagagaaaaagaaacaaatcatggtagtggcagagtaaccaaggcttttggggcctcactgtatttgtcattaagttaggatgcagaaataatacctgccttagcttatacagtgtgggttggggaactctgccatgaacatggaagtattaagcactgacacatgatatactgatgccactgctgctatttcatgtccggcattgctcttcctgcatatggtactgaaggcacacctactgctgtgtgcatatgtgagtgtgagtgtatgtgtgtgtgagagagagagagaatttgtttgttgcaaacacactaagcaccctcttactgctacagggctctgtcagttactgctgtttttgcctgtagtgcttatcagtgatagcctcagggtttgcctgctcacctccttcaagtcttggatcagatatccttttctcagaaaggacttcactgtcaactctatttgctatggtctgaaagttttgtccccattaagttcatatgttgaaatcctaaccctgaaggttgggcctttgggaagggattaagtcatgagggcagagcccccatgaatgagattagcacccatgtaagagaagccccagagagctgcctttcccctttgctatgtgaggacacagcaaatgggtgccctctatgaaccagaaagtgggcttcaccagacaccaaatctgccagcacctcgtgcttggacatctcagcctccagaactgtaagcaataaatttctgttgttatgaagttacccagtttatgttattttgttaaagcaacctgaacagactaagacgctatttaaaattgcagtgttcttcctagattctctattccctttcttgatatacttaacttcacaatacgaatgacctttcaacaagctatgtaaattacttaatctgcttcccacagcctagaatgtgagctccttggacagtgtgtttacttctctctgtctatcctcagtgtgaatagtctagtacatagtgggtactcagtaaatacttgttgaatgaatgaaagatgttaatccattatcccctgtcagttacttcttacttagttgacatgtttctcaagcaagcagatgcttttgcaataaaggtagagaaggtcacagtcatccaccttctctgtggctagaggtgtatgggaagggatttgaggatcatttgatagcgaaatgaagaggacaggtggatgacttattcaaaagacccaacaactcaatggacgtgctttttacctcatcttaagaaagctaagaaaacgtttttttcctctcttttgataagcctgtgaattcaagtcaatggcattttttctgctgccatttatcctttcacagaaagggtttttgctttgtgtttgcccaaatcagtgtgcatgccactttaccttatgacaaaatgacatagaaaaggcagaatgcccaataattggtgcaaattttatgcttgtcattttgaaaggttataaatcccctcttttataatgttttctatagaggatactttaggacagaatatcccttctgtacatcaatatgctgctaattccaaaaaagaacaactttgtaatttgaaagaattggtaacaagtgtggcatatgatgaatcacatttatccattctgctgtctattgaagggaaatggactttcacttgtttccttctaaaccaaagtttcaagacataaatattgacaaaatagattatctctcttcctaagggatgattccatcattctttcccactatatttctaggtaaaagtggaccagttttactgttatccaaacaataaatgggaggaaacttcaggtactatgaaaaacatttcatttttaattggaaaatcaagattctggtgagagctccatcactgcgtatctgtgtgactttggatacaccacctaatctttgcaaacctttgtttactcgcctcaaaaagtggggtttgataaaaatctgaactcactcacatttaatatgccattttactcacagccttagtccatttgtgctgctatcacaaaatacctgagactatattatgcataaagaacagaaatttatttctcactattctggagactggagagtctaaaatcaaagtaccggcaggtttggtgtctggtgagggctgctctgtgcttccaaggtggcaccctgttattgcgtcctccagaggggatgaaggctgtgtcttcacacggtggaagggacaaaaaggcaagagggttgaatgctgtttgaagcctcttttatgaaggccttaatcccattcatgagggaggagtcctcatgaccttatcactctcctaagggccttacctctaaatactgttgcgttgaggattaagtttcaacataaattttgaagggggcacacacattcaaaccatagtgctcagcgtaccagaatctcatgtgttacttggtgctggtaatcatagagagcagttgccgtagtgtatcataatgccagtaagtacttggctctgatcttagaagaaaccaagttcagtccctgttctgcagcctcttataacggtggcctgtctccaggcctctcttttccatcattaaatgaggaagagcatagctcttgtctgtgggttatatgaaccagcccccaataaccatttttactttgtagagagcctaaccttattatgtactcagtaaatgatggttattattgtcattattttacatggctctaaagaggatacataggggttatcttttgaggaagggagagtcagagttgatttgtagttttgtaaacactcttttttcaaagctgagcaaatctctgcctaagttgaatgattatggctttgtttatccttctctgacaggactttctagtttcagtcagtgggtaatgtagaacatatgtctggtttggatttcccgacaaactttcaattaaaataccaatgtcccaccaggaagaaccgtatctggagccccttacctgccataaactttatctacattgtgttctcattcccaacttcactgtagacatcatgatagccctatctcctaagaaacaatgtgaaaaataattaaaatagtttcacaccagaaagaaaagcacaccaaactcaaatttagtggacctgttagaaatatgttctccaagttttgcttgagtagctttcagattactccctttcacgcttcctagtatatatattgacgcattcactatgtgccaaattacaaacctgaaacatttagagaaagacagaagtagggtactttagctgccaaagagacaggtgcaaaggctcatgaatattagttgaggagctgcggtgcatataacatgaaagtactgcctgcaggcattctgtgattgggcagtttaatgtcagtgggaaacggagggtgtcactggggagttaaaaacaacagcagttcaccccagaagggcttaaaacagatagtctccaggaaactgtgaaattatgactgaacgtagaaagggcaacctctccactttggtcgtacttttgtttagatgagaaggaggatggtttggctcttgggagcgttggagagatagctggggaaagaaacggtggtttctcccagtcccacaaaaggttggacaactctggattatagtactcttaatacatgacaactaaagcgtcagaagccaaagcagatcttctagatcatttatacctcctattaaacagaaaaatatatccctatgagcatggataatgggagacactgttcattcagagcataaaagagaggcatttccagcatttgatttcagagccatgcaagtgctcttttttccttggttatcagctctggcagccacctggtgcttaaaacagcctgatgtggttgctgaaattacccttctatgccctccttaaatagtggctcatgattgtagatcacctgcatctgtaacccagggtgcaacattctaatgcatatgcctgcaccccgtccccaaatctatgtaatcagaaagtttgggaaaggccacggaatcctatagtcctcatttttaactggctctctgggagattctttatgcgtagaaagaatacacaaatgcatattgaaggcattagcactgcttttggttaacggtcttttcaaaaggccaccattaaagtgtatgaattccagcttgaatctaacagtctccagaatgacttagattgtagttatatatatttttttacaacaagaaactgtcctgtagtggggaagggcctggacaacacacatgatggagttttccatatgcatccagaaataccagaaggggtacagttcaaggaagcagatttttagggagtagttgatcccggtggtgttcaggttgaagtacagacacaaaaatgaacagtaagtccacagagagaaggcttttgcctgccacattgctgaagaccagtcttacttgtatgtattcacacacacacaagtacatttggagaaatgtcaaaaagaaataagaatagaacgaagaccaatgacatgaagaaataactcactgaataaattggtgtgtacctttctatgcatatagtgttgatcaggagtttcttaggtacagctgataacaactgcaactcagatttgcttaaatgaaggcaatcattagctctcatatctgagaatcttagggataaagcttgcttgggacggaacttgttccagagctgaaacgatgccatcagaactcagtctgtccctatcctttaattttgctcttttctgttttggcttcattctctttttaggttctctctctctatgtgggagtctttggaagctccaggcttccttctgtaagcaattctagactacaaaagggttttttccttgtagttttatgaaaagtcctgcaatggagtctcattagccaggctttggtcacccatgcatgggaaccaatttaaccaagaaaatggaatattaattggtcaggccaattgataatgtataaataagtattaataacttatcaatgctaagcagtgtcatctgctactcctgacctgtgcagaggattttagtctatccaaaccacttgagttgaaagagtaggagggttggttcaccaaagaaagagtagaatgctcttacctaatgaggagcagtggatactgaggcaaaaatcacagatgtctactacatagttatgccagtagggaagcaccattgagtgaattagtgaccctgatatctcatttacatttctctagctaaagccaatcaattttatacatgtatgtttctatgcttttattctcatgagtaaacagtaatgcacctaaatataaatcggaaagtttgctgcagtggagcgctgggttgttagggtagtacactactctgtgtgatattgtaatggtggatccatgtcctaatacatttgccaggaccacagcatgtgcaatacgtgatggaccctgatgtgaactgtgggctttagttaatatgcatgcattcatattggcttatcgattgtaacaaatacagcacaggaatgcaagatgttaacaatacgggaaactgtgtggagaaggagtgtaggcaaactctctgtgctctgctccatttttctgtaaacctcaaactgctctgaaaaaataaagttctattaattaaaaagatgaagttagctataactattattagtcctctctagagtaaacattccatgagggcaggacaatgtctgctttgcacacggttatgtcgcctccatgtaatattggaattggaatccaatctagtcccagaaactcggatcagaagccatttgggtcagaaatgtttgagaatttaaaatgtttgtaattttagaagagaaatatagcccacaaaacatgcccagtgttacataatagcatccccagctgagtctgggtcagcactgcataatcaaacgcatttctaattctgcagcaaagcatatgaatattcacattgagtctataaatagtctcccatcagttcccatcagttcaggtcagtttttgcctccaaatgagttacaaagtatttgcatttgttggaaatgcttctttcttgtcataactagggcttggcgtcagtatcacccaattacttatttttaaaagagtcattaatccattgttcctggaatgtgtcaaggtttaagatcagggtcagagtaggatacattgatacagccccacggctgttcttttccacgcctaaaaatcctcgagcaatgcacaatttttccccaaggagagaccctttttagctcccagcacttccccgtcctaccactgtttctaagatctggcattacaaacgattagggcttcattatgtgtgggacaaatgcatgatggcggcagcattattttgttaacaagagaacaaagaaatcgtctgagaagagttcacttctcatttggatttttttcactttgtgccttcagacatacaccagctgtcggtagacttctctgtttcttgctgtttaaaatgctcatttgaggggttaaaagaaggaaggcggaagcaatgacaaatgaaagtaatgtttatcctttaagcaggcatgtctgtctcctctaatatttgctttgcctctgctctattcagctgaacaaccaaatagaatacttattcaatagaaacgctgtgtgttggccagtttttcaagtaggcacttgggtaaggcctttgaacatgccttgctgtctgtcttataaatactaacaacactaaattgtattagtaatgatagtgtgacagctgtccaatcatcatttctacaatcagtgattgaattttaaaggaattcttgcactcaggaaaatcactcttacagtatttcatttgtttgtgaatttccttaggttattgcccatacgttttatgagtaatttagatccacagagatgctgctgatcttacagttttttagccaaaatgcatttccctaatcattaggaagcctggaggagaaggttcacagccagcaggacacagtgtgccctacgtgtgcccttcttggaacatgctggtggtggaaagagtaatggttcttcccattgggttcccccttggtgtgagtggtgagggagaaagtgaaatatgagcaggacactgagagcacacccaacaacccagcttagcagaacttccccttccttttccctggtgactttgttctgcaatctgataaagcaacacgttcccactgattacacacacggagcatttactctcttgattggtcaagggctctgcaggatataggcaaagccactctggtttgcaccaggttacttctgtgcatgcataacgcaaaaagctacctaccctccagatgtgacccaggtacaactcatatctaaacccatgcagtcttccctggctggtattctaagcttctattcaagcccttgtgttccccattaggtgtcctagagtttacttcccaagtgaaaattgttgctcttgaagtgtttctacccaagaccaggtgtttaatcaaatagcccatttgatgtcatgggaagattgactgtatatcacagtgctgggttcttggctgttatggcagcacttcatacctgccattaggattaagggcttaaacaagtttcaggtgcaacacctgggaacaccacagcaatgacaagtagacttgaacctggaatttgtagttttctaagatgaaatcataatattgcatttttgttctttcccaacagagtcagttgaatttgcaacagatggaaatacttccagcaaaagaaaagggtgctgttctaagggtcatgcggcgaaatgtggccttcatcccacggagtagccgcagagtgatctagcacatagaacagaactctgcagggtagtttttcttcactgggatcctaacctgtttagaaatgaaagtggccgggcgcggtggctcacgcctgtaatcctagcactttgggaggccaaggcgggcggatcacgaggtcaggagattgagaccatcccggctaacacaaaattaacaaaaaattagccgggcgtggtggcaggcgcctgtatttccagctactcgggaggctaagcaggagaatcgctcaaacctgggaggtggaggttgcagtgagccgagatcgtgccactgctctccagcctgggcaacagagtgagactccatctcaaaaaaaaaaaaaaaaaaaagaagagaaaagaaaaatgaaagttgtctgtgctcaattcataactagttttaaaactttagaatgcataggccaggagcagtggctcatgcctgtaatcccggcactttgggatgcgaaggcaggcggatcacaaggtcaggagttcgagaccggcctgaccaacatgctgaaaccccgtctctactaaaaacaaaaaaaattagccaggtgtgttggcacgcgcctgtaataccagctactaagaaggctgaggcaggagaatcgcttgaacctgggaggcggaggttgcagtgagcagagatcaagccactgtactccagcctgagtgacagagggagaccccatctcaaaaaataaaataaaataaactttagaatgcataaagatcaagagatgcttgctcaaatgctgttttctgagtcctgataattagaatccagtaggtctgggagggactcaagaatctacctgttaacaagcactcttagctaaggtcatagaggttcagtatcccttatctaaaatgcttgagactggaggtgtttcagactttggttttttgtggggggtggcagtggattttggaatatttgcatatatataatgagatatcctcaggatgacacccaagtctaaacatgaaaatcattaatgtttcatatataccttatacctatagcctgaaggtgatttatacaatgttttaaataattttgtgcatgaaacaaagtttatactttgaatcatctagcacaggtgtcactatctcatgttggcactcaaaaagttttggattttggaacatttcagattttggatttttggatgagggatgctcacctgtttcagccgggaggtttcttgacacactttgagaaataattattttaggtatagtttgacttacctttttactatgttgctttctatgaaatgtttattttgagattagatctactgcctgacttggtccagctcctaggattgttcacagatgccctgtaaaaataaaaataaaaaccaaaaaactacatttagcatcagtggaattttcctagctccacccaccctctagcttcctgctttatgcgtgttatctttttttgacctttcccttggaatccagattttgttctgtacttgctcctgtgggcttgatatttgggcatctgcctcacttccttgagttaaccatcacctgagattcaggcttatttttctctgctcagcctcagcccagccccatccattcagattctcttgcccagcctcgcttccagcagcctgagtagtatcctgcttgcctgggagggaagttcaggaaaatgtggaagtgggccaaattaattaaaagaaaaaaaaatagagatcattgatgttccaatacagcaaataaattaagtgacacccggctgcggagaggtgctttattactctttttcttagagggtttttttttttaagtcaaaaaatattttgtttccattacagatgtggtcatttttattctgtaacctaggaaaataatattaaataatattttctaatggaaaattctatgattctgtgcatctctttcagtaatccaaaaatttcagattagcccagagacactatgttttacttctgggacccttgtttctggtcatgaaatctgtgcttttttctgataatccaaagatttcccactccttgttgaagcatgaaagcagattttttcagcctagtcttctcccttccctttatgaagatgggtttatccatcctaattcaagataattaccgtggtatggaactttgcagaacactggtagtctgatagaagttagcctagtgactgattggcaggtacctagttaccaaggagaaacaaactcaggaaatcatgaaatcatgatgtaacagtattggtgcctgcactagatcctccaagctgtgtgtcagatcaatggtctggaatccacaagactgtaggtgagctcttggcaatcttactgctcactccctcattcctcattcctcctcttaacatgatttttaggaattcctagaagggtggaaaatcattgccttcccctcctctaataatgtgagcccatgcccctaatttctccaaggcagatgatgccctggggcgactctcacccttttggggacccaagtgtaaaaacattaatcccaacatcctgtcactcaaataagaagacattcattacttataaataaatggtagtggttacagtataaatgctatgtatacaaatgaagacaaactataactataggtcagtggactattgtgatctctaaggatgcctgctctttgtcaattcagtgcagtgcttgttggggagggtggtgtctcacaattagcttctggagttcaactacaagtgttctaagaaagagttagtttatgtcagtcctaggccttgacacattcatgtgagtcagttttataactttctgttcctggatgcttccctctcaactattagtccaggcaggcatgtgctaaaattacctctctaaatcttatcaagcaaagatttgttggttagactttgcccccaaaaaaatgtgtctaggagtgggtctaaaaccggtgttggccgatgttctgttcttaggaaatggagagccaggaatagaaggatctgtgttagtagttctcaaacttcagtgtgcagaagaatcacccagagagctaggttaaagggcagattaatgcaccccagattcttctggcgtagtcagtctggactgaggtttgataaaacaagcatggcatgataataatgcaggtggtctacagtctaactcggagacgcattgtattattaaatcttgtcctctgtcatttgctgcgatgctctttacctctttagactgaaaatcacagccactcttctggttacatagaacaacttactgtgataaaaaaaaaaaaaagatgaactttatcttctaggctttgaaaacggtaaatgcagtcttttgtatgtgccttcaagacacttgaaagtcactttgtggctgccacacagagatagaacaaacttagggatgcctctccccctgtttcatctcagaacgcctctctcaggactctttgtctcacccaggcacctcaaggttttggtgaaataaagcagctcttttttctcaaaaacattgttaaccctggtccgaaggtttaaaagctaggatatctgggttttttttaataccttgatagctaaactttctaaaatttctcccttcatctttgtgagcccaaatagctcgtgcacaaaagcctgtggatttccttcgatgagaactgaaatactattccctttatgctaatgttaattttcaggcagtgagcttggttaactatgagaaaataaaaactttagatggaatgcattatttatagtgaatgcaaagcatcattattatcaattcttgttacaaaatacacagaaaaaatatctttttgttatttaaatattgcatggctacattgagaaacagtacagatgttaatccacagtctctcagctgcatcctgagtaatcattattacgttttattcttatgtggaataactagtaatagactctatatttctgtatgaaattcaaatcagggaacaccaatgaattgagatgattgatattatatatacacacacataattttggaattggggacaacaatggaaatatttctctcttagagaaaatccaccaaacttgttgctttattagtgatcttgacgaataacatgtttcatttacctagatgtgccaaaaatcacttaattctttaccattgaagtgagctcacatttgaccagtacttaaatatgttttgaaaatatctgtgtaattgttaaaaatctgaaattgaaatgtaaatatctggattttgaaatatccaactttaaacacaaattttttttttaaagtgcatgtttgtgtttttttttttttttttttgagacagagtctcacagcatcgcctgggctggagttcagtggtgtgatctcggttcactggagactccgcctcccaggttcaagagattctcctgcttcagcctcccgagtggctgggattacaggcacacgccaccatgcccggctaatttttttgaatttttagtagtgatggggtttcactatgttggccaggctggtctcaaatgcctgacctcatgatccacccacctcggcctcccaaagtgctgggattacaggtgtgagccaccgcgcctggccatgtctgcgtacttttattccatgattttattttgtgtgctttcataaatcttctcttttttggttgttttaactttttattgatgtggtattttataaatggagtaaggagagacagtggtagtggtgatatgattcatgacatctttgaatgcaaattaaatgtgtaggtacatgtgtgtttatgggaaaatattcctggctgttttccctgtctttgttttttgttgttttgttttgttttgagatagcgtcttggtttgttatccaagctggagcctgctggcaatgatcatggctcactgcagccttgatccccccagatcaagccatcctcccacctcagcttcctgagtagctgggactagaggcgcatgccaccaagcccagctaattttttaatttttggtagagatagggtctccctgtgttgctcaggtttgtcttgaacccctgggctcaagcaatcctccacgcctcagcctcccagagtgctgggattccaggcttgagccacgatgcccagcctgttttcccatttttaactgataaagaatcactggcctagtctaatcttattgatttatagatgaaacacttcaggcatgtagagactaggtgattttcctgaggtcctggagttagtatttgacccaaggcattgaaactcagtccatggtctttctgaatcctcacccatctctttctcacaacaagatcgtgggccgtcctcagtccccagtaataagatagaattctgtttggtcattttgtcttcttaacttttcttctatttcaaccttagcatgaagtgctttttttttttttttgtctgagttaaatgttaaatgccttagaaattaccttaccaggcttcacctagatccccaaaccaactttattcttttttctcagcactgatgcacctgaatgaattcagtctcatcctatcacctatcaacaaaaggctggttatgaagtttttccaggatagcagttgcaattcttgcccttcaaaataatcacatataaggggactgccagttgcagggtgatatttaatataactttacatcatagcctctggtgattctatcttaaaactcatcaggcagtgcctaagtaagctaattgaatacattaaaaattgaaaaaaatacttcaaagtaaagcagattcttattgatcaccgtgtgttatatataccactgtacttggtaccacaagagatacaaaaataggtaagatacagtcatgctttcaaagagcttataatccaaacaagggaaaataaagtgtactctatgttaggtgcacttagtagaaaaagataagcgtcttgggaaatatagttttaaaattatattaaagaaaaaggttgagggtctagcagagtcttccaggaaaaagaatttgaacttgattttgaaaaacgaaaatcacttccatgggcgtaagcggcgagatgcattttgaacaatatttattgtgtgcatagtctagaagcatgtgtactcgacactgccacttaaggtatggtttgtggatcattccagtctttgaactttgttactgctccgtgacaaaataagtctcatgcatccagtttctcttattgagagaaagcacttagaaatgcatggctgtttaacatggcttcaccatccaagcacataatcagtggactcaaatcattgcacctgttatagaccagtttgggcgttactgagtcatctgtggtacaggctatgtgacatttatgcaaggtagaccatatatggcttcataagacgttgggaaaacaaagaacctagtccttcgctgcagataatgtgagaataaagactgtaggttgttctttatttgcatacatagtcattttgaggaagtgttgtgtatattagcaatacggagctgttactcattattgacttatttacagtatcgtccttgcttctttctaattttatcatctcattacagcacagaaaaaaatgttagctttatgacactagacagccatccacaatgacagtagcacaaaagggatacgggaagcacaaagtaaaggggtaggctaaagacaagcagaacaatacatagaagagagaaagggagacgtcaagcagcctgcgcctggaagttgttagtaaaattagtgaccaatgtgaaataagagggcttatattttcacttcatcataatccacagaagattaaccttcaatgggaaattttcttctagaagctgaaacacagcctgttgtgccttactattttttgttaatttctttctattattttccttatgttgttgtttcctgttgttgttcctatttggaagggattcttcattttggacattttctcttctcatttcagatgattccacactgcatggcccgatttttattcaagaaccaagtcctgtaatgttccctttggattctgaggagaaaaaagtgaagctcaattgtgaagttaaaggaaatccaaaacctcatatcaggtttgttgatgtaaaagcatgtgtttccatgcatatagtttctgttattaaaatcaacaaatacttatacaatgctggttacataaagagcttttatttatttattttattttattttattttatatatttatatttttgggaccgagttttgctcttgttgcccaggctggagtgtaatggtgtgatctcagctcaccacaacctccgcctcccaggttcaagcgattctcctgcctcagcctcccgagtagctggaattacaggcatgcaccaccacgcccggctaattttgcatttttagtaaagacagggtttctctgtgttggtcaggctggtcttgaactcccaacctcaggtgatccacctgcttcagcctcccaaagtgctgggattacaggcgtgagccaccacacccggaccaagagcttttatttatttatttatttatttatttatttatttatttagagacggagtctcgctctgtcaggagtgcagtgtgcgaccactgctcactgcaacctctgcctcccaggttcaagtgattctcctgcctcagcctcctgagtagctaggattacagatgtgtgccaccatgcccagctaatctttgtatttttagcagagacaggatttcatcatgttgaccaggctgatcttgaattcctgacctcaagagatctgctagcctgagccttctaaagtgctgggattacaagcatgagccactgtgcccagccatatttttatttttcgagacagggtctccctctgtcacccaggctgaagtggattggctcagtcttggctcactacaacctccccctcccgggttaaagggactctggcacctcagcctcctgagtagctgggattataggtttgcaccaccatgcccagctaattttggtattttcagtagagatggggtttcaccatgttggccaaactggtctcgtattcctgacctcaagtgatctgcccgcctcggcctcccaaagtgctgggattacaggcatgaaccaccacgcccagcccgtaaagagcttttagacaggcatcatagatatcctgaaagtctaaggagatgattgtttcctgaaaagctaagtacccaacctctgtttttcgtagtgctgggaattaaatatcctgattgactttctctttgaaaacattaacaattcataaccacatatatttaacttaataaacatattttaaactatatcagtaaactggcaggaaagtaagaaatgtcagaagtctacaagtaagtgggtttggaaccgaaagaagtaagctgaacaataaagacagttttcatgttaataaactacaagtatgaattgagctttggttttcatggcttcagagaacagaggtcacaagacaaagcctagacaacccacaggagaatccaacatgagaacatctcccagaataaacctgggatacaagggctacatctttacagtaaatgtgaacaagaaataagcttgacttccaaagagactcaaaagcacaggtaattgtgtctttcaaacattaaaccttagtggttctagtagcagatgaaatacaaccgaaaagaatttgtaaactgcaagataggtctgaagaaatcctccagaggcagcagaaagagacaaagggaagcaaaatactttaaaaagaaagagagaaaaaatgtctactcaggattccagaagaagcatcaagaaagactgaggcagaagcaatatttaaagagaaggctaagaattttccaaactaattgaaactttcaagccgtagctataggaagcccaatgcacttcaagcagtacaaataaaaatgaagccacatctaaaatagtgaaatggtagaacaccgagtcaaacagattatcataaaagtaaccaaacttgtaatacagatgacattcaaagagatcacaaactggcagctgacttctcaatagcaacaaaaaatcaggagacagaagataaaatattcagtacagtgagagaaactgtcaaatgtatggatagcctaaatacttcttttaaagcaaaacaaaataactacatttttaggcagacggcaaccaaaatctgactccagcagaccctcactaaaggaaattttaaaagacatacttgaggtggaagagaaatgattccagatagaagagctgagctacaagaataaataagtaaagcaaatggtaaatgttagtaattccacaaaaaaatttattgcacagaacaataaaaataataaaaagaatactgtcttgtgaagataaaaagaaaagttaaaattcatgacaacattagaaacaaatttttaaaagatgtactagacaatggattgtctatatggttaaagaaataaaattggaaccctactgcgcagcatacacaaaaatcaattccgagtgtatagaagacctaaatgggaaatttgcaatacttttaaaagcagatgggtttacatatttatgactttggggaaggaagagattttctaaatatgacagaaaaaatacaacttataaaagaaaatatttaactgtattaatattgaaaacttatgttcaatagaatatactgaaataaacaaaattacaagctgtaaacttgaagaagatttttaagtatatttgttatgggtaagggattcatatccagactatttaaagaatttccacaaacagaatgtaaaaaacaacctagtggaaacattagctaaacactttaacaagtatttctaggaaaatgaaaaccaaaaattcagtaaacataaaaagattgtcaatatcattagtgaacagaaatatataattaaaactacaacgacatactctttcaaaactaccagattgacaaatttagaaaactgacaatctgttggtgaagatgaagagcaaacagaacccttgattgaacactgctggtagcaatttaaattggtaaaagccattaaaaaaaaaaacactccctagtaaagctaaaggtgcacgtactctatgatccagtgtatatgattatgttcatagtatattcacaaatacacataacctggtatgttcgtacaaggtaacctcatacagtagtaaaaatgaatgaatgacagctgcaacaaatgggtagatctcaagaacataattttgagtaaaccagttcacagccaaatgcatagtatgtaatttcatattcataaaatttgaaagtggttgagatggagtggttgttcaaggtatagaggaagtaacagaggaagcaaaactttacccctcctctcttaggatttttcagctaagcctgagaattaaattaacataaagcagatcaaaaggagaaaaacatatttatttaatacaagttttacatggcaaggaagccttcataagaaaatgaaaacccagagatgcagttatcgttgcacatttatttactgaattggacaaagagtagtaaattgtgaaaaagtaactaagttatgtggggagctagaagaaaatattttaacaaggtctggacagagttttctctgtctcaacttcctgtccttgatggaaagaacgttactttccttctaatatagaaaggacatctttggcatggggattttatccttgctttttagaaaaagaatgaaggtgaaagtggtcgtcttgtacctgctgttttccaagtacctttttttttcccccaagtacctttaactcaaaatagtcaatataggcagggcacagtggctcacgcctgtaatcccaacactttgggaggctgaggcaggaggatggcttgaggccaggagtttgagaccaacctgggcaacatagcaagacccccatctctacaaaaataatttaaaaattagttggccatgggggtgcacacctgtagtctcagctagtcaggaggctgaggtgggaagatcgcttgagtctaggagttccaggctgcagtgagctatgattgcaccactacattccatcatgggtgacagagcaggaaccggtctctaaataaataaataaataaaagtcagtatgccagagcagcatatttttgggtggcatgctctgaactccttcaaatgataacatacatgataaaattataaagaatatcacgggaatggaaaagccaaaattaaagattataattaaccattaagaaggagtggtataatcaaagtagatacagcagacttctaaagtaataatatcacttttaaacacagatcttcattggcttatgatttttataacttacatacatcttataaatattatgcctctattcaaatttgataatgaaaaactttaacaactactatctaatattatgtaaaaaacaaatatatatgtcatagtttaggagagactggagtcatcaggtagggttctcagaagaaatgggatatgaactgagataagtaattttcaaataggcagagggtaaaggacattgtattcaagttaaaggacggcagtattagtatagtggatattattttagaatttactttacatgctcatttatccatttgttcatttatcaaacatattcattattcatccttcaaacctcaccagtgtttttcaaacagaattccagggcacatggaattggcttaaagatcaccagagaaagaaaataacagaattttcatccaagattcagcctttgcagctctactttgaactagcccatatattaggattctgaaaaatacgtcatatagacaaagtatttaaaccactctattaagcagctgcaatgtaccagtcagcatgctaggtctgagtattcaaagattaatcaactctacaacatgcttactagtactgttaatttgaggactgcctagatgtggacgtagttggagtagaatgatgtaactacaagtaaaggatgaccaagttctaggtattctggaggaaagaaagtctaattcaggatggcgaaggtagatgtcactgaagtcttcacagaaaaggagatattttaatatatttggagggtgaatggttctttcatcacatggataaggaaaagaagtgcattccagaaagtaagaaaacaacaactctctaatggaccatataattagggtgaacatgtaatttatcatctgaggtcactttttaaagcagaaggccgctgttcataattattctaggacagcaggtgtaaaccaagcacttgtcttgggcaagccagaatgaatagttactctccctagaatatattaaacccaaggctaaatcaaagatttttaaatactttgtgtagtaaagaatgcaggaagcaacggctgttaggtacacacatgatgagttaactggtccttgtttgccttgcgtagccaagtgtaaggtcagatgttagccgtaaatgaaaacacattttgcagcagaatttggcaagtgctgctttgttttcccccaaactgtgacctttaattaacattgcttttgtaacactgtgtttctagatataggagtttgccttgttatttaaagcaagcagtgaaacagaaacctattatgtttttagatttccaggaaacactgagaacaaaactttttaatcaaatgcactagcaatttattgcagtatacttcttgcctttatgcctttggcagtgtctctgtaacataatagcagactggtacctgggagctaaagcattcctcttgttgaaagaaagagcaagacaaagaatggagagatcaagtattttcagacacctttctgcctgaactttttcagtcttcaggctgaatttgagggggaagaacaagtagaagaaattccgaagtgagtctccatggggatcttcagcactaggttctctcctcagacaccgcaactgacctctcttctttgtgtttattccctcaactgagccttctcttttcattgtttcctgcccctcaattttgaaaggattgacccagacccagaaaaatttaagaagttttaacttgtgccaacttcccttatattaaacttccctaaggacatatgacattacttaatgcactcagcatccctttccagatagaagaaatgttcactcacttggtcggagtacttttgctgaggtttgtattcaactgagttggcagaaaacaaattccaagtcataaatgccctgaccttcccttagtgccaagttgacaccatcaacaaagaaagaggattttgctacagcgaatcctatagataccctcccagcaaagccacagcattttaccctccagagtgtcacagcatcggtgtttggttgtgcacaaccccactctctggagagagtggagtcgtggttcctcaaatgattcagaaatcagcttatgagactcacaaatttctcttgtcccttgggaaaatctctattggctccaaatgagcattgcctctatattaccaacacttaaaagattcctcacacattgaaagtaaattgtgaaattttcaagcgtgtttcagtatacagtgagataagaaattcagtgcaatccacattcaattggaatgaacagtgactgcattgcaataaaacttggtatagcgctttgtaatagagactcaactgcatttcggagaaagcactttattttctaaataatcccttttcgtttgctatttgtatgtaaaagcaggcgataaagtagattaatggactttctgcacagcattttagttgagatgactagtgtaggaaaacctacagaggagctctcattatgcccacaaccacttttctaaaaagactcacatggccccactcctaaattccacactctgcttgcagctcacattatgttgcgatttcctttttgagttcttagatttgtcatattaaattgctctactatcatttgaagtaagagttatggtcaagacgtgatcagctgactcaaaaaaaaaatgtctagggcagacagtcagttctagagattcatgtgcacatagagctgctagaatataacctggctgttctgtctttattatactttcttgtctgtgtcagagcacagagaattactgtggagactaaaaacattgtcagtttctaatcccaatcttcttatatacaaacacataaagaggtacctcatgtttctatttcatgctcctggtctacctttcttacctctcttgtttctaaattgttacatttcaaagacatgaataaacatgtgttgctatgtggtagtgtgctggaatgcttcataaattgtggatgttcaaagctaaaatatccagcaaagaagtgaaatatttagttaattaaattcaaccagcatttatggagcacaatgagagtgttagattttagatggctaaagtgagaatacaaaagtgatttaggtaaattatctacagtaaaagcagcattcctacataaaggagcatggacaattccgtaggagattggacaaagctttggttaatttttgttgtttttgttttgagatgaggtctcgctctgttgcccaagctggagtgcagttgcagtggtgtgaccttggctcgctgcagcctcaatctcccaggttcaagtggtcctcccacctcagcctcctgagtagctgggactacaagcatgcatgcaccaccacacctggctaaattttgtattttttgtggaggcagcgttgtgccatgttgcccaagctattctcaaattcctgggctcaagagacctgcctgcttcagcctcccgaagtgccgagattacaggcgtgagccaccgtgcttaatcatctttggttaattttgactagaaatactaaggaagacttcattgaaaggggtgtcactgcaaaatggctttgaagtgggacagaggtcttgacaaaaagaagggattacccttctgtatatttgcttttgttgataccagacatccaaaatcttgaaactaactcacgtacatttttttcatgtaaatccttttacattatgtacagacaaccacagtacccaagaatgttataagatgatacacagtgaatgtgcatgtgcacacacacaaatatttaaatggtgatttttactatttaaaggagataaggttaatggctctcattccttactctcattatggatttggatcagttttgtttgtgctgctgtatctcttaatttttaacattctggtgtgaatgctgctgtgatactcttggtaattcacaaactcctactatgctattttcgttagttaatattctgtgtaagagttgtgggggtaaacgaatcggatagtgactgagttatattagtgcaaacgttctgaagtgtttaaatgacttctgaaaggagatttggtcaagagaagctctcactctttggaatggtattggttgtaaaatgaaataaaaacaaaaacataggtcttattaccaaaacttcgctgttaaaatgtgtgggtcccactaaacctgctttactgggctaaatactctagtcacatacataggtgatccaggtagataaacagaaggacaaaaaacaaaaaacctgtctttgccccgataacctaatagcctaatctgcagtttgctgggatggttgattgatgtttgtgtgccggtggtgaaggagctcttcaaagtgatccacggttaaagcaggtttggtccccacagcagctcaagatcaatagttcctctgctttgcagccagccattgcagtcatattaaggaccaaatcaaagcaactctgctgcaatttcatcagatacttagcaatctacctggaaatagtatatgctgtcatctgtatagacctatttaaagaatgattgcaaactagaaggacttttactgaggagccccatttgaagaaagctgcacaggtgctatgagaaatctgtggcccgccttcaaaacagtgaagtgtttgtagcatcataagtagtcagaagaacattttaatgatattaaaaaaattttaatatcattgtttactttaaaagacatgctctttccatataagcacttaagatgtcaccattgctgggtagagcatttctaacttcttaatcatgctttttacaaaagtcacaaatgatttttcatgctatttatagtttttatatattttagacaattcagaaatattgattaatatgacaagactttatctactggcatttttatactataggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttgtaagtagcaattatacaatgctgcaaatgttgctttcagtttgtgtaccattataccaataagcttttatagcagtttcattttagagactagattttaattggttacatgatcatctttactctttttcacattttggaaacaattttatttgtaggataaactgtaaatctaagtgagaagatgtattcttctacttcgataaggattgagatagttgattgtatgataatttgattatatgatgctttctttatatacaaataaattcacacactgagattgacacatgtataaatttatgtaaacaacaaatttgacacccacacacacccacacacacacattttaaatagaatgtgtataagcaagcaattgaacaaattttacacacacacacacacacacacacattttaaatagaatgtgtataagcgagcaattgagctgccagtaatttagtagagtcaataagagaaatactttaacgataaaggtgagagttggaaaaaaactcagtagtcaattaatcctacaattctctaattgtttcctatttcacagagttgaaaaaatttaaagcaactgtaataatgacaaaaacatggagacaaagtgttatccacctttgatatttccagcttaaaatgtttaaaaaaacaaataaccgtgtcttaagaccaccatttaacaaaagtccatgaatatatgaaagaaagtggaatttagaaatcacaatttgaaaataaaatccataggcaagagcaattagcatacatttgggtatagccacctttgaggattgaggttcagctacatttttaagggtttatgtatttgcatgtgattatatatttccttgtgtgaaatcccaactcatatagcagtgaattttggcattagccaaaggtttcataaagtctgctggcagtaacactgtagaatattctcattaacaaaatcctctccaggaactcaacatccaatatacctaatatccagttcctaatctattaatgccatttggtggcatttttataagttgggaaatgaattttctaagtattatgtatatgcgagattccaggattattctgttagtgaatgtctcttgagatagtcttctaaatattcgtaggtgtttagaataataggagaataatatgtgtgattgaatgtaacagaaccaaagtgtttctttctcttggtttaatacaagtcttgtatctatattgattttttagtaatgacaaatcttgctaaattaatttttggaaataaccataggatcatgtactctcagagtacgggaaaatctcattatttagtaaatcttgtaattctttgaattttggatgtcatagtgtaggaaatgtttaacacagtataacaccaaaaaaaaaaaaatggagatggaaatattgtatctgggccagcgcggtggctcacgcctgtaatcccagcattttgggaggccgaggcgggcggatcacgaggtcaggagatcgagaccatcctggctaacacgatgaaaccgcgtctctactaaaaatacaaaaaattagccgggcgcagtggcaggtgcctgtagtcccagctgctcgggaggctgaggcaggagaatggcgggaacccgggaggcggagcttgcagtgagccgagatggcgccactggactccagcctgggcgacagagcgagactccgtctaaaaaaaaaaataaaaataaaaataaaaaataaaatactatacccaaacttctttattgacagcttacatttaaaaaaaaaaaattaccagctcttaagattatccttttgtaaaagaccgggcattttactaccaaaacatcagaaagatagaatctcatattcaaggacagtcatttacatagaatagtttaaccaaaacaaaaaacaaaacaaaacaaacaaacaaacaaaaagctctaccactcagttcgtggtgggttgacctgaggacctaccaggaaatggaatccactttgctcattccacttcatgtgtgatgtaggcattcctcccaccctcaaaatccttggctgatcatcatttggtttgaaaaattctagtgacagaaagttcaccaattcatcacgaggcaccctggcccacagcagactgctctacttgttcaaaaatacaaaaacaaacttgacatctctttcttaaaattgagccaaatatctcaatttctatcacattcactcccaattcttactttaaagatgctggttactcttcaaatatgtgaagatatgatcatgtcccttgtcccataattcttttcttcccaattaattaatccacagccatcttcttcacaacacactcaattatgttaattcatctattgcagccttatggaaatgcacagaattccatatatgtgtcttaacttttgcaaaggacactggggacagtagtatctcatgatgtgaacttttttcagttaatgaagctgacaataatatttatttaatcttcatttttaagtaccagccccagattgcaactttattttaaacatataatcatgtaaaatctgagaaagtatttcttataaattcctattcatccagtgctacccaaccacgttgttttattaacctaaattcagaatattgtatttacccctaataaattcatgttctgagtagtgaccctttgttccatcatatctgaaattgctttaagtcttttttttcaatcagacataatgattgttctcctagtttagtgtcagcagaaaatttgataagcatatctccattcaaataattgatataacatgttgaccaggacagggcagcatgtcactagagaatttccactaaaatgaaattaaacctttaatttaatattatttggacactcttgttcaaccagctacaaatttagccaaatatactataatcgaactccaatttcatccacgtgtttttaaagtagtgagaatctttgctaaagccttgctaaaatcaacatgtattgtttctgcaacatccagtcctacctgctccgtctgcatcgtcttgagcctttccttaaccatttatcctaaaactgccagagtaatcttttaaaaaatgtaaattagatcattccgcttccctgctttatgccttctactgtacttagaataaatctcaaactcattaccatggtctcattttaatttctcaaaaatgacaaactattttttgcaacaggatcttgatacttttgttccctctgcctgatcagcttttctcatgatctttcacacagctgacttcttatgatcctcacttctcaatttaggtatgacctcctgagagaaagtttccgtgtcaccctgtctaacataacaagcaatttccatcatttctcctcctctctgctgaccttcctccagccctctacttttacataacagtatcttctatttcacttaccagaattttttgtttttttattttttgagactgagtcttgctccgtcgccctagctggagtgcagtggtgcgacctcagctcactgcaacctccacctcctgggttcaagctattctgcctcagcctccaaagtagctgggattacaggctcacaccaccatgcccagataagttttttttttttttttgtatttttagtagagatggggtttcaccatgttggccaggctggtttcgaactcctgatctcaagtgatccacccgcctcagcctcccaacaaggtgagattacactttgcccagctcatttaccagaatttaatacaatctagaatgattgtgtatttacttttttctcatttattatttcactcctatggcagaacgtatattttaagagaactgagactatcttgtccatccttttatttcctagccatttatatgtttgaataaaggaattcctgtgttacgtgcctgttcagtaacacaacaaagaaaatatatgtataaagttaatttgagggtgatgtatttttatatacccaaacccaccctttctattcttgtaattttctggagtttatctttttgatcattgatccatagtttctagatgtttttccctatcttttgtaaattaaaagaaaatcaaaagacattgcctatattcagaattcactttcaattgattaggataaaatccttttcttcagtgaattaataaaagtgaggcaagacagtgacatcttttgaatgttactagtttctttgactccacgtattgtcatactcattgaaggaaaaaaaaatgttgctttttggccacacttactgcactataccatgcaagtgagaatatttcttcctctttaatcatacaattttatggttaaaaaagacattaaaggtctcctggcctgtatctttttaaaaatgaaattgaagattagagtaacggaattactcattgttaatacatagttaagaagctacagagccaaggaaaggcagtcttcagctcccagtttcatgcatgctggccctactttgctttagatttactctaatttatgagaaaaacaaccttcactttatttaccatgttacaattttcaaatctcatttacatactttctataattttattcagaagatagtcttataaggtagacattatttctattgattattaaaaatgttttcatgctgcttttgtgcacagaacttagtcatgtcttgtattagcatttagcatttttaagttgaattaattcacataagcaaaatttatagctaactagagatgagaccactaagaacttgctcttcctcccactttttaaagtcaatatatttaaaatagaaatccttctttgattaaataaggatagcataatttaagtcccccttgatgagatatggataagcatacattattgtaatgtaattgggagcacattttgtttttcagtctctctgcagcattaagccatcagcaatcactcccctcactgtcacttagcctactaccataccctttctaccttttagcccttctatttcacctagggctacaaatatgattgactagatcctctgtgcctggcacttaataaacttgaaataatggttgctgaatgaataggaattagacattaaagtcatcatgccatgtgtggggcataaggaatgagttgaaccactgagtcaagcacgttctgatggtcctttggagtgaattggaggtgagagcaagcattctcaccttgaggttgatacagaagacagttgacatcttaattccttataagtgtttctattggtgtggcaggcgttggcccacattaaaaggatgcttatggccaggcgcgatggctcatgcctataattccagccctttgggaggccgaggcgagtggatcacgaggtcaggagattgagaccatcctggctaacatggtgaaaccccatctctactaaaaaaatacaaaaaaaaaaattagccaggcatggtggcgggcacctgtagtcccagctactcgggaggctgaggcaggagaatggcttgaacctgggaggcagagcttgctgtgagccgagatcacaccagtgcactccagcctgggcgacagagagagactcagcgagactccgtctcaaaaaataaaaataaaaaaaataaagatgctcatgtatggaatgaatcaaacaagccctcaaagttcgcttttaccctggaaagtcagcctgagactacgcacagcttcatgaagtgtttcaaaggaaagctcctttgagcttaagcatacctccccaaccttcattcactctacactccctttcgtccaggagcaaaaccaagttgaatacttcaaaaagttcttccatagacgaataaatcagaagataaggcctaaagaggaggggatttcagttcgttatttgcacagcttaacgaaggggatgtttccagagcttgtgtctatacagaatgaagtgctatagctccatcaccctagctgcccacttttgcagcccagcatcccggtctaaatctgcttgaggatctttgtgcacagtcactcaacacagcaacttttctctgtcatataaacactgatatttattttaaaaaaataaatttcagtacacacccctacactcataaacaatacaaatcctcatttttttttaacttaggaatgtgggcttgagaagatgagatgttatattgactaagtttagagggaatcaaatgtcgttaattgttccatttcattctatgtgtcctgtgtctctagaactccagcttctcaataccactacacttcccttttaaggttgttagcaagattacattgtaaagcatatgtaaaatcccagaatcatttccaacataggaaagttatacaataactgcttctgtgtttttttgtctgttctctcttccattcccctttctgtccctccatgtcctgtctttttaaaataactatcacttacaaaaacttaattgactcatagtaactgcatgtatttatgggttacagtgtgatacttcaatacctgtatgcaatgtgtaaatgatcaaatcagagtaattagcatacgcatcacctcatgcaactaaactatcatttctttgtgttgggaacatgcaaaattctctcttctgaaaattagagtaaattggttttttgttgttttttgtttgtgtgtttgttgaggtggagtctcgctctgtcacccaggctgcagtgcagtggcacgatctcggctcactgcaacctccacctcccgggtccaagcgattttactgcctcagcctcccatgtagctgggaatacaggcgcccaccaccacgcccagctaatgtttctatttttatagagacagggtttcaccggcctcgaactcctgacctcaggtgatctgcccatctcggcctcccaaagtgctgggattacaggcgtgagccaccgtgcccagctgagtaaattgttcttaactgtagtcaccctgtggtactagagagcacaagaacttatccctcctatctagctgtaattttttgtctgttaaccagtctctccctatccttcttcctcccttccccacctctagttaccactcttctactgtctactctaattctgtcttactaaataagaccaacttatttagcttccacatacaattgagaatatgtggcattcgtctttctttgcttggcttatttcagttagcataatgtcctccagattcatccacggtgccataaatgacaggatttcattctttttatggctgaataatattccattatgtatgtatacttcattttcttgatccattcatccattgatgggcacttaggttgattccatattttggctattgtcaatagtgctgcaataaatatgaaagtgccaatatatctttgatatattgatttcctttcttttgaatatatacccagttgtggaattgctggatcacatgaataactaccattgtatacctaagtatagttgataagagcacaagccctggagtcagactccttggattcaaattcagcttctataatttcgtgagcttgaacaaggtacttttttctgccccaggttgtttacctcctttgttgtgaggatcaaatccattaataattgttaaactcctagatcattgtttagcaaatagtcagggcataataaatgttataatgtgaatactctatgttggatattatactaagcactttggaagcattattccatttagttctcaacacaacccaatgaagcacagatattacttttattttataggtgaagaacatgaaaattaatgatgtgaaataactttcaccaaggatacagcagtgggagaagggaccagcataggaacctggtcacctgagtcttgagcagatgcctgttatatggcattttacatgcatggcttcccttatgctgtgaaaaactacactttaccagtgaaatttatgttcaatccgtagatttgggtggttggtgaaatgtttcctttgtacacaaacttgaattttttgttgcattaacaatctttgatatagtaagtacatccatcatatatttgcttttgtttttaattttttagttgtaggtattcttgatgccatcatactgttgatttactgtgaacatctaaaagcataatgttacatgcaatgactatacataaatttgtggactctaattttaatataattggtttcaggttttataatgagaataattaataacaatatttctgctctaaaagttaagatgcagatttccaatttattgcaagtaggctgtaaagcattttgaatattgatattttatggtgaataactggttggtaaactgtttatccccaagcagtaaatgaaatatttgtataagcttcttactcccatatcatttctcccctacatgtgagaaagatgaactttaaatgtagattattatgaagagcttcccagagaataatcttaatatctaatgactccagattttagcctgtcaaactgattactttataaacattgtttggggccttcatcctggaattttcactttcttgtagtagttcagatctgcaaagcaaaagacttaagctactcatcatctcaggctgtagatgactgtaagtcatacataagtacttccaaattgctaatggtaaaattaaatctttgaacaaaatctggctacctgcctgctgtagggaaactggcattatcatggtcatgggcaaggtggtattattctggaggaagcaaatgggtgatatctatgcttacctctatggatacctcacttaagatgaggaaagtaactagactaatacaccattcatgccctacatctctaccctctgagcatgtgttaaggggaagggcatagaagatgaaaagtatttttaaaaaatggaaaaatggagatgttaagtgaaaggagtgcttacgtacaaaagccacttcattttggccttcctgtgacttcaagcaagcaatctatgaataaagtaactcttctgctgttgcggaatgaagtgaaaaaaaaaaaaagaaaagaaaaaattttaaaaagagagtaatgtaacacaataaatcactccattctgaggttaatttaagttagccttatcagttaagtggcaaacattttttatggtgaaaatatcaattgaataaacagcaactgattagatagtctcattgaaaaagatctttcttatgactactacagcgagccttaatctgagttctctttaactggggcacactctgacaactgtaatgatggtggtggtagtggtagtggtggtggtgatagaaaactttattaaactgagaatgtattgtattctcactgggaattttggcaacctgatttttgagcccagatccttgcttctattcacggtaattttcaaatgttcattgcttttaatatctaataactagcttatccttcatagccaatgagtaaaatgtgcagtcgatcagaacagtagctgggagtttgatacacggctaaactcataactggcctgactactttttaatttggaaagctgcttaaacaggcaaactttttttctgagcgataaaatgtggatggatgactatttagatgaataatctgtgaatatttagatcaactgaaatgtaatcaactttagaaacatttgggtatcaaaagtaaaaatatttttcaatggaaggctttgatcttcaataaaagggtaaatacttttattggaataggtagaagaagtcaaacccaaacttgctgagtttctgaaataatgatagtttctgccactgagtatagtactagacagaaagacattaatggtgataatgggtgtctattgaaaatttcacaaggtaaatcttaggagctattaaagtacagatgctagttaattgtagctattattaatagtttattatgtatactttcttttggtcatcccacagtccagtttggggactgataaaaagcagtttgtgacataagacaatcaatgaagtatagagattgctttaaattcaagaaggttctgagagtatgatatatatatgaaaattggcgaatgaaacctgatggggatccaagcaagattcatcagacttttaaaaaacatgaaggctaaaagagaacaattaatattttgtatcaccataaaaaaaccaaggtactaaaatatcactcctttttgtttcgttgttatgagtaattcagtcaacaaatattaaaataattctgatcatttttaagtttaatttttaggcactgaaggtcaacattcatgtgttgccattcggggaaaagggagaccactttctgaatgattgaaaatgtcacaattgctctaattatatcaatatccttttcttcaagaattttcatttgagaggttatggtgctgtagtacatatattttcacttgtggttaagtcagaatctaattgactaactatagtgatttgaatggtacctgctatagactgaatatttatatctccaaaatgcctatgttgaaatcctaaccccagtgtgatcatatgaggaggtggggcctttggtggtgattaggtcatgagggatctgcccttgtaaatgggatcagtgcccttataaaagtgattcctaagagctcccttgctccttctgccatgtgagtgagaaggtggcagtcagtgaaacaggaagagagccctcacaaggcaagaaatctgctagcaccttgatcttggacttcccagcctccagaactgtgagaaatacatttctgttaagtttcccagtctattgtgttatagcagccctaacagactaaaactgtaactctcaaaaaatgtgtctacctggaaactgtgaaagtgaccttatttggaaaaacggtctttccagatgtaattaagtagatgacatcttccaaaatcacccagatggaccataaattcaatatcaagtgtcctcataagagagtgaggagaaaacacaggagagaaagagactatgttaccatggaggcagagattggaatgatccagcaggggaaaccagtgattgctgaaagccaccagaagctagaagaagcagggaaagattctctcctagagccttcgaaggtgcccagcactgctgacaacttgatttcgggtatctagcttccagaactgcgagagaataaattttttttttaagccattcaatctgtggtaacttgtttgcagtggttccaggaaacaaacaggccaacatatgcacaattctttttcatttctttcctgaccactttgatcaattttttaaaaaaatctttgaatgagatcaaaatcaggtgcttttgtaacttaactgtattagggtgaaaagtattaaagaaatggcctctatcaaatgtaggattatctgtgcaagttttgtctcacactatgcattttcccctggagagcataacagagttttgaactttataaagtatgatttgaccagataatgaaatggggactgcaaaaaattcaaagggtaacctttccctttcccgggtatgtttttacctctcacttggaacagacctctgcaggccttctctgaaataggcagaattggccctttctccatagggcaatgatttgaagtgatgcggagtagtttgttggccctgagtcccgctctctggacttcttccgttttctaggtcattttccctgaattcgacctctttgtctggcactctaaagccctagaaactggctattatcacgtttagagtgtctgacctacctgtggctgtaaccgttccactgtggtctctcaagcgatgttatcgttgatgttatgacatttctagccccagaaagtccctgtgctagtgagggccagcttccgtcctcttcgcagtcagcacctttcccggagtaggctctaacataaacaaggcatttgccttctagctgtcatgtattttatgcaccatgctagctagtttttacttcatgtctataatatatattcactttagagaaaaaagtatgcgttagggttcagaggttaaatctcaaattcaagggcatcatgaaaagatgtgtgtgtttcccaagaactaaattattctgttacatatttcaccaaagattaaattccaaactagccactaaactctcagtagatggcactgaaggtaatttatccctgaaatatgtatttagggtacacactaattatgattagagtattaatttgctcctaaatacttgcattgttatctgtcattagcatttcagatttgttcatttgttcatagcctctacttttttttcccctcaaattgaatgcagtctagtgtggtaggtaatctgttagctctacctcataaaatttagattaattatatcttaaaggcccttctttatatagtcctataagtaatgtatatgttgaggtgagggagtcaacaaatggcttttcttatttctaagcgcaatgactactttcttctcaaatgctgaataatgccgaataaatgctgttaagtgataatgaatgttgataagtgctgaataaatatttgtggaataaatgaagctgaatgaaccaatgaaggaatataagagaaaccgaaatgtcttggcctttaccagcctatgaggttatatttcctcttgaatattctatttccttaaacaaagaaatagaatattctattaggaagagccctccaataaaggtgcatattccatatagtctttctcattcacctagaaaaaaactcattatgaaggtgttgcctcttactttcaacaccatacttttttttttttttttttgagacggagtctccctctgtctgctggcgtgcagtggcgggatctcggctcacctctgcctcccaggatcaaactattcgcctacctcagcttcctgagtagctgggattacaggcgcacatcaccacacgcagctgatttttgtatttttagtagagacggggtttcaccgtgttggcctggctggtcacaaactccagacctcaagtgatccacctgcctcggcctcctaaggtgctggaattacaggcgggagccaccttgcacctagccagtaccatacttttttttagtaacatctttgttaagataccataccatacaattcattcatttaaggtgtacaattcagtgatgtttagtttattcacgaagttgtacaactgtcaccactgtctaatttcagaacattttcatccccctaaagataaaacctgtaaccgttaacagtcactttctgttccttccagacctgataaccactaatctactgtctctgtggattttcctattctggacatttcatgtaaatgaaatcgtaatatatgtggccttttataacttgtttcagttatgttagcaaggttcatctgtgtcgtagtgtgtattagtacttcatttcttttttcttttttttgagatggagttttgctcttgttgcccaggctggattgcaatggtgcgatctcagctcactgcaacctctgcctcccggcttcaagctattctcctgcctcagcctcctgagtagctgggattacaggtgcctgccaccacgcccggctaatttttgtattttcagtagagacagggtttcaccatgttggtcttgaactcctgacctcaggtgatctgcccgcctcggcctcccaaagtgctgggattacagcgtgagccaccatgcctagccagtacttcatttatttttaggtctaaagaatatgcagttatatggatgtaactccattatatttacccattcatcagttgatggacgcttgggttctttttactttttagctattatgaataatgctgctatgaacattcatatacaggtttttttgcggacacatgtattttcatttctcttgggtatattcctaggagtggagtagctagtggagttactgtatgtttaacatacagtaactgggcaacagaggagactctgtctcaaaaaaaaaaaaagtatgtttaacattttgagcaactgtcaaattattttccaaattggctgtatcattttacagtcctaccaactgtatgtaaggcttataatttctccacatcctcactagcacttgctattgttggcttttttagttttagtcaacctactgagtgtgatgtgatgtctcatgtggtttagatttgcatttcccacatggctaatgatgttgaacatattcccatatgtttattggctattgctacatctttggagacacttctattcaaatcctttgctcatttttaatcctttgcccagttatcttttcattgttgaattataatatttctttgtatattcctcatacaagcgccttgtcaaatatacgatttgtaaatattttctctatttactgggttgtattttcattttcttgatggtgtcctttgaagcacagaagttttaattttggtaaaatctaatttatttttttcttttgttgcatgtgctcttgttgtcacatcaaagaaaccattgcctaatccaaggtgacaaaaacttactcctatgttttcttctaagagtttcatggtcttagctgttaaatttagctctatcacccattttgagttaatttttgtatacgttgaagtattcgttcaaaagaatgatttttttttcagattctttcttttgcacgttatcggttttaatatcatctgttgaaaagatggttctttctctcatgaatggtctggacacttttgccgaaaatcagttgacctcaaatgtaagggtttatttcagggccctcaatttcattccattgatttatatgtctgtccctaggccagtaccacactgtgttgactgctgtagctttgcagtaagttttgaaattgggaggcagctgttaatagtaccttaagatcaaagaaatatgatgctcacatcgcatgagctatggactctatcctacattccctgcaagcaaaacatactgcctttggatatgtaatataaaattcaatatcaataaattctgggctgtctgatttaggtaaccacacatttggagccctgacaatctaatccactgtttccccaaatttgaggtagaactcatttgtccttactccttttctcagggtctcagttctattgtctgcaaacaaccactcaaacaagaatgttagtgatttcctaacagcagtcactattttacaggccaggcacaatctaaatccatagagaagaaatatttttctctaggcatgaaaatcctaggagaactgttaaataagcaagaggaccatttaacattgtccagctgggctccatttctaacttttccaagaccagtggagaggtaattgctgtatatttgcataactaaaaggcccaccttgtactcgttttctaagaacaatggacactgacccaaggtttattttaaatgggcggtttttctatctctaccagagtactctgtaataaataatttctcctaaattttcttaggtctttcagtcttcctgttggccttgtacttgctattccctttatctaggaccacagaaaggctgtgaccttcagtaagtttctatacccctctgaattttgctgccttcatctattgaatggacataatgatagtatttgagaattatttaagttacatagtatccttcagagttgtgaggattaaatatgcctggtaagtgtaacctgtgtgtgtgtgtgtgtgtgtgtgtgtgtgtgtgtatttgaacaggttttcacctagtcacatgtagatgtacattaacatgtgaatgctctgatttcttatctcttttgtctgtgagtattctagtatttattatgctatatgataattacagggtatagttttgtctggctctctcactggtccacatacaccctgagaactgaattggatccatgtttttatattttacttggtattaaacattggtacatagtagatgttcagaggtttcaaacacagttggcagttgttctgtctaggatattagcttcattttactctaaccagccatttatcctacataaaattcaaggtcagtaatcacctgagatttctaagaagggattattattaattaattactgatgctgtcaagaacttgttaattctcctctatgtttgaataatcaagtacctttgggcaaatgtgctgtaaaaacttgagttatccatactcagtatggagatttcttttgtttatttttccttcttcccataaatatttaatgaataccaactggatagcaagcaatgcgttggacacagggaatgcatcaatgaactagacagatatgaagtctacatccagtagggaagacagacattgaacaagtaacctcaagtgtggtgaatgttaggaagattgaaggtcttgaaggaacgaagggcagaataagcagtagaaaagcgggaatgaagagctgacctaaaagtagtgtttgtatataaggtaatttttcaactttttaatttcaggaatacacgtgcaggtttgttacataggtaaacttgtgtcatgagggtttgttgtacagattatttcatagcccagatattaagcatagtacccattagttattttccttgatcctctccttcctcctaccctatgacctccgataggtcccagtatctgttgttcccttctatgtgtcgatgtgttctcatcatttagcttccacttataagtaagaacatgcagtgtttgattttctgttcctgcgttagtttgctaaggataatggctccatccgtgtctctgcaagggacatgatctcattgtgtatgtaccacattttctttatcagtctatcattgatgcgcttttaggttgattccgtgtctttgctattgtgaatagtactgcagtgaacatacacatgtgtgtgtctttataatagaatgatttatattcctttgggtatatacacagtaatgggaatgctgggtcgaatgacatttccatctttacatctttgagggatcgccacactgtcttccacaatgcttgaattaatttacactcccagcaatagtatataagtcttcatttttctctataaccttgccagcatctgttatttttttactttttaatatggccattctgactggtgtgaggtggtatctcattgtggttttgatttgcatttttctaatgatcagtgatgtcaagctttttttttttttttttttttttagactgagtctcgctgtgtcgcgcaggctggagtgcagtggctcgatctcagctctccacaagctccgcctcccgggttcatgccattctcccgcctcagcctcccaagtagctaggactacaggcacgtgccaccacgcccagctaattttgtttttgtatttttagtagagacggggtttcaccatgttagccaggatggtttcgatctcctgacctcgtgatccgcccacctcggcctcccaaagtgctgggattacaggcgtaagccaccacacgcagctgatgttgagcttttttatatgactgttggctgcatgtatgtcttcatttgaaaagtgtctattcatgtcttttgcccactttttaaagtggtggttttttcttgtaaatttaagttccttatagatgctagatattagaccttaatcagatacatagtttgcgaagactttctcccattctgtgtgttgtctctttactctgttgatagtttcttttgctgtgcagaagatcttcagtttaattaaatcccatttgtcaatttttgctttagttgcaattgcttttgttgtctttgtaatgaaatctttgcccgtgcctatgtcctgaatggtattgcccaggtgttgtcttccagaatttttatagttttgggttttatgtttaagtcttttatccttcagttaatttttgtgtatggtataagaaaggggtccactttcaatattctgcatatggctagccagttatcccggcaccatttattgaataaggaatcctttccccgttgtttggttttgtcaggtttgttgaaggtgagatcgttgcaggtgtgcagtcttatttctgggttctctattctgttccattggtctgtgtgtctgtttttgtaccaataccatgctgttttggttactgtgtccctatagtatagtttgaagttgggtagcatgatgcctccagctttgttattttgcttaggattgccttggctattcgggctttttttttttgttccatatgaattttaaaatagtattttagatgtttaaggagaggtataaagtggagggatacaaaaaaaagagcaagacatttcaagtgaggagaaaacatagactgtagcattcatccattcagatatttttctgagtgcctactctgtgctgggcagataaacaaagccagacccagtccctcatcttaactagttcatgttctagtatggaaggaaaatgttcatcaagtaatcacactagaaatatgtgatcaccaattgagacaaatgctaagaaaatggtagtggttctataatgtttgtgacaaaggaaattaacatagagagcattaagaaaaacttcactaagaaaatgattgtaactgagatctgaaggatcagtaaggattaaaaaggaaatgttttctagacagaaaatacagaatgtacaaaggtgctgtggtggcatagagcatggtattttcaagggattcgaagaagacctgcctgtgtggctggagggcacagagcaaggctgaatgcagcagagcagaaagtggtgggagggaggaagaaaagggaagagagtttgtcctgcattttagctcaagatttactgaggccactatgcttaagcgtgtcactttactgacttaagattaggaaaattctcatatggtcccattaagcatgctcagtgtcttgaagtctacatggtatgcaagacagtagctttctgtaagtctaatcatcagttcacacatcgtcaaccatccacctgtaacaataacaggagctaacacttctcacttgctttgcatgtaccagccattaaattaggaattctcttttttaatacttacctcaacactagacacctgtactcttgatgttcccattttacgaaggagagaactcagacataaaaaaattaaataacttgccaaacttcacacagctgggaagttgaagggctagggtatgattccaggtaatttgacttcagtacttgaattattaatcaccacactatactggctttctgatatttttactatggtgaaaatgcatttccgtcagagggaataatttgtttgagaaactcaaaactgagtttagaatttgatggtaataaaatacccagactcaatttctaaatgccgtactgtcaactaaactccacttgcatccataggtgaaaaggtgaagccgtgttttgttcttttgccagtaagtggcagtgctgagtgtagtacaaagagatagaggatagggtttcaatatcaccactcgtacttgtcgtcactgagtttctgcacggagatgaaaggatgagattgaagatgctaacgaagtcaggaaaagcccacttaaccgacagtgctagagaatggagctcaagtaatgctgatagtgctttttttccgggttaagaagacatttctcctggctccccttcctagagtatgtctcacatagttattttaagaattagaaaacatatgtgaagtacctggtctgtagtaaaaagggaaactatttgttttcctgggattagacagctaatcaaatactgctctactagcctgctgtgtatttttaattttgcttaataattttaaattattaatcatcaattaaatatgggatagctataattagatattttatatgccttagagtttttaatacctgtgaatagctgcacatataagttcctctgtcgtctttgtttctagttataaaacaggtgccctcagagagcatcctacagattgataaagcaagtgccacctggagaaacctaattccttattcaagaaatcttcatatgccaagaaatacatagcaagtaataacctaaaactgatcaaaataaatatttagtgactgtttcttcaatgatgacactgtacccacacacacagaaactaacattgttggtgctggaaaggacaaatcaccagctttgaaaatgtatcatgaacttagggatttgggcagtgggagaggaacagccttccagaatttgatcagctgtctatagcatttccaaatgaatcctactttatgatggcccttgagaaggcatccctcatcaccactctttccaaatcagagttaaagcccagagtcacaatagggcttcctttgggggtttggttcaaaatttaaatatcacctgtctctgccactctggttaatgtggccttcttcagtgactgcctctctcaatgccctgtggatttccttcacctttctcctgatcgcatctataattttatctataagtctaccttttgctttgtcagtcccactagaaactccaccagtgcttcacacacagtgttagatacattttttagataatcaggctagtccaaatgaccatcagttagtgagtggataaagaactgtggtatacatatatatgatggaataccactcaaccataaaaagagaatgagttagtggcattcgcagcaacctggatgagattggagacgattattctaagtgaagtcactcaggaatggaaaaccaaacatcgtatattttcactcataagtgggagctaagctatgaggacgcaaaggcataagaatgatacaatggaattttgggacgcggcggggaaaggtgggaagaggatgagggataaaaggctacaaattgggttcagcgtatactgcttgggtcatgggtgcaccaaaatctgacagatcaccagtaaagaacttactcatgtaaccaaataccccctgttcccccaaatcctatggaaataaaaaattaaaaattcaggagatgcaatagtagcagagcacaacgaaataacagaattaaggacacattcgccatatgtctcttttatattgagaacacagcaatattaatgaccagatgatgaccttcaacctaaactggaagttgtgtgacaaagtccatgttggtttggaagctaaaggtggaaagtgagattaaatactatagggcatggaatggtagtgacctgcaacttggagctgatgtaaggacttgataagtcaaagctcactaggatgcaatactagaaaaaatggtcttggtgtatcacatggattaagtgagattaaaagtagtttttttattagatctcaaaaaaaatataccaggctaataagtcattccatgtaaaagcgagggtgacaaagagaagctggtaagaaaggcaaccttgaaagtcttcacactttagagctaaacatgcaaaatatattcagagacaagatgaatgtgctttccttttggaagtgatattgatctggggagagggggagggtgatcttccaaagactttatttcttttgttatcaagtgattggtgtgagtgcacccttttgatcagaggtatgtagacatgcttgagtaacagctctctctctcctcttattgaactgctttttgtgattgatttttaaaataaacgaattgtttgcttcagctaatcagggactagttagtgtatcctgaaaaaggaagtttatataagtgctctttattacctttactgagtgagtgggcttttttgtttttgtttttgtttttgttttttaaattttcagttagttgccccattgacagacaatagagataacagtgagtccatggaatacctcatggtggaaaatgcacagccgattagaaaaatgttctacttgagcgtaccaaactaatcccaaacagtgaattctgatcccctttctgtctcagattttctctatgatcacgtcttacgataataagaagcaaagtctctaatggaagttcatcagtggcaacaactgtggctaacctgacaacccagcacctagtacagtgctcacaggcagctggtgttcaataaaagcttcttacatagctcaccttctcagtatttttgtgtttttttcctttaagtggttagaaggcagaatttaaaatattgtcacatagcagtgggcgtgtaaggtcatctgctgtttgccaaccaaatggtgaggctagaaaacatttgcatataaatgttacatttggttgaggcttttaaattacagaaatgtaggtaaaatggtcagagtggcagttagagatgaacaaatgttttacatctgtggagccttcatatttattgctttgagtgtcattgccatttcctgctggaaattaaacatcacaaatgtatccttcatttgaccaggtggcctcgatgcttctgaaatgaatggcgaatccggtaatataaattgtaatcacatcacaagcatcttcctcttaaccttggtaatgatgtgaaatagtgcattttaagcttgttttgaaggttaagcaggaaatcttatcttggataattaatatttcaacaaaaatcaatgtggctacagttagcaggtaggtaatctgactaattggctcaatattaaatttgttaactacaaattgtctttcagctgaaattgtattggtagaaacaaggaaattggtgaagtatttactagatttgtagcacagtcttgttcagcttgctgtagagagcttgtgatttaaacatggtggaccaatgggagctcattctccagccacctccacagcagtcctgatgacttcccctatctactttataatggcacttaggctgaggcaggaacatttcctcaggaaattgtcaccgtgtccacagaaagtgggttggtcctctgtgtctactgcttcactttctccttaataatccaagccagcactttatgccttgaaaaaaataactaatagttaagttgtctatatcgttttcctttttagaaagtactttcaaatctgttttatcttttagtctttacaaaggcctgtgaggtatgatttatcatcatcaccatccccatcttacacatgtagaatgtgaagctcagaaataggaagtgacttcctcaagttcgtgatcccattaagggacagatccgaggatcaaaacccagacttttgacttcaagtcttgaagtcttttcattgtaccatatcttcatttaaaatggggtccaccctgaagccaaagaaacacatccttactagtaggtatctgacatttgtcttattttgtgaaaaagatattttgggagcacaccttcaaatgctggttcccaaaacttacctatactgaaatttccaccagtctacgcaaatatgcactacattattaaaataaggtggccaggcacggtggctcacacgtgtaatcccagcactttgggaggccgaggcgggcagatcatgaggtcaggagttcaagaccagcctggccaatatggtgaaaccccatctctactaaaaatacaaaaacaattagtcgggcgtggtggcgcacacctgtagtcctagctatcctggtggctgaggcagaagaatcacttgaacccgggaggcagaggttgccatgagccgagattgtgccactgcactccagcctgggcaacagagtgagactctgtctcaaaaaaaaaaaaaacagaaacaaaacaaaaggcagtgtttagtcaattaaaggacagtttttctgttgatactatctttctgtaatttttcacgttgaaaagttctgtcttttatgtattgatgatggtagaaaattgtggtggtactggtggtaacttttagtatccatagttagaaacacctatgttggtttcacacacatctcatatttccccttaaaattctattgctccattaaatccaacactctgtaaaccaggattttaaaaaacaacatacagatgatagaatgggtggcaagtaaaaatgcttcttgcctgcagcacaggcccttagaaatcatcagcggagccaagggtctacaacaagcagatcaaaaatagcagcaagacaggctaactatcttcaggaatcaatgccagcctcttatggcattccctagaggccatctcttgggccttggcacctgtgctagtttcatggttagattagttatgtcctgttgctgaagaacaaggagtgacttctcttccatctctctctgtctctttttgtttgtttgtttgtttgttttttttttttgagacgaagtgtcactctcttgcccaagctggagtgcaatggcgtgatctcagctcactgcaacctccaactccctggttcaagcaattctactgcctcagcctcccgagtagctgggactacaggcacgcgtcatcatgcccggctaacgtttgtatttttagtagagacggggtttcactatgttggccaagctggtcttgaactcctgacctcgtgatccgcctgcctcagcctcccaaagtgctgggattacaggcgtgagccaccgtttccggccctcttccatctctttctatttagctttggaggaaaatgttagagatttaaaaccatttgctataaggcagtattgccttttgcacacacaaaccttccctggtgggggagggccaagggccctcagcttccttcatcccaagagaggaagtgcattgttataaaatccctcatcagtctggctctaccaaagaaaaggtatcataaaagcttcagatctctgcaaaatagtgtctctttttctacagatctttcttgcctggcttctacacatgcatcactgcactgacccgtaaggattaaggaaagtaaacaaacagaaactatccagggctagagataatcagtggaccaggctgagcaaaggaatgtaaatctaagtgtcatgtggctaagaactgctgtttgaaaagctgacgcagtgggaatagcaagagttgacaggcaatgcttagtgtatggtgagatgctcagtgtgagaccagttaccatttgaggcatagctcaggggctctgctaccaagcatggcagataactcccagaaacacacacaatgcatatccaggtgatagtaacaatgtgttttactgtgttttcctcattttttggtttgcttttctattaaaaattcagagaggggtgcatatgtgcttgaaaaatactgtttccccttcactggtagtgtctagcatccctgagtggtctgaaatggaaagagcaacatggagcctcatgcatcttcacagagatttgtttccaaagtcagcacttaaagcaaaatgactgtcattaaagttaccctcagaattctcttaagttggaagtatacatacccatgggagataggcatgccacctctcccccgaggatggaacagacaagtaattgtttctttggttgaaaagcaggtgaagaattaacttaagtttagagccacattgcatgagaagtgggtatctttaaatactctacaacatgggaaggtactctctctatgtgaagccagtgaaaattgaaactgaaaaataaaagagatttgggtccctcatctctaatgcagtgttggaaactgatcaagcaagccacatggtgggcagaattacccacactatttacatggctacctcttctctctcacacatatcactccaatatgtgacctctggcaaatcattctacctctctgagtctcagtttcattctctgtataatggggatgatgtgagtatcaatggccattttaaggaccaattgagacaaagtatgttgacatattttcttccaattatgtaaatgtcttatataaaataaggcatgctttattgaaagaagataatagaaaaagatctaaagaaaaaaatctgaaaggagtaaaaataaataaggaagatcttgtactttagtggaagagaaagacatacagtattaattccaggatattatgtggtaaatgaaaagacagcagtgtgcacagtatgtaatgaaaacatggagaagcaatatgtaatccgtcctggggtacacagtaggctccccaagagagacagtgactgagcagagtcttgacagatggttgatagttaaagaggccaagagagctggcagggtgtttcatgcgacaagaacagcaaagcctgaatcttcatggatatgcacgggacatggaaacattccatgtttcaaggttgtcaaatatgaactggagagtgggaggctacaaggggagagagagagagctaaggcggggagatgatggaggaccttgtttgacatggtaatgagctttagctaatcttttggtggctgacgatctcaaagggttttaagccagcagagtggtataaccaggtttgcattttagaacttgattactgtggcttcattttggaatgggcatttaaggcactaggataccagcatctggaaaaacaggaaggctttccaatatcgcaggcaagaaataataagagtctatcctaagacaaaggcagtgaaagtagaggaggcatatttgaaaaatacttttgtggtgaaatcgtcaaggttcgttggatggtttgggtgaaggtagggacggagactgagagtaaagagtacagaaagaaagaaaaaaaagatcatagaatgactttaaagtctaatgtcttggatggtggggtatcattgactaactttggaatcaggttagggttggagattaagaggtggcaaatttactttaagacataccaagttgtgtgatttatcacacaaacctggattcttatgagtgtgaaaagtgccactgtcaataattttgccaggacaataaatgtaaacctcaattatttcaggaaaactagaatgtaaagtcaccttatctgtaggatactcagcagttgaatatatgagaaatactacatcgatagggctgaaggtttacagtaaatagacatgaacataaagattagattttaaatcatgagaatgtataagatcatccaaaaaagagagaaaagcaaaggcaccttggtgaaaactagtgtttgaagggtaggtgaagttgaaagagccctcaaaagagactaagagggaggaagagaagagataggaatcaggagaggatagagagcagatattttcaggaagcagttgaaaatgtccagtacaacagagaaatcagataagataaggattgaaaaatgcccactggatctggcaacatggaattgacttttgccagagcggtttcatgggagatctgaggccagtatccagatagtggggttgtagagtaataagctttagttaatcttttggtggggggggttgcagagtaaatgggaagtcaagaagtagagaaagcaagggtatacctgaagaaggaaagagaaagagaagtgcacagctgaagggagtgtagagtcaaagaagtgttgctttatatattttttcaggttgacaaaatttttgtatattttaataggctgaaagagaaagtttaaagacacaaggtttattaataagttggtagtagtactgacttgttagatataaagtttgtacaagttttattcaatgatatattaacttatttaagttttgttttacattttgctctgataagtagtgggtagggaagggaatccaacattcttacggggtactttccataacacactgattgcagcatggagaacacttggcaactggaggaagacctcagaaaagtaatgcatgtaggattctagaggaagatgagactaggtgttcggttgggttcctgctcctgaatttgtgcagtaaggccgaaattccttactgtagacagatttccttgtctatggatggcaactatgtcaccttttctaaacaccctgtgggcattacaggcttagggggttaccaaactctggcactgagtaataatgaagccttcatctcaatgtagtagacttttttttttttttttgagacggagtctccctctgtctcccaggctggagtacagtggcatgatctggctcactgtaaactccgcctcccaggttcaagcaattcacctgcctcagtctcccaagtaactggaattataggcacccgccaccacatctggctaagttttatatttttagtacagacaggatttcaccctgttggccaggctggtctcgaactttggacctcaagtgatccacttgcctcaacctcccaaagtgctggcattacaggcataagccaccatgcccagcctcgatttagtagacttttgaccaagacaaatattagtccagaaaagatagatcaggccgggtgcagtggctcacacctgtagtcccagttacccgggaggctgaggcaagaggatagcttgaacctgggaggtggaggttgcagtgagccaagattgcaccactgcaccccagcctgagtgacagagcgagactccatctcaaaacaaaaacaaaaacaaaaaaaagaaaagatatgtcagctgcattacccccaccccaatctccatttcatctgccaatcttcttgccttctgatcaacctacctttcctaccgccattgttccttctctcttccacgtcacttttatgttatggtatctcacttatctcctctactttcaaagtaaccaaacacttttctttccttgtgtgcatcaaaatgaaggagggacccatttcctctacaaataattgactgaaaaataatggttgctcttcactccattagctcctgtgaactttagaaaacaattgatagcttatgtattttcagttttggaaaaccttcaagaatagctgaactttggaactgcatactagacctagcaggatgggacagcaaatagaataacactccttcaggctagtgagtgtctctttgttttcatttggaaagactgcaggaggatgactgttacagcagttttggaaccattgtgtaactgtatcccacgagacaacatcatttggtttcaagatgtttatttaatactgttttcttatttgtattaaccatcaacaacataaagcagatgcacattgaggctgtttacaaaatagcctgttgtacttgcaagatttccaggattcttatgtcaattccctttcaaccatagcctgaacagtcctcttctttggaagcacggacagcgatttcagcttcgcaaaaggctagttgtgcttataacgttcacccagcagcctgctggtgctctttattcatcatatgctctgtgggacagtcatgactttccagcagacataagtgatggtttgcttttgcatcttaaaggcattaatcttgtatgatctgatccatatgctttgtacagtgactgtaacaattaaatgttcacatggactcttttagggaattgcattggcttatttcagaattcaaatactgcttagtgtttttatttccagccagttcattcttatgaatctgttttcaagcctcatctcttctcctcccgtgttctcccaccatggccctcttccccatgcaaaactcctctgtacatagagttcctatggaaacataccatgtctgaccaccctctaggaagttgttgcccatcatttaatctctctttatttgattttattattcttattatttttctttgagacagagtctcactctggagtgcagtggcacgatctcggcccactgcaacctctgcctcccaagttcaagtgattctcatgcctcagcctccagagtagctgggagtacaagtgcgcaccaccacagccagctaattttttgtgtttttaatagagatgggattttaccatgttggccaggctggtcttgaattgctggcctcaagtgatctgcctgccttagcctcccaaactgctgagatgacagatgtgagccaccacacccagcccatttaatttctgtaatataatgttttaaaactttgcaacagagcagttattatcactctttgattatctattttttgtcttttttactaagctattgtctgtcttcttcactacaatatgagctccatgagggcgggaaccttttataatatattcggtgctataataccaacacctagcattggacctgacccatatatgcagttaacatatatttgttgattgaagtattgctcttcagcccgaactgaccccttcttcctttgcgctttgcattttatacatacttatgtcatagcatatttattgcatgtgtcaaccttaataaccggattcaagtgaaatgattattgaacttatttgaacacaaagtttgaggatggccacccagaaggacacagactctaaaagagtggagtcatggctccaaagtggggagatttgagggcccctcttatattggcaaggtctggggaagatgagcaggattacatcattttccatacaggattggtgaatagttaacagcaatttgattggttataagtgtttctttttttttttttttttttggaaagaatataagtgtttcttttttttttctttttggaaagaatatttaggtatatttaatattccacatgaaggatgtaatagtcaaagggtctgttgtctcagtcaaggggtcctctatctcagggccatctcctctgagccaggaataaggaaataaggtaggaaattaatctataacagaaagtcagtaattaagaggtcaagctctgtgacttgatctccaaagtcaacattcctcagggcctaatagatagactatccattttcttttacacgtgaatttgtgtgacatgccctctactcttggtagaattggtagactgtaaacttcttgaggaaagggactgtgtcttcctcctctttggttccctgggtcccagcacagagcttgttattaagtcaatgatcaataaatatttgttgattacctataggttcctcttgattaaatttaactgcactaaattttatgtaataagtttttgctgagcccgtagagtacaaagtcctcagttacaaatgtgggctaaatggaaacagacatacccccttcattcaaacatcttatgtatcttaggtatacgatgcagagactctgtgtgagggtgggtatgcatataaaatacattgaaaatccctaatttgtattccaggagagacaccatgcatctttttgttttgttttgttttgttttgtttttaagacagactctcactttattgcccaggctggagcgcagtggctcaatcttggttcactgcaacctctgcctcccaggttcaggcaattctcctgccttagcctcccaagcagcagggattctaggcgcccaccaccacgcccagctaacatctttgaatttaaggatcctttgtgctttcaggaaaatcacatttgtgttttatggtatttaaacagaaattagtataacccatgattaatacccctaacatgagggaaactataagactactcaatattccatatctatctcaggttaattatgcttcccccactaaatttagtaaagaaagatggaaaacaatgagagttactcttacccatctacggctctccaactaatacttctaagagtgtgtttgtaggctctatcagggaatatatttgctcttatgttttcgactgaataaagatttgctttagctaatgtacctggcatggattacccatccaacatcaggtcaagtgaccttaccctctctggtagcagcaaaggacaaaagaccaatcaaggcaccagatcctccagttactataaactgagtcaccttaaaagtagccaggagagtaggctttgctgttctgccacacagcatgtaacaagaaaaatggagtcatgaattcttggtttatttgggaggtatctcacgcaagataccctcaagtggccagttctaatgtatgtccttttacctaggacacaaattctttccaatatggccagcatatttctccaaacatgcataaccaaataattgtatccttttctctgtgaaagtttttaaaagatatatttctcttttattgacttaacctattactatgtctttgtattataatccaatagttttgtttctcagtagacagtaccttcctaaattttaagaaataactgctgggtgcggtggctcatgcctgtaatgccagcactttgggaggccgaggtgggcggatcatgaggtcaggagatcgaggccatcctggctaacacggtgaaaccccgtctctactaaaaatacaaaaaattagccgggcgtggtggcgggcgcctgtagtcccagctactcaggaggctgaggcaggagaatggcgggaacccaggaagcggagcttgtggtgagccgagatcgcgccactgcactccagcctgggcgacagagcgagactccgtctcaaataaataaataaataaataaataaataaataaataaataaaataaagaaataactgtcccagaaatattttgtgttatccatgtatgtataagagaaaaccatgatacaattgttttaaagatcttgaggtaaattacagaatagtattcctgtaggccaaaaaattaaattatgttctcaaaacatgagccactcatgattttttaaaagcaagttctcaccagaaaatcacctaagctctaagacccaaagccactcaaatttcactactgtttttctctgtttacagcatatagaactctttaaaattcctattgctctcactcatattcattataaaaattttaatttactctaaccatgactacattcagtaagtgctgtttcagacaggaaatggaactattatagtgatgaactcctttctcctagttattaaaggaatctgttcttatcatactgattccatccaacttattataatgcatgaaataaccaattcagtgggttcagcataatgggggagagaggggaagaaaacaacacacataataatagctgacttttaatgagaattctttagggctttcaccaagcagatccaaaataatttatcttatgataatatcaaaagcaaattactcacaagattatactgttaaggactgtcacaatattcccagggctgtaatgctgtctcttacagttttagaaccaactttataacttttgctattagttgctaagaaacaaattataattgcagctcagactctttactgtgttagcctcttaatgccccatagtagcatttatttccttcagatgatgaaatgatcaacaaagtaattgttttatatatagctgacaatgaaagcattttcaggaagcaagccacgtttttatgatttttatctggtggggggagggtagttagagcaatgattttaataacatcacgatgttgaaatggcttgaatcttagaccaatatttaatggcttccttttcaggttgtggtgttgtttgttttgtttgtttgtttgtttgtttgtttttgttggttcgtttgtgacagggtcactctgtcgcccaggcttgagtgcaatggtgcgatctcggctcaggtgcacaccatgacacctagctaatttttttatttttgtagaggctgggtttcaccatgttgcccaggctggtcttgaattcctgggctcaagcaatcttcctgccttggcctcccaaagtgctgggattacaggcatgagccacagttggttattacttagaaatcaattttattttattttttagttattatgttggatggaaagagaggttgaagagtagaaactttggagtgagactaataagagtttgaatggtagctctatcacttactagatgtgatgaactttgtgtaagtcatttaatttcctcaaaagcttagtgttcccttctgaatattaaaatgaagatattaatacataccttgtgacatcacatgggcaataaacaggataatgtatttgaagtatctagaagccatacaataagtggtggtggtgatttgtatgattgttaagtcctaaaatgagggggaaaattcttaggatatccttaaaagccttcataaagataattggctaatagagtagagtagcaatacgttatttcaaattagtacactattgactctcaagaattcataccaacgtcagatagtgacataagaaatttgttaatttattcatttatttgaagaactaactgaccattatcattttaagtactcactgataaaaggataaaagtagtggggaggtcttaatcccacagctgtaatgggcaacatgtgatcaaagagaaaaagttagtgtgtatatctgatgtgtactctgacccaacagatgttacatataagaataagataaaactagttgtcctgcaaatctacattgtgagggccaaatgttgaaacagaatgatataaagtatttccaatttagctgtagtaagcaccacagtttttattactaatgccttttctggtacgagacatttagtgtttgactgcatggacctttacagtataggagatcatgtgtgcctgttggcctctgtggaatggattccttgccctctcagccctgttcccctaaaaacatgtttaaaatctctaaaaggctctggatcttccaactctcaatatagaggcatgttctcttttatgcattttctctttggcttccacataagaataaaagactatatattttttaagtagtttctccagaaaataatctggattttaagcttctcttaaagacatggaatttctggcaaccatgtctgccattgagttcctccacatggatttgttcttctactactttgatcttacatgtaatatgcaatcacgctagcctacctcactcatctaacttttgtttctgacccttaagggcaagtgggtttgtagtccttgctattccccagtacatacgcatgcccttaaaattccacgcccgtatggatgaaaaaatgccactttaatatctataataatacattttcatttcctgagaggtaaagttgtgatgctgttggtcatagagaattaaattatctttagcatccctgcattatacgttttagatattgtgaattcgttgctgattgtaaatatctctcacaattccaaacccaagttaagtagaatattttgttctacatttaaataccacttgagcacatgagactgttctgggaactctaggaaagcaggaggcaaatcaactatggtcctgccaaaaatctcaaagcagtagaaatgggaaaaataaaaagaaatatacatggagtggtgaggttcaaatgaaaaggaaagaaaccaacaaacatgccctaagaccagttgaaacagtgtatccacctaaacgaggaataaagatgcttttcatcttaattccagaaagctcaaactcactgaattcaataaataccatttatagtctttattcatctatattcttcattcctccttttgaaactatggagaaaatagttggccatcttgcaggtttatcatcattaacaaatcaaatgtaaaatgctttgcaaagtttttaaaaaatgggaaaaagagcaagcataatactatgctgtgaatgagatctaagctgtatgctaaggatatatgcgtgagtgagcaatgtcaacgaagagtcaaactctttgaagagatattatttgaatgttaatatattaattgaaatacttgaggagatatattctgagccacatataggtgactatggcctgtgacacagccctcaggaggtcctgagaacatgtgcccaagtggtcggggtgcagcttgcttttatacattttagggagacatgagacatcaatcaaatacatttaagaaatacattgtattcctccagaaaggcaggacagctcaaaggtggggggtgcttccaggctttgggtaaattttttttttttttttttttttttttgagacggagtgtcgctctgtcgcccaggctggagggcagtagcgcgatctctgctcactgcaacctccgcctcccgggttcccgccattctcctgcctcagcctcccgagtagctgggactgcaggcgcccgcaccacgcccggctaattttttgtatttttagtagagacggggcttcaccgtgttagccaggatggtctcgatctcctgacctcgtgatccccccgcctcggcctcccaaagtgctgagattacaggcatgagccaccggtaaatttaaacaatataaaggaatgtctgggttgccataagaggttgtggagaccagttttattatgcagatgaagcttttagctagcaggcttcagaaagaacaggctgtaaaatgtttcttatcagactgaagtctgtgttgatgttaatggcggagaggtataaagagtataaagaggcatgtctgaccccagcttcccttcttggcctgaatcagtctttcaggttacgttttaagagccctggttgaggaggaagtccatttagatggtaggtgggggggggccttagaattttatttgtggtttatagcaagatacctctgcatgctgtatgaaccctttcagtctgccttccatgattgcatcttttcactaaagagcttcctagtggcgatgaagacttgaaaatgtaatacatacccataactgattcctaccttcttattctgtgtgtgtgtgtgtgtgtgtgtgtgtgtgtgtgtgtgtgtgtgtgtgtgttttaatgggaaggaaaccacagtttctaaatggtcccaccttccttattaacaaagaattagcataagtcccagaacattatagctgtttctctaagaagttgtgatataccaccgggcgaacaggagaccaggtgtcatgattcagtttggggatcgaaaactagtaacaacttcactttgaaaatcttttcagtgcccattccctggggctttcaggctaagctactgcttttatttctctgctatttaatgtataacaaaagaaaaagaaggcatgtatcctggagccctgtggtgaggaaaagcaacttaatgtttatgaagtgctttcaaggggatcataatcttaggaccaatgagtaacccggaatgagttttgtgtttctcttgggtctcctggcctgatccataaatttacttagctatgtcagggatcctagagaatactggtccagttccctaactttagaggtgaggagtgccagtgcggtggcttacgcctgtaatcacagcactttgggaggcagacgtgggaggatcacttgaggccaggagttcaggaccagcctgggcaacacagtgagattttctctctactaatttttttttttttttaaattagcaggacatagtggtggtacatgtctgtagtcctagctactcaggaagctgaggtgggaggatcacttgagcccagcagatggaggctgcagtgagccataccatgtcactgcactccagcctgggtgactaagcaagattctgtctcgaaaaaataaataaaaataaaggtaaggcagattgaggccttagagataattcgtcttgaaaaaggtcacagcagttagctgcagtctgaatgctattattaggacttcctgtccctctccacactatacctattgttttcacagggtgtctctcctttatctccagaggcagttcattggattatcactgggatcaatggatcagaaggaataagggggtgaagtaggagccaaaggaagtagttagaaactaattgtgttttttctcagcaggattcaggctttttctcagcaggatccagcttttaaactttttaacttctaaacttttctctagagtaattgaaactaacagtattttagtggtgaaatgtttgcagtgcttagaaaaatctcgaacaaatttcatgtctctcatgttataaaacagcatttgaactcaagactatagaagagttgtaacgtaaagacgaatccattttcggcattttgaaatatcatttgatcactgcaggctaattgctgctgttcctaatccaccaggttgacacttaatgaatgttcatgatgaatccgttctttagttagttgaaccctataattttcttgcttcgttttcaatttacaatatttgtaataaaggtgccatgcataattccctaggaaaggtcaatatactcttttattaaccataagcctttctggtcttctgggtgtatatttgtcagggaatagactattcttttatgatttcaaatgttagattgtacagattggttatctttactatattacctgctgaaatttctacatatagacatttagaaaattgggataatagcaaccagccttttttactattctttcaggaatgagaaactcaaacgtgtgtggggaccgggtatgtaacatgaatgagtgaacggggaatggatacaaggccaaaagagacaggtggatattatggtagactggagctcatgtgttctcccttaccgcctatactgttttgaaaacaatttaatcattatgctaggcaaacacaacacattttgggctgattttctcaactttgtttattgcgcacctccacatccgtttgatcttcgaaacacaatatagggagaatataattagacccttttttcagatgaggaaactgagttttagagaagttaaggtctttgcctgaagtcatacaactaagaagtggtagaaataatattcaaagttaaaccatactctgatgcctgtaaaaccaaaactgcactctaaggaaagaaagatcatgtgatgaatgcagttcttttcagcactgaaagaacatcaagctggaagttaagttaaataatgtgggagcattacagtcacctagaaaaagcagagttgtggtggccgacctggctggattaaaatcccagctgtgcttgtcacctgacagccatctcactttgagcaagtatttaatctctgaacttcatttccccctctgataaaagagataatatgactcacctgaccagatggttttaagaattcaataccatggctcatagaaggtattcaataagcgctagttccctttctcctacagaagtaagtgctggtatgagtatagggaagattttaaactaatgagttctttctttttgagtacttggataattatacttgagtagttcctgcttggatatactctgaaaacttggccttcttggccctggacaccctaaccccctgcagtcttatttattcattcttctagtcaaagacatgggcaagtacatgtgttctatttgtatataagtacacatttgtacatgcgtacacacacacacacacacacacacatatatatagagagagagagagagagagagatttaatatgataaattggcttacatgattatggagtatgaagtcccatgaccttctgcctgcaaggtagaaacctaggaaagctggtgttataattccagtccaagtctgaatgcttgagaaccaggggtgctgatagtgtaaattccaggccaagggcaggagaagagcaatatctgagctcagtaggcaggcaggaagcaaaaggagtgaattcctcttcctctttcattctactcaggccttcagtggattgaatgatgccaaccacatagttggggggcagtctaccttgctgagtccactgattgcaatgctgacctcatctggaagcaccattacaacacatccagaaataatgtttaagctttgcactccttggcccaaattaacatataaaactaataatcacaaatgtttaacacaaacaagttacagtgaaaatacaactggttttgtgatagatgggaactggaaggaaactcgacaatgagtggtcaggaaaacccctcagatggcaggattacattgcataatttgtgctaccaccccatgtggcggctctgctgaagtgatacggacaggagacagggatatactgggtagaagggcagtccctagtgagggccacaccctcaagcctggactcatggcccaaagtgagaacatgccttcctgttttcccacccacatgttgcctttcccagaaccaccctggcccacgctgcccccccccgcccccccatcctgtacccataaaaaccgcagaccccactggcagagcagagaggcgtggcagaggagagaagaggtgtccgaacgttgagaggtgaagaaccagctgggcatcggagactacaatcggagaggatttgggctggggatggttagagaggagtttgtcagccgaactccaggggaagacaacccttcccctccatcccctttccagcccccgcttcctgctgggagccactttcattggcagtaaaagcctccacattcaccaccctccaatttgtttgtatgacctcattcctcctggatgctggacaaggacctgagtgcaggtgcaagaggctgtcacactgaccctccactgagttgttttaacacttaaagtgtccacggacagcaaagctaaaagagcacactgtaacacataccttccggggctccggggccacaggcaacccctagatgctacagcggttctgcacagagtgttgctcctgccagttgcccagaagtgcttgtcccagcctctgcacctgcttacctgcgtgctccctcaccctcaacgggttaagatctgtgggctgcgtaagcaagctaccccttcacaagtcctgtgaagggatcaagggaactgccccatttcaatttgagtttagacctgaaagacaagaaaatgattctcacccctcaccaccatctcctgattacctgaaataatgaacagtgttggtaactatcaaaacccatctctatcattttaaaagtcattatcatgttctggaaatttttttaaaaagcttctactggagccaagagtggctcagctttcaagaaagaatggtttttgctcatgattttctgtattttaaaattattagatccatttctgtgaagtgcaattgaatggtatagtgaccaccatcacaggtcagggagagcagcttttcaggagagtgaaatctggtgtcactcttgaggccaaaaataaaatattaacctcaaatgcagtaagtaacctcagtaatttatacaaatggttctattttttatttgaactattgtttcttggcactcattcatgcaaaaactgggttagaaattggtatagttggttcatgctatgaacatacagtttgatcttaatagttaagaggaataacaaaaacttgaaggtattttaagaaaatcggccaggcgcggtggctcatacctgtaaacccagcactttgggaggccgaggcgggtggatcacctgaggtcaggagttcaagaccagcctggccaatatggcgaaaccctgtctctattaaaaatacaaaaacagccagtcgtggtggcgggcgcctgtagtcccagctacttgggaggctgaggcaggagaatcacttgagtccaggaggtggaggttgcagtgagccgagatcatgccactgctctccagcctgggcagcagagcgagactccgcctcaaaaaaacatacataaataaaataaaataaatataaaaggcatctgaccaaaattagtttaccacttaaggagtaaaccgaggagatatatagtgatcattacataccggaattattgctataaaagccatagtgtttatttggtcagtgtccgaactttttacaaggtaataatagaggaagaagaatcctgtaatgactgaattgcattttctggaattggattccctgaattcagatttagtctagttcacttaccagctatttaaccacagtcacgttatttaacttctctgagtctttttcctcatctgtaaaacagggatgcaatagcgcatactttgttggttcattaggttagctcatgcacaaagtgtacttatcacacagtcctgccatattgttttgtgggtttttgttttttttttttttgaggcagggtcttgctctgttgcccaggctagagtgcagtggtgcgatcttggctcactgcaacctctgcctcccaggttcaagtgattctcctgcctctgcctcctgaacagctgtgattacaggcatccgccaccacgcctggctaaattttgtatttttagtagagacggggcttcaccatgttggccaggctggtttcaaactcctgacctcagatgatctgcccacctcggcctctcaaagtgctcggattaccgtgcccggcctatagtattaataataatatataatgtaatcataagagtaacaactatataccatcacatcatcatcataacagaaatagctaatgtgtattgggtacttaccatgtaccaggcatagttctaagcattaatttcaagtggacatttgggaagagagaagtaattcaggcacccaagggaaatggatttttgaaatgtgaattgtcttctgtgtcctgtggccttccattttgcagacacccactcatttcactgtatgatataatttggaattatttaacccaatggaatataaactgatggaatgtgtattacttcatactatcatgataaaatagaatttggagatagaaataattgatctctcatatgacacaactgcccattcacaacattcttactgaattaagatgttcaaaagcaaactttaaaaaatacatacgtaaggatctatgatatgataatttttaaatactattatttggctaagtattctccacaatctttggaaaaatatactgtcttgttaaattcttttccaattaaattgtaatcccataaagactcctattctaaaggtcaaattaaaaagcatttatcctcagaggctctaaaaaacagtcattagaatgccaacccttaaatggaaacaccattaagctcaatagctgaatagcttttattagaattacccaatccccctagccagccctgcaaccctgctgacaccccagggcctgcaggagaggataacctctgtatttgtttaagaaatgacaagaaaaattttcttttttaaagatataacagtcaaagactttggtctttacatagatgagcatatcaatcttctaagagacacaaaaacagaaaaaaagttctgattctatctgtctttttttttctcctgatgcttttaaggattcccctgtattttattttctctttatgcctttgaggatttcctctggggctctacataatcaggtggatctttaccatgtagatgctgcattcagtcttaatgaaatgatctcgggagccctaggaatttgcctgaccattcaaaataagcatagcaaatgaaatactggtctctagaaccagattgtggaggttgaaattttgacttctcctattacctgtgtgtctctgggaaggtcctttactctgaatctgttttctcacctgtaaaacagtaattcctaatccaaggagcacttgcaagaattgaagatatgacacatgtaaagtgtggaattatgtttagttattattatgcaccctcattattaggaaattgccatgcctgagaaggcttagccctgacctagttgccaaagtggatgcaactcagatttctttttttcttttgagacagagtcttgctctattgcccaggctggagtgcagtggcgtgatatcagctcactgcaacctccgcctcccgggttcaagtgattcttctgcctcagcctcctgaatagctaggattacaggcttgcgccaccatgcccggtgaatttttgtatttttagtagatggaatttcaccatgttggccaggctggtctgaaactcctgacttcaagtgatccacctgccttggcctcccaaagtgctatgatggcaggcgtgagccattgtgcctggcctcggatttattttggtagaaaatagaggataacccaaagaacaatgtagagaggtttttaaaaaaaattaaaaagctaaattagaggagacctggaaaagtatatatctgattgcaagattaagggtaaagttttccattgtttggaactggcccttaattctggttacaatagactagaaaagtgcttatggtgtttagccatttagtagagtatccaaggaaggtagctctttctttgagaaggtacaattagtaataatgatgattctaataatagcagcaattgccatttagtgctttgcatttaccacatgccacgttacacaatttacaagcataatttcacttcttatttaggggaaaaattattatctctttttaaaatgagaaaaccaagatgaagtcaaatgaagtaatttatatggagtcacactgtaagtggtgaagttagaattcaaacctgagtttgttagattttcatcttctgagtgctactgcctcacctggatgaggttccctcttctgtatttggggccatgtaaagggattagttgtggtgaagtgaactggagagagaaaggcattgagccatagtggatctcaagagatcctctgggccagcttgctgccttccatcaggtaaatgacccagccatctaggacagatgcttgctattttttctgaaagatcttcagggatagtcgtttcacaagctcctcagaagggaaaggagcagaatcagtcaagcacagcaaagtaagggcctaagtaggcagatgtgctcagtgtcactgggacccccagctgacaagcttgctgtgcagtgttctgcttgagaactttctgtttaacatgccaggcaaatcagccaccaagtcctaagtccaggaaaatcactttattttctgtgagtgttgcatgaatttatccaactgctttggttgtagcagggcaagtttgatgtctgtcatagacctatccaccttctgtaaaagcagttcagaggatgaccaatgagctatctttttctgccattcataacttgtgcatttccttgacttgcttctgttacaaggaaaatgatcttattttttatgcaaatcttgcacataaaattgataagtatttgatgataatcagcatctgccatcaccattttgcagacatgacagatattattacttttgtttagataaggttcaaatgagcttggatttggttgcttatttaatacttgtcttctctgctagcctgtaaactctgtgtcacaagagtaattacagtgtcttaaacctactatacactgaaggatgaagacaacaaaggcagaccaagatttgagtcggcagaatttcagtttccacaaggacaagccattttgacctctctgagattattaaaatgagttttatcatgtaactcacaagattactgtaaggaattatgcaaataatggtggtattattgttatttttattatttagttcagaaatcactttttaaagatgaggaaactgactgggcatggcggctcgcacctgtaatcccaggacagtgggaagccaaggcgggctgatcacttgagcccaggagttcgagactaacctgtgcaacatggcgaaaccctgtctctacaaaaaatacaaaaaattagctgagcatggtggcgtgtacctctagtcccagctactcaggaggctgaaggggaaggatcacctgagcccaggaggttgaggctgcagagacctgtgattgtgccactgcactccagcctgggtgatggagtgagatcctgtctcaaaaaaaaaaaaagatttagaaactgagctctatacaaacatagtaagagttcacccaagttcatggacaagaagaatgcaaacctgatgcctgatgtattacttttctcagctactgtaataaattgacctacatttggtgacttgaaacaaaagaaatgtgttcttttacggttctagagactagagatgagatacccgaaacttagtaggaatgcactgcctctaggggttttagggaagaatctttgcgtcttccacctcctgatggctgccctagcattcctgagcttgtggccacatcttcccagtttctgcctctgtcctcacattgccttctcctctgtgtgtctgtctaatctccctctgcctcactcttagaaacccttgtcatcggatttagggcccactcagataatccgggatgatctccttatctcaagatccttaccttcctatgagatgggttgataggtgcagcaaaccaccgtggcacacatttacctgtgtacctgcaatcctgcacatgtacccctgaacttaaaataaattaattaattttaaaaactcttaaccttatttatatctgcctaggtcccttttcctagttaaagtcacactcatgcatcccagcacttaagacatggacattctttcggggggcccttatttaacccatatttttacatgatccctatgttttcctgacaaggattctaatttggatgtttttacaataataagtgttatactgtctgaatcaaataataggaatttctactacacaacaatcttcgtgataatggcttaatatataatctttatttcacagatgaatcatttcaagatccatgatcctcctagtttgacagaaataacataatttgcttgaatattaatgttgctcttagttttgagtgagatgtttttaaagtatctaaaactgattggtacacacatcttttcatttgcagctgaatatgtactaattctggctgtgagcttcctaagcaagaatgctagaagccaattgaattagcaaatgcactcagatttttgatagcattattccactgaatgtggaagtccttcagaaagaatcagctacagaaaccgtcttgctaacagacacctgtcaaaaccaattccattcacttagcactcacttctaatattgaagggtgttttgttataacttcagtatcttcccacccttgtgagagagaatagggtgggagagagaaatccttagtttaggctgttttgaaatgggtatagtaataataaatccctcaaattttatataagatgtatttatactttgcattttcaaaatacacattctcaaataccagtatttatggaaacattcctctgatgagtgaagatttgcaaagcagagcttagctttcataaaagatagggacatctctgtcacaccacccatgacctgagacatgtaacctccttggggaagtattattgtttccattatggttgctgaggagcagcaagttcagttgctgaattatttccacatgataggcaatgaaatgaagaaagctaaccttgtataaaatgctcaaaacaggaagacagagttcaaatgaaaacaaattcacaattagcttcatccgaaatagaaacaggtttgcttgctggaaagaaagttcacactcttcactctcgattcctatcacgcttctgcttgtttctccaaagctatatgaaggctggttaatcaccttatctattcataaagtctattaatctttcttattaacttgtaagaccttgtcagatgaggtccaaaaacaagttttaagaccttgctattactactggtaatgtagtaatgtttctccatttctagcttttacccacaaccacttggtttatttccatctataatggaacaaagaactttgagttttactggatttttgtcccttaattacggatgtttgccttcatgaaatatgacgtggttttggtttaatgaaagagcatcgaagctgtcaagaacctcagtgatttttcttttcagttcttaatcactgctatttgagggatgttttgatagtatcatttcttaattgcgttttcgaaaaatgatttgtttcaatagccacatttccagaacttgacaatcacctcactgctgctaccagtatcgtattaccttattccatgctacctaggaaaaataacagaaaaagtaaccatttcttgccttgattacagttactgactacagaataaggagaagaaaacaaaatcatgtggaacttcagattctgagacattaaaagggcccacatagcattcagttagtaacccattcctatgaaagaatctttgagaatgaatcactcaaattcctatctgagaaaaatgaccaactactgcctgccactttactagtgggccatgattagttggaaataccaaatgaaaacatgtactgccatgcatatttttcttggtggtgacatttgtagcataaagtttacagcataaggaaatttaacatgtttcaaattcaccatatctgttaggcatgctttcctgttcattcatctcttttaatagtttggaacaaataatgaaaaccatgtgccatgttttacagattctgagcctcaaagataattaaatcatgaaagaaatgtttctacatctgcaaaaaatgtctggtgcccgatccatcagtagaaaaagacttacaggcaggaagctctgctgcagcagttctcagggtatgcttaggaaggacactgattctcagagagatcaacaattaacagttcacatcttagttttctaaaagacttctgggagtctttgatgctgtaatgtatgttggatagtcccaaaaaggagatacaataaatagtaactcccagtctcttgataataaatccctttttttgttcatagaaaagcactgtttttagaacaaactttgcaaaaactgttaacatagcataagacagtggagtagaagaagagtgaaagtatcgacttgggttctaaccctggctgtacctcaaatagggcatgttaagcatatcacttgaccgctcaaggcttcaacttcctttagagatagaaataagtcatctcttgagtcctttgaaaacttacatcttccattctgtttaggctgctgtaagctgccattgactgtgggcttacaaagaaaggaaatacatttcttacagttatggagcctgggaagtactaaatcaagacacaagcagattcaattcctggttagggcctacttcctggttcacagactgctatcttgtcactgtgcactcacgtggtggaaggggcaagggagctctgtcgggcctattaggggactaatcccattcatgagagccccatgctcatgatctaatcacttaccaatggccctacttccagatacactttggggttaggattttaacagagaatttgaggggtggggtggggacaaacattcattgcataacactttaaaataccataattctctgtccatggttaagaaggttcctgtgtaatatatgtaattccattctgtaagttttattatggtctgatagttttagtaagagttatcaaacccactggaatatttaaatgattaaataacccgaaaaagttactgttttgaaagtatcacagtcatgagcaaataatctaaattaggcagattaaataccaaaattggacctgacaggctgaccctgatcctgaaaggctctgaccttttcctggtggcattggttcaaacatccatcccctctcttctctccaaaaaacatggaaaggaacttgtgtaactgggatttggtgagctcccaatacccttttctcacaactccagtgacattcccacggaggaagggactctataatctattctgttaaatggtgagaagcatcattttttcgtcttagcagtcttatattagagtaacaaatgggtatcttttttttttttttttctgagatggagtctcgctctgtcgcccaggctggagtgcggtggtgccatctcggctcagtgcaagctctgcctcccgggttcacgccattctcctgcctcagcctcctgagtagctgggaccacaggcgcccaagaccacgctcagctaattttttgtatttttagtagagacgtggtttcaccgtgttagctagaatggtctcgatctcctgacctggtgatccacccgcctcagcctcccaaagtgctgggattacagacgtgagccaccacgcccagccacaaatgggtatcttttgattcaaatttgtcttgtatccaaaataggtacatgtgatcaaggcaaaaagaaataaaaatatataacatttgattgtgagtaatcttttcattacacctaatgttaatgtgttcatgattgcagaaggtgtaaataaccatttcttagatgtctagtttattaatcacagaaatatctggagaaaagaacaggattttttattctcacagagaattgttgattgggactttcttgacccgtaagatgtaaaggttaaggttgtctttgttgctttcttttaaattaaatccaagtgcatcttaattaggttaaatacttggttttggaccaaaaaatagggacttcaacaagctacactataacttataccaactgaagttggtagcttttaccttccttcatcattgcagttcttactaaaatggaattagtgggagatgtttcttaaaggattatatttgaaggttttctggaaaccaaagtgtgaaaagttgaagcactcatcagtatggcatgacatgaatttgaagttttttaaaggcaagcaagcagaatcttttggcataccctaatctaaaaatatcacttgattagattcacttttcaatattccttttaattctatggtacggtttttaatgtgcccttatttctctaagaaaaaaatgaagagctagaatctaaaaataaaacccgtacttaatacacaagctaaatatactcccaagttttctcactgctacattaattcaatgaaatctaatttaggctagtaccactgttatgaataaagatgaatacacattaccagttcacattgtgttgtagcatttttctttgagacttatcggaagaaatgttaattgcttaagtccttacataagatccggtgttctttaaagttttcttgaagagagattaagggaaaggtgacaactaagtttgcatttatttttagcttcatcctattctattgctgtattcccaaagtagtcatcctgactttatagcattccttaagagttaactttccaaaacccagatactataatgttgctcagtaccccacccctacttcatactcagattcctacagtagcccttgttgcttataagagtattcccaaactggtgaattctgctcctgcccaatgttttgttattgttgttgttttcatagagatagagtcttgctctgtcacccaggctagagggcaggggcatgatcaaagctcactgcagcctacaactcctgggctgaagtgatcctcctgcctcagcctcctgagtagctagaattataggtgtgcaccaccatgcccaactaattttttaattttttgtcaagctggggtctcactatgttgtccaggctggtcttgaattccaagctatcctcctgcctcagcctcccaaagcactgggattacaggcgtgaaccaccactcccagaccagaatgttaatttagaaagctacactgggaatggtggcttacgcctgtaatcccaacactttgggaggccaagtcaggtggattacctaggtcaggagttcgagaccaacctggccaacatgatgaaaccctgtctctactaaaaatacaaagattagccaggtgtggtggtgggcgcctgtaatcccagctactcaggagactgaggcaggagaatcacttaaacctgggaggcggaagttgcagtgagccgagatcgcgccactgcactccagcctgggcaacaagagcgaaactccgcctcaaaaacaaaaacaaaaacaaaagcaaactccaaagagttcagtgcccagatgttagattaaacaagtccctttactgcaaagtttttttgtgcagaatgaactgaatctccaagagttcaatatagtttttaacctttcacaacttaatcataaaatatttgtaaggcattcctgtttagtaagattattctgtggaagacaaagtaaaattctagggtgttaacaatgtctgttacactatgacccttactcacatttcttgcttcatgtcttttatttttgtgcagataccttactactgtttgatgaccacactgagtattttttttttttttttggtataaatttagaaggtaaaagtgcaattttgtttcatggatatatcctgtagtggtgaagtctgggattgtagtataaccatcacctaaataatgtgcattgtacccattaagtatttttttttaatccctcccaccctcccactctttcaactctccagtgtctattatttcacattctatgttgatatgtacacacgttttagctctcacttgagaacatgtggtatttgactttctgcttgtgggttatttctcttaagataatggccttcagttccatcgatgttgctacaaaagacaagattttattcttttttatggctgagtagtattccattgtgtgtgtgtgtgtgtatatatatatatgtttatatatttatgtttatatagtctgtatatatacatactatatctatacacacataaatctatctatctatctatctatctatatatctatctatctatctcccattttctttatccaatcatctgttgatagacatttgggttgattccatatctttgctattgtgaatagggctgctataaatatgtgaatgcaggtatctttttcttttctttttgagacagggtcacactctgtcacccaggatggagtgcagtggtgcgatctcagctcactgcaacttctgcctgctgcactcaagagatcctcccacttcaaactcccaagtagctaggaccataggcacgcaacaaaacacttggctgtttttttgtatttttagtagagatgcggccttgtcatgttgtccaggctggtctcaaactcctaagctcaagtactgcacccacctcaacctcacaaactgctgggattacaggtgttagccactgcacccagctggtatccttttgatataatgatttttttttcctttgattatatacccggtagtgggattgcctgatcaattggtagttctattttcagttctttgagaaatctctatactgttttccatagagttgtactaatttacactcctaccgatggtatatagatgttcccttttctctgcatcctcaccaacatattcttttttgactttttcatagtagtcattctgactggttgtaagatgatatctcagtataattttaacttgtgtttttctgatgatcagtgatgttgaacattttttcatatatttgttgtccatttgtatgccttcttttgaaaaatgtctgtttgtgtcctttgccttttagtagggttatataggtttttgttgttgttgttgggttaagctccttgaagatcctggatattagttccttgttggatgcatagtttgcagtatttccttctattcttcagattgtctattcactctgttgattatttcttggctgtgcagaaacttttaaattaagtttcatgtgtctattttggcttttgttgcatttgcttttgaaatcttactcatggattgtttgcataggccaatgtcctcaagagtttttcctaggttttcttctagtatttttacagtttcaggtcttttttttctttgagatggagtctcactctgtcacccaggctggagtgcagtggcacaatctcgggtcactgcaacctctgcctccggggttcaagcgattctcctgcctcagcctcccaagcagctgggactacaggcgcctgccaccatgcccggctaatttttgtatttttcagtagagacggaatttcgccacgtttgccaggctggcctcaaactcctatagtttcaggtcataactttttcacatgtatttttagaaaaaaattttaattttaatttttatgggtacatagtaggtaatactaagcctttcacatagctcgagtttatttttatatatggtgagagataggggtccagtttcattctcttgcatatgacaatccatttttcccagcaccatttactgaatagggtatgctttccccagtgtatatttttgtcaattttgtcaaacctcagttggctgtaggtatgtggctttaattctgggttatctattctagtctcttgatctatgtgtctatttttataccagttccatgctgttttggctactgatagccttgtagtagaattcgaagttgggtaatgtgatgccatctactttttttttttttttgcttaagattgctttggctattcaggttccacaggttgctttattggttccacattaattttaagatttaaaaaaaaatgagaaatgacatcggtattttgataggaattgcattgaatctgtagattgctttggataccacagtgcatatttttaatgccttttcgtcattgtgcatgttgttctttaccctgacattcgatttatttcttctttcttctctcaaaatcttaatttttttcgggtctagactgcatgttatgtactttcttattattttttatcctgcaagaaaataatttgctttctcatttgtaatctcacagcattttgtttacataccactaaagttcttattatctgttttgaatctggtaattgtccacatcttcctacaagatgaggagttcttcaggggcaggagctttatcttaattcatctttgcaactttcatttcttagttctctgccagacatgtaataagcaatcattctggttgaagagaatcgagttgaataactacaaaactgtaagtcaaaccatgtcactcctctgttcagaaacctgcagtggcttccatattgactcagactaggaactaaagatcttatagaggtcccctctctgtcccaatacctccctgactccatgtcttaacttttatcttccttattcattctgttccagccaaactggctctgtgatattcctcaaacatgttcagaatcctgtctttaagagccctttcttctacctgaatgttttcccgtaaacattcatctggctaaaccccttgccaccttcaggtctctactcaaacgcacctacttcctgaaacttacccagagtccatttttaaaaattatagccttccttcctactcccagctctctcaatccctctgattctactctgtttttcccattaccactgcatgaccttctaacacactatgtcatttaactttttatcatggtattattttcctgcctcacctgatcagatgtaagttccacaagggcaggagtatttgtctgctttgttcattgttgtgttccatgaccttaaagcaagatctggactctgctttatgaacatatgttaagagaactgaatgaatgaatctggtttttatcccattttctagttcagtgaatttgtgatgtctgtttgtcacagtatttccatatagaacttagtaatatcagggtagcttttgttagttttcattattgaaaaattgttctctgtacttcagctcactcaagctgtgaaagcagtgaaacattgcatcaattaaaatattccaattaacactaatcaagaggagcaatagtaataacatagctgaaccaggttgttgaatctttgtagcctcacacatcactgtaggcacagtatgtcaattaaataagataatttttccctattatgcatcttggtaaaataatgaagatattctttggagaaaaataaagcattattaaaacatgggtccctgttttaaaatagcatgcttctgctcttcaatccagtatagcattgcttgtatcattgtcgtgattaagaataaaatttcatggcatgtctactctgtcagacagtgaggtaggttttgggagcctaggaaatatgagatgttgtttttgccctcaaggagattgtagtctcccctgaaagtgtttttttattctggtcctagataatgtacttattagaggtttaattctaagcaaacctcttaacttttctgagtttcaaatattttctacaattaaagtttatacttaatgccatccatgtctgcttactgagatgttttcttaatcaaatgagttattagtaaaaatgttggagttttctctatttgctaaaaataagtactataaaaatgtaaggaaacatatcattattggtctagttgctgctactattattattacaactacttctaattttgttcttgccattattatcattttaaattattattgttaccatcattatcatctttttcataatcatttttatgcctgaagcatgggctaagacactatatttaccagtaacatgtatccagtgcccaccaagtgcccatccctgaaatttatcgataaccctcacatcaatccttttggagtctttgtggtcatttgtggacttgtgaagagcagcaaaatatttaagtcacccaacacttattttcccagctgaggttgaacaaagtgacactctgccttctcgtttgagctctaggtgtacaaacaagtgagctttttgctgtctgtttagtggcacgttgttttgccttctttgcttttttgttggtgatttcactgtttaaaatagcccaagggaatagcaccgaggtgctgtctagtgttcataagcataagaaaatcgtgccttacagaaaaaatacgtgtcagatgagcttctttcagaccacgaattcaatgtcaatgagtcagcattatgtattaaataccatgtcttcaaacagaaacaagtaaagcaaggttatgtattgattggttgatgaaaatggtgtgaccagagactcgcagaaacctaaccctgtatttcccctacggtttagcagtcactaattcagtgcttggggcaactttgcagagaacataactacagccagtaatgtaaattgactgtagacacccggcagtatggtgctgaggctgaaagcaattgagaacacaaattgtcttaaatgacttgacttaaatgagaacacaaaactttaatacttttagaaaaaaaaatgtaggagaatatctttatgacttcaggataaagacgagtttcttaagtaagaaattaagaatgttagccttaaagaaaagactgatgcattcataggactgtcgtttatcaaagaataccagagagtgaaaaagacagagatatagtaggaaaagatatttgtaaaaatgtaacaaatagaggttcccaagtgaatgaagaactccaatgagtcagtaagaaaaataaaaatcctttatataactgggtaaatgatatgaactggcattttcagaatgattaaatgtgaatggcccataaatatatgaaaaaccaactttattaatcatcaaagagatacaaattagaaatcatgaattatcatttcagacaccagattgacataaactaaaatagtaagtattgttgaggaacaacaggaattctcatttagggagaaaagattgaaaattgtcccagccattttagaaaacagattgtgtaaatatcttgtgaacttataaatctaaacttgtattttccactcttaaatatacaggctgtagaccaaagaaactcttgaaaatatgtgtaagacacaggctttttatatcagtttagtttataatagcaagtaagtgggaaaagaactattgatggacagtggaaagaatatattaactatattaactgtggtaaattctttttttttttttttgtttgagacagagcctcgctctgtcgcccaggctggagtgcagtggcgtgatcttggctcactgcaacatccgcctcctgggttcaagcaattctcctgcctcagcctctagagaagctgggattactggtgcctgccaccacgcctggctaattttttgtatttttcagtagagacgagtttcaccatgttggccaggttggtctcgaactcctgacctcaggtgatccacctgccttggcctcccaaagtactgggattacaggtgagagccaccaagcccggcagtaattcttatgaagaaccgttaccacacaattaaaatgaatgaaccacagctacacccattgagactgagtctcaaaggaatcatgttgagtaaaaatagcaagtgttagaggaatgcatagtacaattccatttttatgaagtagaaattaatttcaaggctgaacaatacattatttagggatatatatatatatatgtctgcacacacacacacacacacacacacacacacacgtatgataaaaaccataaagaaaaaacacatgacaaacaaaataatcagcagtgggggtatagtcagggaggaatacacagaagcttcaacattactggcaatgcttcatttgttacagtgggtgttaggatcacaggtgtgcactttagtattcttgtaactctgcataaacattatttgttttctttgtttgcctaatatgtcacacaataaaaaatttaaaatgaggaaaaaccatcaggttatctggagcaagacagcctgggttagtattctggcattatcgtttactaacaatgtgtacttgagcaaattattttgctgttcagcaatcagtttccttatctataaaaaggaatataaaattacccactttagggattgttcagaggattcgattttatgtattgttaatatgtgaaaaacacttaggataatgcctagcacataggaagaactcaataaatcttagctctaaatactactattcaacctacaagtggctgaattagctaacatacaactaagcaaggaaggtgtgagcattgctcttctatcacttgaggaccaggatacctcatctgagatctggaatatcttcactagctcacccaaccacacccacatattttgagcactttttttttgagacaaggtctctctgtgttacccaggctggttgcaaactcctgggctcaagcaatcttcctgcctcagcctccaaagtagctggaattataggcacacaacaccatgcccggctattttagggacactgaaaagtgtctttatcggccaggcgtggtggctcacgcctgtaatcccaacactttgggaggctgaggcgggcggatcacctgaggtcaggagttcaagaccagcctggccaacaaggtgaaatcccatctctactaaaaatacaaaaaaatttgccgggcatggtggcaggagcttgtaatcccagctacttgggaggctgaggcacgagaatcgcttgaacctgggaggcggaggttgcagtgagccgagaccgcaccatcgcactccagcctgtgcaacaagaacaaaactctgtcttaaaaaaaaaaagtatcagttgctgcactgtgtagcatcctgatcactgttgcttcatctacaatcttttaagaagcctgtggcaattcaagtgccacatgagctttgtagctgtaaagtttcttgtgatagaagagcaattggagttgtgctagaattcagttgctgaaaactgcactaggaaagttgcaaggcaaagacaaacccaaagaaatcagaatagaaaatgatctcaggagcaatgttgtgacgatggaaagatgacaggccagtgctctgacatggaaaatgagaatgtagctggatattagcttggctcatatttttgaaacccagagcatgagtagtctcaatattgatagcctgggtttgagtaactctcttaaactcacttgatgccaaagctctcatgagaatccagttgtgccttgtggtgaggtgaggctgtaccttggcactgtctgtgcacactgacctgcattgaaaacaatgggggcagtgagcagggccgaggtggagattgagaggaaccaggtcgtggatgccaaagggggagaaattggccaggtttttatcccggaagctaaactgaaaactcaagtcccttgatcctcattgttctgggtccacagtctgtgcagatggaatgttgattgggtgatcaccgccagcaaaaagtacagactgttttttctactctcataacactttttgttttgttttgtttttgtttttgtttttctgagacagagtctcgctctgtcgcccaggctggagtgcagtggtgagatgtcggctcactgcaagctccatctcccgggttcacgccattctcctgcctcagcctcccgagtagctgggactacaggtgcccaccagcaggcctggctaattttttgtattttcagagagacgggggtctcaccttgttagccaggatggtgtcgatctcctgacctcgggatccgcctgcctcggcctcccaaagtgctgggattacaggcgtgagccaccgcgcccagcctctcatagcactttcttatactctacagcatttactctaaacacttttacagcaatgctctacatactttctttacaccttacagtagagccactgatgtgcgtatcatatctggattgtaaacgtcttgagatcagggaccatgttggattcatcttcacattcctcacaacatcttccacacatggcaccacaagtaatattgacgaagggagggctgtcaggccgcacaaaggatggtaaggtcttcctaactgaaatcctctggcttcctaggatttcagaggcagaaaacagtaactatccatcgctgacacagatgatcaccatgctagtttgttcattgtcttctcttatcaaatcagtgtggatttcatatgtctcctcagttgtttctcccacttcttcagcagcttagaagttttgttttgctggggagctgtttttaacttttagatataaggtgaaaatgcttatttattagtttcctcaggtgttacatgaactaagatgacttccacatcagttataaataagaaagtaccaaactaaatcaggactgctgtgtcacttggcactacttcacgtccttcttggcagcctcgatgggggacgagagctgagttggcaaaggggggagtgatttatcctcccacacttagaagtaggatggaaagcagaaaggttctacttttatattacttcttcttttcaaattttcatattaacatcccctatccggtttctctagcttatttttctgtagtgggcatcaacgacactatgtgtgatttgtttattttatttgtcatctcttacccacattaagctctttgagaagagagatttttgctttgttttgttttgtcagtgatatatccccagtgtctaaaacagtggctggcatcatgataggtgccgatagtaggcatactgtaggtactgaatgaatcttcgttggttcttaactaccacaaagtgcacttaagagcaaggggcatgagcaatggcatttctaagaactgacaggtttaacacacggcagccttatctctgattcttctttgtgaaaatgagaacagggaaacagcacccattgcaaaatctaaatcgatgatgaatgaacacgtagcttgcgtgtatatttgacgatggttttattttcaaaactgtaattaaatgagataaaaatatatggttgaagttgccgaagcaacttaaattcaacataaataacagctgctcctcatctgggaatttcatttatatacagaacttttttttttttgcccttaaaaatttttaactggtatacagctaattcagcatccagtatcccaagatacactttatactcaaagaagatggaaaagagaagagaaacagccctcgttgagccagtgatgaaacaaagctgttactccccatacctttgatttccctaaaatagctatgatgcaaagcatgtccagtttcttaggagcaatgagtctaagcatgactggcattttttaatgagtccagcaatccctactttaatagttcaaaatcctgaaactgagtacagagtgaagagtcttctattagctttgaaagcaaaatttttctgcagagcatggatgccaggaagtactgataacatctgcctctccttgtaaagtaaggatcagtgcagtttcctcccaagcttcttggaggaaaaaaatacctactctttggatagaattaagagaaggtataattacttgaacatcgatctagtttcatttgcgagtaggaagtgagaaactgcgcctctttcctgagacatcgtatccactaccactaagtgctaggcaaatttggtagtgagttcactgcctcggtttatattcctgaaaggctaataaaagaaaagaaattgaatgaaaaagtttgagatgaagagatttctttcactttgaagcagggtttttcatgaccaattgtatggctcgtagatttgtagtctctggggtttgatcatgaactgtggtccttatgtctccatttagtaatatgtttccaaggcttttctgtagattactgactttatcatggcctcttgatgcataacttttcagcattttcttcagagaatattcattctggtgttacttgaatgtatctgatttgccttctaaggtgcctatttattaagaagattggtacaatgaattacaacctgctaattttaattttcattggggagaaaaaaaggctataaagtaaaattcaaaatgaagaatcatatttctttctgtcaaagctataatgagcataagtctatcagttataaaattatcacactagatgaagaaaagataattgtatgatatatcactgactggctgataacagccctaatcacaaataataggcccatgcaatttgcaaggagttgtttcatgttttcatcatctctggcattccctggggcaggggtgagtgggcgagtgggtgggagagtatttattttgcaaagcaataactccagttcatatgttgattacattccaattttaatttatctcttagctttccacttaaggatggggatgcgggaaagtaggtggctccatgcccttgattggacaccttttcttgaagttattctccaaagcttccctggctattgagcatacaaaggtcctttgtagccaagatgctggaaagcagtgtgtcatgaggacaaatacaagaaagttcaccctagtccaacaggtctcaccaaccaccacagcctgtgaaacaggaagaacagcagtgctcaacaagtactaattaagtatctactatgtatcagacactgttttgggcattggctatagcctcataaaaactggcaagattcctgccccacagtgagcttttatttggggaggcaatggagacagtaaaaaagaaagtacacaaatgagaaccgtagttgcagatggcggcggtggtgatttctgggaaggatgtagtaaagaggggatgtgacagagagtaactggagtcaggtcacggttgactttacttaagccctcaggtaatgctgctctgaagaagggtcatttgagttggttcctaaaggctaaacatgataagccaaagaatggggaaagagcactccaaacaaggggaacagcaaggacatgggtcctgagactgggttagctgcaaggtgtttgaagaacagaaagcaaaatgtggccattacggtataactaagtaaggagggaagtggcagggagcaaagctggggacgtaggcaggggctggatcctgaagggcctttgcagagcacagtgaagggtccatattttattctgaaattgaccaggccaaatgccttctgaaacctttgtttctctttgtgttgtgtaagtatgaaaccaaagataaagaatgcagctgcctaaccattaacactcctgagtcaggatgatatgagaaaagagatgagctcccgtagagaaaaatgctggtaataatagcttgcatgttagggcacccgtctccgaaggagaacaacattattaacggtgccatatctcactaattgtagtaacctcatgagttagataggtgtacttttttgtggaacacacagggaaactcagacattttaaattaagttgttctttggcctcttaaatagcacaaaggtctagataaaatagagtatgtcaaagaaatgaggaaaaggaaagaactaaaatgagaaataaaaatagccatcaggaacgctgtaagctcccagagaaaagggcagccaagcaacgtttattttctgtaaagtcaagaaaataatagttgaggggtgaaaaactgtgagagtctcagacagtcaaacagaccatcaaaaagtatggtttcatccctgttatttaatttgatatagaatagaagttatatatagggacttctgggtcgggaaaatccggattctaatctaagctcttggatgtttatttttctttctattaaatgagaatagtaatagaacccacctcaaagagtcgtggtgaagaccgaatgaataaatacatagaaattgagaaattgtgtcatttagctaagctggatggaactggccttagcattcttccaaatagataatatttataaagtggttaaattgccaaagttaagaagccttcttaacatgtaatattgattatgctatttttaattcttgcctaggttttgttcctggaaacaaagagtgatatgtgatctagtaatgtggtgcaagaagagaaagaggagaataacctccaattttgctaaatagaggattgctgaccctaggcaaatttgtctttggcagtctccacacaccactttcctcatccagttttttaagtcattatccttcttgaactttctcagcgctattttgccttctccactatttcatagattaaattttcctttgattcttctttggttattcaaaactcacatttgaagactccatactgctcttacttacttgttaagtgaaagcaacctgattgaattaattcactcttcactgaaagtgattaatagcaaggtcatacttttgaagaaggtatttatggtttaaaatgatatttttgtaattccaaagtaatatctaaattgtaaggttttatttggtatgaccgaagagggtgacaaaaaactcaggcagttggagagagaacactgtgagggctggaatcagcacctgggacagctctgaataagctttcccttttactctgaaataagtgtattaaggatttccatagtgatgttcatggctgcagaattagaggctctgaaaaaaaaaagaaaaaaaaaaagatcagaagtcatttctgtgaatgagtcatttgtatctcaagggtacattgacttaggaatattagacctagcataagattttggtcccggccaggtgcggtggctcacacctgtaatcccagcactttgggaggccgaggcaggcgtatcacttgaagtcaggagttcgagaccagcctggccaatgtgggaaacctgtctctactaaaaatacaaaaattagctgggcatggtggcaggtgcctgtaatctcagctactctggaggctgaggcaggagaatcacttaaacccaagaggcagaggttgcagtgagctgagatcacaccactgcactccagcctgggcgatagagcaagactcagtgtcaaaaaaaaaaaaaaagttttggtcctttactttatttttattttattatttatttatttatttatttatttgaggcagagtctcgctctgtcgcccaggctagagtgcagtggcctgatctcagctcactgcaagctccacctcctgggttcacgccattctcctgcctcagcgtcccgagtagctgggactacatatgtgcccgacctcctagtcccttactttcgactgccaacaaactggggtaattaatgtcaggtttttgtttttgtttttagacggagtcttgctctgtcacccaggctgtagtgcagtggcgcgatctcggctcactgcaacctccgcctcccaggttcaagcaattctcctgcctctcagcctccagagcagctgggactacagcacatgtcaccatacccagctaatttttgtatttttagtagagacagggtttccccgtgttggccaggctggtctcgaactcctgacctcaagcaatctgcctgccttggcctcccaaagtgcggcgattacaggcatgagccactgtgcccagccaaaaatcacatatatttacatcctttaaaaaaggtaaggccgttatcctcagcaaattgacagaaaacgaaataccacatgtcctcacttacaagtcggagctaagatgagaacacgtggacacataaaggggaacaccacacactggggcctgttagagagtggagggcgggaggagggagaggatcaggaaaaatagctaatgggtactaggcttaatacctgggtgatgaaataatctgtacaacaaacccccatgacacaagtttacctgtaacaaacctgcacatgtacccctaaacttaaaagttttaaaaaggtagacaaatatcaattttactgttgtatagaaacaatatttttaagtaacacaagcattctcagaccagaagattataggaagaatttctcatgaagaattatctgaatccagggtatagtgcgtatatcttaaatataagtgttataaagaatacagttcatgcaatataaaggataagatatctgattcacttcagcatcaatcttgacttgaaagcataattaggactagcagaagaggatatattttaagtcttatcaggtttgttttttttgttttgttttgtttttttgtttttttgccacagtagtgttgacttggccactctaatgttactttatccggtggaagttctcccagtgagtcactttctgtaaactttcctttggatgctcaaaagtcatactgatagtgctaacatttatagactactgactttggaccaggcagcatcttaagtgctttacatgcatgatcttaatcttcagaaagtcctatgagacaggaattattgtcctgacattagaagtgagaattgaagttcaaggagattaactaactcacctacatcatacaggtagaaagtaagagtgctaagtttgtactcaggtccttctgactccaaaaccagggtgttaaaccatcaggcagttcttcctcttgctatatactctcttacagggaagtccagtcttccttcttcctaaatggaaagaatgtcaaaaatacgactttgaaactcaggttttgtaaatttcgatttattttcactacaagtctcttcaatccaggaaaccataaagtgtgcatccacacacacacacagggagcaaatggcagagagtcaagacataactttaaatttgctgcatgatagtgagtttttaaagttactctccaaaaatacttctttttataaatggtgcagtcatcattatggagatcatattcataacaaatgtatcacttgaccatttttccaagttgatgttcatctccttactgattgcgtcttttaaaaggaagcaataacaaagggaactggtgctgacaatttcttgttctaaggccaacctgggagaattaatagaatccaggtctacccaagtcaggaaaaaagtgaattggtatttttttacttgcattaaataatacatgtattacatgcatggttactgtatcatttttcctttttttcttttctcccttctctctgtggattcttaacaaactatgatgtgtgatattatctcattaacctttcctggccattttaaaactaaactttttataccttcctctgagtcatcccaccctgtgaatagcttcagctcttcctgtccatatgtgtaatggctagtccattaattatgacctaaataaattactctttcttatttactgttattacttctcaaaagagatcttggaccctcttgattttatatcctctagactataatcaggtatttatggtaagatacttcttccccagctctaaatatttaaaaatttcccagacaaaaaatacgtggacattttccccttgctctctaatttactccatggcctgaattccaaatgttttcctatattaagactttttattattgatagcatattgcagctttaaggcttttgtacacgtccactcctccaggaatgtaactgctaaatcacttcctctctggtctcaatgaggtaacacattccaaatactatagcatgttttctaatctcattttaaaatgaaattcaggtattacattccataggagaataaaggacagctgttttcacaaatatgatatgaaaacacatctgccacacaattgtacaatccttagcacatggctgttggaaaaagttatgtaaaatgctgacaaatgaaatcaacaccaaaaagtagaggtatttattttttaaaaatctacacatcacatgtcaatgaaccacatataaagcttgaaagacaggctattttgagaaacaatggtgcacggatgttaattccttgttttacatacacattatttattcaatactatctttggtgaccaattgctaaacggaatacaagccaagtgtaattgtttagctaccttcctaacaaggcagcaatcctgcttcttaatagagttgtttctgtttattttctccttgttcaacttcacactttgcacctaacatttacaatctccatgttgagtgcccaaccacaaagaaaagcagaggaatagaagatttgaaaccaaagtacttataccaacccatcacactatgtgttgaaatgtggatttctttccatattcactgagtgtaaatgttatttaaatgaacgtttttgtgtcctggcatggcaagtaactgatttgaaagctctttttcactgactttacgaaatcagtgaagatgccacagattatggtgcttcagagcagtaactttggagagagacaaaacatgagtttgtatcttctggccacttcctaggcacgtgaagaaggtgctgcacctccgtgagcttcagctgtgtcacctataaattgggagtttaaagtgtaatggaattcaatgagatcaaataagaaaagtacttggccacatggtatgactgcaatatagtctgcaagtcaattctattgttgctattagtgtgatggccacagtgacagagcattatccataatgtatattccgtctcataatgcctgctgctactgatcattacccaagtaccaaggctttggagataaaatgactctggatcctcatctctcaccttatacaaaaagcaactgaaaatggattaaggacttaaacctaagacctgaaactataaacattctagtagatgacattggaaaacccttctggacattggcttaggcaaggatttcatgaccaagagaacccaaaagcaaatgcaataaaagcaaagataaatagctgggacctaattaaactaaagagcttttgcatggcaaaaggaacagtcagcagagtgaacggacaacccacagagtggaagaaactcttcgtcatctatacatctgacaaaggactaatatccagactctacaacgaactcaaacaaatcaataagaaaaaaatcaaacagtcccatcaaaaaagtggactaaggacatgaatagacagttctcaaaagaggatatgcaaatagccaaaaaacataggaaaaatgctcaacatcactaatgatcagggaaatgcatatcaaaaccacaatgtgataccgccttacacctgcaagaatggccataatcaaaaaacagtagatgttggtgtagatgcagtaaacagggaacacttctacaccactggtgggaatgcaaactagtacagccactatggaaaacagtgtggatattccttaaagaactaaaagtagaactaccatttgatccagcaatctcactactgagtatctacccagaggaaaagaagtcattgtttaaaaaagatacttgcacatgcatgtttatagtggcacaattcacaatagcaaaatcgtggaaccaacacaagtgcccatcaatcaataagtggctaaagaaactatggcatatatatatatatatatgatggaatactatgtagccataaaaaggatgaataaacagcatttgcagtgacgtggatgagattggagactattattctaagtgaagtaactcaggaatggaaaaccaaatatcgtatgttctcactgatatgtgggagctaagctatgaggacgcaaaggcataaaaatgatacaatgaggccggatacagtggctcacacctgtaatcccggcactttgggaggccaaggcaggcagatcatgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccaggaggcagagcttgcaatgagccgagatcgtggcactgcactccagcctgggcgacagagcgagactccatctcaaaaaaaataaaaaaaataaataaataaaataaataaaaaaagaatgatacgatggactttggggacttagggggaagagtgggaagtggggcaagggataaaagactacaaatatagtgcagtgtatactgcttgggtgatgggtgcaccaaaatctcacaaatgaccactaaagaacttactcatggctggacacggtgactcatgcctgtaattccagcacttttggaggctgaggcgggtggatcatgaagtcaagagatcgagactatcctggccaacatggtgaaaccccgtctctactaaaaatacaaaaattagctgggcgtggtggtgcatgcctgtagtcccagctactcaggaggctgaggcaggagaatcacttgaacctgggaggtggagcttgcagtgagccgtgatcacaccactgcactccagtctggcaacagagtgagactctgtctccaaaaaaaaaaaaaaaaaaaaaagaacttacccatgtaaccaaataccacctgtatcccaataactgaaggaaaaaaatttaataaataaataaaaatatatgtggaaacattgctggtaaaggcttaatcatgagtgtacaaactttgacataatacccatttacacacatagctcttgacttagaaaagtatcatgttgttaactgttaggatctggatagatattcatacctgaaaagaacaatttgaggcatgtaatctttccctaaacatgtgcataagtatcatgtcctttgattcacatctacagcttgctctagtgtgcgtttgctattagaaacctttccttagttgcaatgtttgggatatgctttggcactaaatcacagcattcgcaatggacagaagaaacataatgactacatacttgaaacaaagaacattcattctcgttacatttatgagaaaattaagacctgcccatggtatgtagacctgcccatggtcaacacagctaataagtggcagagatggttttcaaactcagatctacccaaatacagtctttccatttgctgtataggtagggtttatcatctggaatctatttcaattaatgactaataaacgtttctgattattttctcaaataccagattaatgagatacacttcaaatgcctaaaacttgtagaagtgaatgaattcataaactaagaaggaaaaaacatgaatacagttttttaaagctcaggaaggatagttaaaaatcattgcccatatttctcattttctttctcatttcttaatactatttctctaatcagaaaccatgattggttttacctagatgatacgtgatctctactacctatcagctcttaatttttcatgcaactctggaaattgaatgggatatctgtgcacaaatgtagatgacttactctaagaacctatatgcagaagtgacaattcagactgattcagtgttatttttagggataatggtttaaaatattaactccataacacagtttttaaaatcctggtttaattccttttgaaggaatctcagaccatttccataaagacaagaaaaataccatgttctaccctcacctggtgtccattgaataaaaagaagtttattacatcagaaatgtaattcaaatcatagcactgatttgttttgtgcagagtatgtgtgtgtccttcatgttcacttttcacagcccaaacctggcagtctttggtttgctctgattaggtgttatgtgtcagacctgcctgcttgagccccaacaggacggaagctgtgttctcacaatgcttgccttctgagttggcaaaatcagatggtacttaatggagtttttatgaatatataagtgatgaagacaataatgtacaaacttaaaatgtccctaattccagaagaatctggtaattaagacatgtctatatgtaactttttaaatatccttagcactccttgaaactaagcctgagtgtagaaacattccaatttgtaactgcagccttcccaattgttgttaggagtacatgagataatcatcataaaatacttaccaaaatggccagcatggaggaaatcatccacaaatgttactctgctctagtgtgcacagccagatggtttgcaaccctgcacaacatacttgaattggaagtccccgaatccaataaaatgttattaaatcaaatgtaatagacaacaaaaaacgaaatggcacttaacacactccttattgagaggatttacatctgggagggtggaagaaaaaaacgtttcttgaacaataatatgtctcactttattagacatatttcttatattaactcatttgtatttgtaactgcctatttacttatactgtgatctttgggtttataaatgtcttatctctctaaccagacttgacctttttgaggtaataaaacattcttctaaaaagaaccatgaacagtaccttctaaatatttcaaactacaccacaagaactttaaaacaattgtgtgtctgtatatatgtctatttatacattttatatagagttgtgtttgtatataaagagagacagtcacactctgggtatatatggagagacaagtataattatatatgatagaatggtttgtgaagtgaacagaattgtatcagaaaacaagagtttgcattctgataatgatatttaaatacagagaggtcttgggcaggtcacttaacatctttaaacctcagtttcttcacctagacctgcactatccaatgtgatgtcctggcatgatggaagtcttctgtgtctgtgctggccaaggtgataatcactaagtgcatgtggctactgagcacttgaaatgtgactagtgtctgaggaactgaattataaattgtatttaattttaattattttaaatctaaataggcacgtgtggtaagtagatattttagtggacagtataaccataaaatcaaggaggatgggacaatgtcatatgaaaagaagctctcctgaattcccccggtatgggtgctaccaacgcagttttgagcagaatgattctcttttgaaatagtggtactctcccttgatatcttaggactttaaagtttaaatgctttttcccatatttctcccaacagatcttgacaactttaaaacaagaacaagaagcactgtgtctgtccgtcgaggtcaaggaatggtgctactgtgtggcccgccaccccattctggaggtacatataaatgaactgacatatgcatgcttcactctctgttatttttcttcctcaatgttctccctcctgacaccagctgagtgcacagtgtcatttatagagattcccaaagcccctccatgtggaggaaaaaccacggtgaatgcctcccatcattaggacaggaaaataccagattgtgcaaattttccaccccactgcagtgtacctggcacaagaagaaagacacctgagtcgatcaaaatcataatgctgttgcttggtaaagcagtgtaattaaaacgactcatacttcttacaacttgattgggttaaaaaagatggccctacttcatttcatctcctggttggtctgggaactgtctgtgaactgtgtctactcgcaatacttctgacaccaaatgtatgggttttttccacactaacaaccaagtctccaatcttctggacaccaactggctgtccaacgattcaattccattttgacagtaactaccccattaactactctgggatggttagtgtcagaactcataggataaaggctcagtcccacaaggctgcctccacttcagatgccactttcaagtccttgacctcacacacttctgactaactggctataaagtgggactcccataactccctccttggcttccataatttgctagaatggttcccagaactcagggaaaacagtttacttacataccagtttattataaaagatattataaaggatacgtatgaacagcccgataaacatatagagagagtgaggtctgaagggttgtgaatgcaggagtttctagacttgtggatcctccccacatgtagatgcattcattaaccctgaagctctccaaacgctgtcatttagggtttttatgcaggttccgttgtgtaggcatgattgatcgaatctatggccattgtaattgatggccattttccagcccttctcccatccccaagagtggggaatggggaggctgaaagttccaaccctttaattatttggttggttcctctgacaaccaatcaaggggcctcaccaagagtcacctaattagcataaactcaagtatggttgaaaagggcctatttatgaataacaaaagacattcttctcagcaatatcactcaggaaattacaagggttttgggatgcagaccaaatatatatatttcttattaatcacagtatcacaggatcagaccaagaacaaaagttccttgaccatagaatctacgatcactttgtggagactcatagcaactagatcagttaggaatgcacttgactgcaactaactgaaaacccagctcataatgttcttttatattctttttctcacatgcaacattttctctttcttttttttttttttttttgagacagagtctcgctttgtcacccaatctggagtgtggtggtgcaatctcggctcactgcaacctctgcctcccaggttcaatcgattctcatgcctcagccttccgagtagctgggattacaggcacccaccaccgtgccaatttttatatttttagtagagataggatttcaccatgttgaccaggctggtctcaaactcctgacctcaagtgatccacccaccttggcctcccaaagtgctgggattacaggcatgagtcactgcacctggctggcatgcaagattttcaaagatatacaatctaaagctagcacagcttctagaggatgtcttccaggactcatgcccttctctgattcttctctgaagtgcttagcatgtggtatggatgaggcatgaagtctgcattccaaaccagatcaaatgggaagaagcaaagacaaaaggcaatgatttgtttttgcttgtttttgtccatttcaatttacctttattatcgtaagttttctttgcctgaggactttgcctccatgtcattgatcacctcagtggcaaaggaggttgaaaaatcaaatattttacgcagatgtgttatgccctggaaaatatcataattttactagtaagggagaacatggagagatgtgtaggcaacttgcagtgtcggctaaaaggaactacgatgactaaaaggcaaatataactgcacataagggattcagtagtgtggaggtttaataagtagtaatatttattaggattccactaaggtctgtaatgacaagattgataaactctacccttggaaatccaggctgaagtttagttcaatatctgctattcttgttattgccttaattttcagtttgactttccacatgtttaaaagaacaaacttttagatttggaatttgaaaaacactgttttatttttgtcctctgttcaaaagttgtaatgttttctttctcatctaattctgagctaacatttccagcagaaaataacaattagtaaaggtgctaaaaggcatgtacttcaagcatcctgaatacgaaggagaggtgggagaggtaggttcccctctatgtctggatcagggacaaggaattgttaggatttctggtttttgaagactgacagaaaatctaggtttgatttcagaggtctgtgtttggaaaatgggattattcttcaggatttcattttcctttcaagttagtatcagaagcactgaatttggactctgggatatgagttttgatccttgttctgtttcaaatcattatttgatactgggaaaatatcttcaaattctttatgcctcactctgcctgtctataaaatgaagagattaaaagaagtctctcaaatccctattgattctatcaacacataattataactcgataagggctaaacatcttgtttatcaagtgtgtttgcattattgaaggcctgtcctttatatgagaaaaccacttcactgtggacatatatttagattcaggtgaagttcacttagactaacacttctctttttaatatggaatctgatcaaaataaaaatggaagattttactaatttcttctgcaggctaccttcattgcattaagttttcatcacatggcagcaaccctaaaaattaatcttgtaggtatattaagaaaaacaccaccactgtccgatataatgatctctttaggaaaggcaaaacacatggagtgatgctgtgctgctacgcaatgaagtacctgactactttccctttcccacagagaaatagattaaaaatttccatagacatctactgaaatgcagttgtctctgctggcagcagtcagcagctctgaaatccagttccttgagctgtgctgacattcctgacaatcttgatggtgaaagacaaggaaataaatattcttattataagctctattagaaatggcgtgcacattaacgctgtgggcaaagcaggcacggctaagaaatttttgagaaaagaacaaagaagatattcaaggttataaaagagcatctcagacatccatcagttttggacaagggaaacaatgattatctgatgaaatccttccaatttctcaaaagcctccaatgcaactgaacggcagtgattctctcactgtttttccgggctgtgtgtcaccctaaagcgagaagaatcactgtgagctgctggacatactgagcattttagacccagcatatggtctcctggtttccattgtaacagatcatgcagaggaagggaaatgagtcagccttttattatatcagtggggtactgagtaatggcatgaaatccattgtaagggatgctgcatgtcctatttcgaaagctgtgcggtgtcagaccttcttagggtagcagagaaatgagcagcaattaatctgttttgaaaagcatttcagtcagcaggtatttccagcactctaccaatcactatgtgtggcctctttgtcatctcttggtttatatgtatgaattcagatgtgatggttttgcatagatttttaccattaaatataagaaaacaccaaaaaatagaaatcactttgatggactctggctatccttggtgctccttcctattagacacagaaattattgaggtccagaatgtccactttgctttctgccaactccagggtcactgggcaccaggaattcatgacctttaaccaagctctcgttaaataggaatagaacagaggaactttgagattcttccttccaatatacgaaaatttctagtttattcctcaataaaatcctcacaaactgttcatcaagagaggtttttgttcatgccttcattttatgtcaccaagatgcttgcgactcaaagggtggtccaagcaccagcagcattggcctcacctggaaatttgataaaaaggtaaaatctcagaccccactacagcctactgaattggaacttgcattttaataagatctccgagtgatcatatgcactttgaagtgtgagatgccctgagtcatagctgtggttcccacgcacaccccacctctgggcagtgagggttgacagcttgagaatctggagggaaaattgttaaaaccataggtgtccaacctgttcacaagcatattccgattccataaatctgggctagggtccccaaggctgttaaaaaaaaaaaaaaaacaggccaggcgcggtgactcacacctgtaatcccagcactttgggaggaggccgaggcaggtggatcacttgaggtcaggagttagagatcagcctggccaacatagagaaaccccgtctctgctaaaaatacaaaaattagtctgctggtgtgcgcctataatcccagcaacttgggaggctgagacaggagaattgcttgaactcaggaggtggaggttgcggtgagtggagatcgcgccactgcactccagcctgggcgacagagcgagactctggctcaaaaaaaacaaaaacaaaaacaaaaacaaaactgtagctgactcgctcactctgaggcagcaccagatttaaggtccattcacacggatcatctacagaactagcccaggtccagccctgctgagatggagtgcttcgatttccacatcactcaagccgaagggctgagcattccttatgtgaaatttttatttaaaataattcatctatttacttattttttgaaatggagtctcactctgtcaaccaggctggagtgcaatggcacaatctcggctcactgcaacctccgcctcctgggttcaagctgattctcccacctcagcctcccaagtagctgggattacaggagtgcaccaccacacctggctaatttttgtatttttagtagagatgaggtttcaccatgttggccaggctgatctcaaactcccgacctcaagtgatctgcctaccttggcctcccaaagtgctgggattacaggcgtgagccactgcactggccaattgaaaataattcaaaataaaatgtagttaccttaggctttagctttgactttatatgtttttgttcataaaggaaatgaaaaactaagaaaagggtggcttttcctaggtactcatactcagaagtagcattctggtcaggtgcagtgcctcttgcctataattctagcattttgtgaggccaaggtaggaggatcacttgagcccaggagttggagatccacctggcaacacagtgaggccgtctctaaaaaataatttattttattttattttatttgggacagagtctcgctctgtcgcccaggctagagtgcagtggcgtgatctcagctcactgcaacctccgcctcccagttcaaacattctcccacctcagcctaccgagtatctgggactacaggcacatgccaccatgcccagctaatttttgtatttttagtagagacagggttttgccatgttgaccaggctggtctcaaactcctgacctcaggatccacccgcttcagcctcccaaagtgctgggattacaggtgtgagccatcgcacccagcctaaaaaaatgtttaaaaattagccaagtgtggtggtgtgtgcctctagtcccagctatttgagaggatgaggtgggaggattccttgagcctagcagttcaaggctgcagtgagctatgatcacaccactgctctccagactgggcaacagagtgagatcctgtcttaaaagcaaacaaacagacaaaacccagaagtagcattttctattcagccagctttcctacattgttattggtgaatgtatggcttcccagagtatatttaaaaaagaaaaccacctgattctgattctgcgattattttcattattacgggttttggagaaactagctaaaattttcatctttagatttttcttttacacagaacacatccccactagagttggatcctatccacagggcatcagacccagggaccttcgaacacgaacatctgtagagtcctttatagtgtttatagtgctttaatttatattatattatctttgaatcctcacaataatcccataagaagtaaggacatgtgtttcatagataaggaaatagaagcaaagagattatggagggcacactctaatcaatggcaggaataagagttactgttgcctagaatgcgcccttttatttgtatatagcagaaaaactggaaacatgtactgtactttctgtgtcagtggttctttggcgctcaccccaggtcaattaaatctgagtttcttgatggcaggggatcctctggcatcatccaggtaattttaatatgcagccagggtggaaaacttgagtccctgcattacaaaatcaagtaggacttatcccagcaaaacgtctctatatgcaaacctctccagggttccataaatgtaattttacgtggacatacccatacagattataaccacagcccttaaaagaagcaagcatgcctttccacagcatggttatttcagctggaccatgctgtatttactgtaggacagagataaaagcgtgaaagtaggacatctgtgttctagtcctagctctcccatcaacttgctatgtggtcttgggccaattatgtaacttctctgagccctatttcttcatatgacttctgtttctgtcttcccacacctactcagctttcgttattaagatatcaccttcagagttagactcacccagtttcttacttagtccaaactatgctgacaggtcactgagccaggacgaatcttactgtgctaaaagtgagcagcctctatgcccagaataatcttcaagatgtccacattcaagtcaagttgccaactctgcctaactccacattcaataccttattctcatcttcttccccaaactggttcctgggtttaccagttttatataattttagattttcagctgcctccttagtccagacacttagcttagctgttgtcctcatttcttacccaaaggcgcatgaaatcccattttaaccccactctaaacctccaaccataacatggtattctttgcattctaagtattgcttaagtctaggaagtctagttactgggccccacgcatcatatcagacctccttggctattgacatttgcctggctgggtcctaggtttgtcaactgtgctttggacgactggtcactttcctcaggaagcagtccctgtacttccagcttactccctctactttctctcattacctttttcaggctccctctccttacccatatctgggttcctagcatcactttcaagtcctcaaacaccactataatgccaaccaaattgaattcatctttgttctgtaaacttttcaaatctgttatgaggatgaaaagacataacaaatgtggcagcaatttgcacagttaaaacttccagacactcctgattttattaattaggctgggtttgattgttttcatttgcttaagcttgaagtcaaagttaaatcagagaatttctcatctttggagatatgtgattcttgatttacattcatgtaacaacttttatgtaggcagatacttttcggatatatctcccaagagatttatatggaatttacatctattattaacataaattggttatgctctggcattgtggctttattagccattcttctaacatttgaaaattgctattaaagactttacagttaaggtaaactctaccaatagtcttctcataagccaaaccctgtgtgattctttatatttgcattttctatttagcgtgtacagtatgtgcccggacttcatttccttagaaaaacaaggcactaggtagacttaggcggatgcaggactttaaaaatactgctgaaataatgctgagaatatttttaatagactgaagaatgttgtcttaaacatatttttatatggcagcttaaaaaaagcaaaatgtgagatttttaaatggttacaaaattaacaatcacttaattgtcataaaaagctataagaatagtgctgtaagtattgatcaccttttctggtcatattgggaacatgattgaaggtacatatgggaacaaggaagggcccagcatttcacttgagtcatctcattctctctctctctctctctctgtgtgtgtttgtgtatgtgtgtgtgtgtgcgtgtgtgtataatgagagaagtgcccaaatataatcctagttttaaaaacacacataacaaatgatagctaatggttttaggtcctgagtctttgtttcttggccaccactgagagagctgcattttgataccaatttcatgtcacctgagaagcgacttccctgagagatgccttatcacctgcaagtaaattaaaagccacaggtgtccagtaggttaacactgaccgtcttggaaatcagtgattcagaaaaggtcctgtaataaggcaaaatgtaggatctcgtcatctggtcttggaacttacaaaatgatgtttaaaatgttggttgggagtggcattgaaatactgctactatgccattttccaagaatgttgaggtcagccaaacttggtttaaaccaccttttataatataatttctatgaaacatgcattctgatttccatttcccaacagaggaactttatatattcacttaagtagatatctatctcaattcagaggggaaagcttaacatttagttagtgataggttaatcaacatcatagactactagataccttttttaaaaaaatcaggaattaaatattcttctgtttgtttttcttgtgacaggatctcactctatcacctagtctggagtgcagtggcacgatcatgggtcattgcagcctgaaaccgggctcaagcaatcctcccacctcagcctcttgagtagctagtactgcaggcatgagccaccacaccaggctaattattttattttttgttagagatggggtcttgttttgttacccaagttggtctcaaactcctggcctcaagcgatcttcctacctcagcctcccaaagtgctgggagtacaggcatgagccaccgtgcccatccaggaattaaatattcttaaggcgatcttgtctgttgcctcttgactgtgttcctttgaaagatatgaacttggactcctttatttgaaatgtaatcagccagttcctcccttttttctcttccccgtttgccaatcagagggggttacagcgcattagttgatttaatcagcatagaataatgtaaaacagtttataaggtgatgcctttctgcattcattaagcctcctgtttcacccattgaacagaaaaagagagccacattgatcagggactacttgtgataaactatctgacccacatggcctgggtggagtgtttcgtgtttaggaggataggccactgggagggagtgcttgccctcactacaccaaaggcaggctccacttctctcatccatgagatcatttagctcaaagaaagaatcagcaaaagaagcaaaagggaggaattggggcctggcatgtctacaggagtgacttgcttctcctctaccagatatgacaagaagaagtgaggtggatatttctgatttcagttatctctgaaattggtgaagtatattctgtgatgctactgacatactttttgcctttgaattttcctgtcaactctttttaaaacaacttgaatgtttcatgactatacttttgaatgcctagatgtcaacaactatacacttatgagtagaaaaaaataagttgatataagtaacgaacgtttcctggtcatagaaaaattatagtctttttatagctgagcttccagtttcttaaagtaaccttgtagagaattggtggtctggttttttaagaagagttccctaggagtagtagctacatactttctactttaattctttttttagttctagtaagagagatgcttaagctgtttttacagctatagcaagttcctggccatagcacttagaaatagactcagctacttaataaataccagttaattaaatatcttattgttcagaaaaaaaataataatttggctaaaaaatagcagaaataaatttcaggaaattctttttctgtctccttttttcctcacttgcttttgtgcaaacgtttctatgtgctttattgggcagaaaccaagaacttaatgatgcccctaattacccagcttctctcctgacagttagtttgtgtgtactttaatgataggcactatgtaactgtatttgtggatacacagatttcaattcaagttgagtacatctctattttctttttaaacatccaaaaaaaattaaaaagattatctccaggtttgatccttagaactggaggccactgatgtcagagtaagggccaaacacattagtaccgaaaggaaataatgtttggaaaatgagaatggatccataaggctaaatgatctacaaactgtgatcatttgacaaagctggaccacatgcagagctttttcttttggagttgtcctgtcccagaaagcagtgaaggatgacattgtgttagaacataggttgggacatgaagagtctggagatgtgaaaaacacattacacatccaggagagtgctaccagggatgtactagccagaagagaacaaatgatcaacactgagctttcaacaacatgaatctggctgagcgtttcataaataatccagtggacattcactacaggatagacgggcaccattcttgttttaatgcctgctggaaatataccctgtgaatctcattttttcagctgaaaaaggaatgagtggtgctttggctacatttttagcaatgaataggtattctctcaggtcagtgcattaagcaggatgttacatggaattaagcaggataatgatgcagtacatagaataaggaaatgctgactgagtcctggaaatttggaaatagactctggttaggagctcagaaatcgaaggctcagaaatggatatttaccactctcagggattttgaacctaggagtcttaggcacaaataagaagttgttaatttttctgatatattttttaacatgttcagtttggttttcagacattaggaacaaaataactggaaaaagccaaattgaagaccagagaaaactatacatttaggcaagtgaagttcagtttcacacacaaaggaataaatcatggcattttgtatgagggtaggattaaagcttttgattctatgtaatatcaaaatactgatttaagaggaagtgatttactggagtatctgtatattaatcaatgacaaacaatatggataaaaaacttttcaaatcaatcaaactgattgcagttctccatatccactaatgattttgacatttgcagatatatagaataaatacaaagttccaaatgaagcataatagttttacagagagaccaactctgtctgcattatgaactcaaagaaatgtttaatgtttaattcagagactgagagaatgttcgtgatatctgaagtaggtggtgctgctaacaaaacaatgggcagccactttgtaccgagccaagagagctcttcccatctccagccgaaacacaccctctttttctcccatcatctggtgcaggttaacacattatcacaatcttcactgtcacaattaacccctggaaaggagttgtgtcataaaaacactccataggacttcacaaatccatatggcaggcacagctgggaagacagttgcagttgataacgtagcatttcagaaatatccaaagaatctctactttgtgaagtagtgtggaatttacacatcctctcattccctcaaatcagcacatacactagggaacacctgggaaatgccaagatgcttcagttttaggtgtttgaagcccagttcttatcatttcacgcaaaccagagtatgctttttgaaaagatgaaaggacttttaaaaacaaaaggtggctgatttaaggattatgtttcttccttctccacttactgcaaactgaggtagctatgacagctctctaacattagtacccaaatatgagaaagacattcatgtaccttcttctcttgctaccctgagaatttgttcactgtctctgcaagccagcactccttctaaatgtacaactccagtttacttcaatggacacagttgtgatgaatgaaatttatgattggattctaatggattatgtaaattaggatttcaaggttaaaggaatagatttcttttaaaaagtaaaaataggagattttggcagaacctttcagataccaggccttgtcatagacagggcagatataggagtgggccaaaacaaaatgttttctcctgccatgtagcctacaggtctgctagggaggagcggggtaatgaaatcatcatactgagatgtgtgctcttggttgtgaggtgggggtgagggaaaggaaaacagggttcagtgaccatgtaaaatagaaggacatcatgtggattggggagtcagagaaggcttccttgaagaagtagttctgtggcttagatctgaaggacaagagagtagaaggaaaggaggagtattatagacagaacagctgtatgtaagtctggagtggagaggttgtcaaaagaagccaacatggcacatgagtatggacatggggaagggtgtttcagtttactgtgaaagtggtgactgaagcaatagaaagctccatttttgttcctcaaaatcttatgaaatcaatgatagccagacaccagtaagttggaaacagaaaatgttatcaaattgcctcaaatttaagttttaaaaattgagattctgggagccccgtgcagtcaatttatagaaatggtgggatgcacccattcttagctggtgaaaccaaggctgggatagaattacaaccgatgtgttaaagtcatagagttaaataaaaaataaaatatctacactatgtaaatgaataataaaataagaaatctacactatcatgatgacttgagaaaatacttagtgataaaaaaaaattacttggtgatcgagaaggaggggaaatgtcagacattgcctaaggatgcaaagcaaaacaaaatagaatgaaaatgctttggaaggaacgccttaagaaaatataagaaaatgaatggatgcatctccactgtgcttttggtcaagtacaagaaaacatggattctatgaaacaaagatgccaatgttaaaagagagttgccgccaatgcagattgaggtttgaagggagctggcaatgatgagaaatggaaatattaaaatctgcaatgcagactcagtaaaaagccaaataaacattgtagcaaattgaattagtgataagcatggctaactaggtaagtttttataaagaacataaaatgaaagtataataatcagaaagcttcataaatataaaaattaggtagtaaagttccaacccatatgtaatcaatgtaattggtaaagacaggtcatcagtgtgtatgtattgttttattgtttaatatcatcacatacttaccattccatgtgagttcatcatccttttaatagtaaaaacatattgtactttctcatgtttgagcggaagaaaaaaaattatggtattttttattttaataattaaagaagaaaggatgtttactgggagctgccacaaaaacacttggtgttttatacatggtgttacacacagttccagagatatattcaaaggatttggaaaatttttaaaaaataattccaatgacataactttacttgggttcagcatatgacctgtactcctagtagctcatatattctgttatgtttgtgtatgacacataaatttgttaaatataaacaactgggctgggcgaggtggctcacacctataatcccaacacttggggaggccaaggcaggcggatcacttgaggtcaggaaatcgagaccatcctggctaacacggtgaaaccccgtcttactaaaaagaaaaatacaaaaatttagctgggcatggtggcgggcacctgtagtcccagctactcgggaggctgaggcaggagaatcacttgatcacgggaggcagaggttgcagtaagccgagatcgccactgctctccagcctgggcaacagagcaagacttcgtctcaaaaaaagataaataaaaaataataattaaaaacatatcacaatttttgttaaaaaaataaagaaagcatagatgtaagaaataaaaatgggatatgtaccatctaagttgctagagacaataaaatcaaagaagttgtggccaggcatagtggctcacgcctgtaatcccagcactttgggaggccgaggtgggcagatcacttgaggtcaggagtttcagaccagcctggccaacatggtgaaaccccatctctactaaagatttaaaaagttagctgggcgtggtggtgcatgtttgtaatcccagctacttgggaggcttgaggcaggagaattgcttgaacccagcaggcgaagtttgcagtgagccaagatcatgccactgtactccagcctgggcaacactgcgagactccatctcaaaaaacaaacaaactacagcaacaacaaagaagctgtaatctatttaaccagagactcaaaataaagatgagcaaaaaagcatacatgaagtatagaaatatgacagatatgagtgtgtgtagcttatgaaatataaagaaatgcaacttattttaaatataagagcctcagattgagttaaaaatatgatctaaacaaaatgcaatgatacaaaatacctagactaccaacaaaacagattttaaaaagaaaaataaatgagggcagaattattagttttagaccaagcattattcaaatacaaaagcattaaattagataaaggcaaccttttttttttttttttttttttttgagactgagtctctctctgtcgcccaggctggagtgcagtggggcgatctcggctcactgccagctccgcctcccgggttcacaccattctcctgcttcagccttcccagtagctgggactacaggcgcccgccaccacgcccggctcatttttttgtatttttagtagaggcggggtttcaccgtgttagccaggatggtctcgatctcctgatctcgcgatccgcccgcctcagcctcccaaagtgctgggattacaggcatgagccacctcgcccggcagataaaggcaatttttattattaaaatacacaaaccacaatgaagacattccatttacattattttaaacaccatgaaacatagagtcatagtatataaagctaaaagtttgggaatacaaggagaaattactaatgcatatttgttacttaacttgataggtcaagtcaataaaaataagcatataaagaatttgaataatgtaataatgattggcctttcttaatgtaaacatacatacttatgtattttctctttaagcacttccataaatcctatttcaattgtttacatgttcagccaaaaaaaatttaaacaaaattgaaattatataggccaggccttattttccgccataatgcaattaaataagaaattagttataggtcaattttatacaacaccacaaattttttaaaaaccgtcccatgcaaatttcaaatcacatttctgatacctactgggtcaaagaaaagataaaacccatattaatatatttttcaaaagtgaaaaaaatgagaacaaacatatctacacttgtacaatttatgaaaagtataccctgaaacaaattaataaccttaaatttgttgtataaggaatcctggaaatcaaaatcagtaccttaagtattcacctcatgcaattcaaaggaacatagcacaaacctaggggaaatggaaagaaagaagataaaactcaaaattagtgaattagaaaacagtatatagagagacatccaagaggagctttgagatatgagatattctctccaaatctaatcaagaacaaactagagaaatacaaataggcaaaatgataagttaaaaagagcatataattttctataaaatatttaaaatcatttaaaaaactacagacaactctatgatcatttaaacatccggatgaaatgaattatctattaagaatatataaataacaaaattgaaccaagaaaatgtagaagatatgaacataccaattattatggaaggaattgaaagttgtcaagatttactctctccaagttctctggtctatacattttataaagaaaatattttaaagttttaatgtaattctcttgccaaataatttgtggcacagcaaagacaagatgaaaagctaccagtttattttatggaatgagaataatcctggcactagaacttgacaaagacagcaaaaagggaatgcctctctcttatttatgaatgttggtaacgcttacatagtgggtaatacatgtaggcactattttaaaagttttacatatattaactcatttaacccttacaaaaacctgatttaggtgttatgtattcccattttatggatgagaaaaatacctgagacattaagtaaatatggcattactcaacaattcatgaaaaaacactttaggacatgtatataaaatgagatagaagttttaaaagtacaggtaactcaaaataagccaaaataagtatttgctcaaaatataccatattacagattaaaaatacaaaaacaaaattaaaaaataaaaacataatgaagagtaaaaagatacttctggggtggggggctgggggagggatagcattaggagaaatacgtaatgtagatgatgggttgatgggtgcagcaaaccatcatggcacatatatatctatgtaacaaacctgcatgttctgcacatgtatctcaaaacttaaagtataataataaaaaagatacttctataatctgcttaatgacagccaatattatatttaacagaggacgtaaagacaaacaagaatgaaacaaggtttataattattgggtgatgatacatgaaggttcattataccatgatttctacttttgttatttgtaatatgttagaaaatatatgtaacaaaaatgttaaaagaatggtttctatggttgaatttagtgatttctaaggtggcttccagctcagctcttacatggttctctgttgttaattacctctttttccaaaaaaagcattttttgtactagcctttcggggaggaagatgtttgcattatgtggaggagtttccaccatacatggacacattggtctcctgcaaaccacgtagttcttttattgcttcttttttcatttgaaaatcattccagatactgaagttaaaatagctgtccttgctttcctgcctggagagatgggtatcactaaaaatgcctggattggcagtaatccgctttgctcctgcctggagctgttctgaatctccagtggcaggccctcacggtgttactggggcaagtgtgcagtgacgtgcatttcatctgcacacagcaacggtcagactacttggctttctgcagggaatgaaaaaatacacatataaccacccccgttcccaaatggcactgtagcctagttaagaaaattgcttgagggggagtgcattatgctaagagggctagttcattttcaggttacaaaactttaaattcaagttgacacagcttctattttcatttccatacttatctcaactggggaaatgtggtgtttgtcactaaaaaccagccagtaaaatgtagagggaagatggagagtcagtggtccgcagcctgcaagtggctgtgatctgaaatatgtcatgctttagttggtagcagataccataccaaatttgcttcccactggtagactttctccttttattttcaacaaagtcccatgtacccagcagcaatctttaacagcaaaaatgcaattaatataagtcatctcatcatgtactagcattccagatagctcataaacaattaagaatcgagtctgaattaaatgcagaggttcagggctaagtgtgttacaggaagacagagaatgctgttctgtcagttttgtgaccatgagcagtttcattcaagaaaccacatggaaggtgttccactgttaagtaccacatgtgacctctctggtttgaatatctaagtagatccataaagcttaaagtacataagctttcgtgcggctatactgaaatgtaaagaatgcgaatgaaggcacccattaaaagataaaactgggtaagactaaaattaatcctccataatcctagctttagaaactctcatctttactgtatacaggtatctttaatgtgagttattgagtaagtccaagggctcttctggtcaccctttcacatatagtctaccacattcctattccaatagaagctgggaagcattccaggataaattaattgtagaatcaatttgcttttatagagcatggatgagagaaatattgaagttttaagagtttctgttgccagacttatagaatatatttgccattcagaccctatggtttgtaaaaaaaaaaaaaaaaaaaaaattaagcattttgggtgttgaccctgggttgtgtaatttatgcatggctctggtaagctgttacctcttaatcacccaggagccccagctcttgaagcagactaatgattccctgctgactatctgctctgcttgcagttctgccttcaacacatctgtcagcaccacttcccaaggggactgtatgaaagttgcaaagtctgacatccgtacattaactactctatgactttctccattaataatggactgtcccgccgtaagctgtgagtttcctccccaacaccgaccgcttttgcttttatgtgccactaggcctgtcatcagagagacagccagagaaaagacatctggcatctgtaactcatagggggttcatgaaaactaaagcaggtagattattatctcaaatgaagttcctggaaatactgaatgatgaatgtcgtactaatggcctccttcctctagcttggtgacagcctgtaaccagttacaaaaaaaaatcttgacatacaccttcaatttttatttaagagatatagtcctaattgttatgtcaaaaccttggaaatagaggccaattattttgaaaacgttattttttccaaatctacaaaggaattgccatatgatataatagctaaaggtgttttcaagatccattttccaattaattgctttaaaaaagaattctctgaagtaaatcacaagtgcctttaagattctggctggattgtttgttaatataccttagatgcagataaaaagcgggggcaggaaagagaaaattggaagcccactgggtcagaatggcaagttttttgcttttaccaaaaaaaaaaaaagacagtgggaatcacaacagaaagaggtcggatgctgttggtgatttttgtacctctgaagcttctaaatatagaggggtttattgcttctcttgataggttccttgtcaagttactgtagaaataacttacttaccccacctggaatttagaacagggcttttaaattttcaaggactgcactgcagttgaattgaagtgaaccagatgtaagataataggggttgggaagaccctgaggaagtaaagagtacacatctcatcaataaggggcagggcattgttggttacagtgcacccaagggagtgctcttagggtcaactagacaatcaaactgacttgatttccatgggttacacttgacatctcattcacttacagaccgagcacagtgtatgcccgcagagcagtactaggccttggtcttcaatgggaatccctggaacagtccgaatagcaatctagggacttttttaaaattttttttctctattcccaagtgttatttcaagagcaaagaagttaaacttgtgtagctaagtgtagagtctcctgatttagaaggtctatgtcttaaataggagccaagatctctggtgacgttcctataggcacagcttccaaaatccccaggtcaagcctcctcattatgagtcaccacactcagggaagcccaacccaataacttctcaacagatgtgttcatttgcagtccttccagccagattcagcttaccaatccggggtcattcttataacaacatagcctgcttatgtggctgacatttcaccttaccaggtttccagggtaacaaagccagaaagttaacccaagataaagttctccatagagagagagaattttaacccgttacccactgttgtcatatgggagtataaactcagatcttttcttttcctttgttcctgcttgcccttctcctcctctttctcctcctcctccaccttcttccttcttttagaaaagctggggccggcgcggtggctcacgcctgtcatcccagcactttgggaggccgaggcgggcggatcacgaggtcaggagatcgagaccatcctggctaacacggtgaaaccccgtctctactaaaaatacaaaaattagccgggcgcggtgatgggcgcctgtagtcccagctactcgggaggctgaggcgggagaatggcgggaacccgggaggcggagcttgcagtgagccaagatcacaccactgcactccagcctgggcgacagagcgacactccgtctccaaaaaataaaaaataaaaataaaaaaataaaagctggacgactagatttttaaaaaatgtttagtctcccaatttttaagcgagactactggagtaagaatactggaccagagaacagaagacctgggttctattaatagtagtctagcaatttgctgtgtgacctccctgtgttaagtgaaaggcttgcataaggtcacctgaaaagctatttctgtgatactgttaatcttttctaattgctaaagaggtgatgcttcctgtttctctgctcattgccagggtacttgtttctcttccatcagcttttctccttctctattctgcattatcatatgaaatcaaagagtgaggaaaaaagtcaaggatcttcaaaatcatacatgactgataccaatctcatcattggactagatttctcagtgaagataatctgagggttaatgctaactctcatagaatttaagtcaaaatatctgtctttgtttgcattgcccaaagaagttggatcaaaagagttacagctgggtggattttaacttttaacccagtttttcagatgtgttaatatatagtgcaaagtttccaatgtagttagagttactacaaccctaactgaaattgcctcatactgtgacattattatatcctacaatcactcatatatctttatttttccaactctaccatcacaactgagaaaaggtaatgtggtacatttacaaataaaagaggattaggattattttcattttaatattcccactataattatctacagatttatgaagaccgagtcaagggttccatttgtagccatcaataaagagattaatttattattcccaatcgggctccaaccctcaaactatatttggccattggcttcgggatttggttatttcctcaaccctttgtgaagaaatcttttaattttttgtgggtcagaggctctttgttatatggtagaagtatagtccgtaaggaatagaaaggacgaggttgaaagtagctgtgccttgaagttattaaaaatatgtttcactcatgataacatgatcattttcaggaattttattcttcctcccttgaccacaaatattaaacgtttcaccagggaaatggctggtaagagatttagtcctaggagtaggatctaatcttttatatcacagtaagaagctgatcaaaggtgttgaaagctgactgttaaaggattaattaggtcacattgaaatatatgattttaaaacagattgaaaccagaaataaataaataaatgaagctagctgcccccatttttttcaagaacatgttattgaagagaaaatattgagccttcatcaccatttaaaatattcttaatgagcattgttgaagccattttaaggagtgtgttcttcaacataagggcaacggaaagccatgagctcttcttctaggaattgagcttatatatcactctttctttaaagagtgcaggtaatgggttgcagcagaacagggctgtgtgaagagaaccttgaaacagatgctgcaataatccaagtaagagatattggtgtctttatcttgggcagtagctgtggtggtggattctttgtgtttcccactcaacccaaacacaaaatcttccagggctccaatctaagatcaaccccatcctcttggtcactggattgcattccctctcacccactcaagaacttcactctagctatcgttttactcctctctcctgcattagatacattttctttccctgctacatcactcctacctgcatcggaacaatgtggcaacatctcctgctttaaactagtaagaaactcccactgctcaatttctatgctcctcttacggcaaaactgcaccaaagagtcatctctacatcttctctttcacggactcttaccctcagtccattgggacttttccccagaattgcacaaaagtagctctcttcagtgatgtccacaatactaaagctgatgataaattcttagttctcacagtatttgacctatcagcagcattcaatacagctgctctctctaaacttctcaaatacttgcttcttgtggcttttgggctataactctcttggtaccccctttaaatccctggatttccattttctttttttttccatttttttcttttctggcttctcatttccctgtcatctactcatattcttaaagtaaagtataagtgtcctcaggctcaagacccaggcctttatctctctgtatacttgctctctagtgatttcatccagtccaatggcttcaaatgccatctttatactgatattttataaatacctactgtcagcccctctccctcctaaatacttgacttacatatccatttcctgctcatcttctcacgtggttgtccagtaggcatctcaaaggtaatatgactaaacctgagcatttgatcttcttcctaaatcttattctcctatagttttcccagtcacaggaaagggcacttccattcatccagtggctcaagactgaaatttgggtgatagtctttatttatttatttatttccatgccaccattcaatctgtttgcaaatcctgaccactgtgccttcaaaacataccctgtatcaaaccaactctccctaccttcaaccattgcaaccccagtccaaactcccatcgtaagtggcttgatcacaagagcttcctaactggtgtccctccttctattcctgtttctccagccttttgttacataaaagccagggtgatagatagagtttgaattatttgtccctgcccaaatctcatgtttaattgtaaccccccaatgttggaggtggggcctggtgggaggtgattggatcatgggagtggatccttcacggctcagtgccgtcctcacaacagtgagttctcgtgaaatctgattgtttaaaagtatgtggcacctaccccccatctcttgctcctgcttttcaccatgtgaagtgcccgctcctgcttcaccttccaccttagtaaaagcttcctgaggcctccccagaagcggataccagcactgtgtttcctgtacagtttgcagaaccatgagccaattaagctaattttcttataaattactcagtctcaggtatttcttcatagcaatacaggaaaggcctaatacagtgactcttttaagtgtaagtcgttcacatttctccctggccaaaagccctccaaaggctttacttctcactcagaaaaaaatccaaacctctcaccttggccagaagcccccataaactggcccctggccatctgtccgtcattatgtccccacaacccccatccttctgttccatatactgtttctcaaagacatgaaacacgtccctcctagcaatggggcctttgtgagtgttgctcccatgccttgaatgtgagtcccccagatacctcgtggcttgcaaccttctttcatttcaaatctctgctcatttccaccccttcccgatatttttcaaatagtactcaccatccttctccatcgctttcactgctttgttcttaatcgcatgtagtactgtgtgacataatactcctttttgagaattatatttattgcagatttgcagaatttcacggttgtactttaaagcattttatgttaaggtcaccatagatatattgtgcagtagaactcagaagtagaatgaatatgtaatataagtctcaaggcttgcagtaggctgctttggggtttgccttctgacccttcagaagtgtgtgttcactcagctgttccggtaaggacgcctcgatggaaaagtttaaaatgtactggttcatatggactgggcaattacccatattatgtaattgagggacacctacagaaacgatctctttccccttatctatctgtattggtctgccatcatacctgcaaaattccaccattactctctcttaatggaatcaactacaattagaagtcaaccaacaatgcctgtataggaagcatatgtagagacttttagttaaaattatatggtctaatcagcaagagtctatttaagggacaataaagcagaatatggcttattttaaagcattatagaggctctctcaacccaccaccctttaactgactttctggataaacagtctcttcattccttccgtaatgcataatgactgttgcctgtggcaagctgaaggttcatggctggtaggctacgctcaggtgaatttggagcactctgttcctaggtgttgagttggacactgccaaggatgagttgtttttattcccaaaccagtttatgccagtttcacttacaattataaactttaaatattatataaactaatgaaataaaaattcaaaaggcaagagttgtcatttccgcaaaaactaggtgcaatcctttggaaaagactcaagaaaaacaagccaataaaaaaattaaaggttctacggacaattatacaagtttatttttaaataaaagacaattataattcatactctagtataattctgtactcagatcttgtcacaactcttttgtaaggaaaccaaaactgtaaatgagagttgtcaatgcatgatgaacgtagcttatgtgaaaataacaaccctagtccactgtcaactttaaaaataaataaaaggtaagagttacattgttcttacatgaaaatattgacaaataataaatttaattgcctaaaaataaattactttattagtaaataaagataagttatatataaatatataaactatatgttatgataaatttcataaaatgtttatgacatacatatggcattactttatggtttcccacttctagcaacttttaaaattaccaactaattctaggtcccaaaagtgtaggacaagcgggtttttcacatggtttgaaaacagttttcaagagtagagattgcagtttcattacagacatgttgagaacagcaaaggaggtaaaatactcagatcaatcctggaagtaaagtaaaatcagcatgcccattctacatatgaggctaacagagagtcagtgacgtggagttgagctgttttcagagaactaagatttgccttcttcaaggttcatgctgttagctttgatgctacaataccttttcaaacctcttctcctatacatctcatttagatctttcataacttggctttttcaaaatagatgtcaactaaaggcagctgagctaatcaggtattttaattaatggcatctgaattattatgacagtgtgatcatagagatgccatttttgtcttcagtaatcaacccttcttccttaagaaggtgtgggagcaggtccttgattaaatagatctgggaaatgctgaatattggattctcctcttggagattttacaatgctaataagatttggagaaatcctgtagtaaagaaatctgcccagcattttcaacccagttgatatgatttggctgtattcccagccaaatctcatcttgaattgtagttcccataatccccacatgttgtgggagaaacctggtaggaggtaattaaatcataggggcagttactctcatgctgttctcatgatagtgagtgaattctcatgagatctgatggttttataaggggctttccccttccttcgctttcattgtccttcctgccaccatgtgaagaaggacatgtttacttcccctaccaccatgattgtaagtttcctgaggcatccccagccatgcaggatggtgagtcaattaaacctctttcctttataaattacccagtctcaggtatgtctttattagcagcatgagaagagattaaaacactggttatttcccaaacatatttgtccacatgattttatcatgtatgcctctttatgttggactaaaccagtattcagtggcacacatttaaaaatattgctattctcaagtaaatttggactcctctgttcatagctgttgagttgtacactgccaagaataactgatttttattcccaaaccagtttatgccagttttacttagagattattactagggaggccgaggcaggccgatcacctgaggttgggagttcgagaccaccctgaccaacatggggaaaccccatctctactaaaaatacaaaattagctgggtgtggtggtgcatgcctataatcccagctactcaggaaggctgaggcaggagaatcgcttgaactcaagaggtggaggctgcagccgagatcgcaccactgtactccagcctggggaacaagagtgaaactcggtctcaaataaataaataaataaataagtattatataaatgaatgcctttcatatgtccattcctgttcttatatattctcagcttgttgaccacagttccctgggctgaattttgtgagtgcacccttactttgttcagctttttgtcattatcaggagagaaaaggcaaatgttgcaaaaaaaaaaaagatagacttggcagttttttctaatagctaaactgtgaccttggcacccatccccttagaggtcagtaagaggcccttgtaatcatccacaagcagagagtcagctaaagactgagatcaccccttgctcatcagatcctggttaagaagctcatgaagaggaaaaaaaagttcagactccttccacaagctaaataagtgcctctagggtcaggcatcatcaaagagggtcaactaatcaatgttcaccaagcaatttgtgatctgaagtgttgcaagaatgctaaaattatatgtatcttgtcctttacaactgaagatggcacatcaggaggtgatagctctgtgttttgatgctggctgtgactttgtgccagaccttagccccggccctgctgcaggcacacgtccttctttacaggataaccaggcaatttgtggtttactgcctgctgtgtgtgtcctgtgcaaactcacagtgtgctgacacatgactgcctagtaaatatcaggggaatattgaatgctcgtgctcagagcttttattgggaaacactttccctcatcccaccctttgctcctctcctgaatgtccaccaccatgcatcagaacagatcatttatagagatactcttagggaatgccagtctgtgccagtctgcctgtcttccctgcccacatgctcttaccggggccgacttgacacccaaaacaactcagagagttgaagtgatttgcccaagaccacacagctaacaactggcaaatgtggtattgtatctaaaatactagcacagggttgggcacagtggctgacacctgtaatcccaacacttcgggaggctgaggcaggaggactgcctgaacccaggagcctggtcaacatagcaagacctcgtctctactaagaataaaaaaaatattagctgggcatagtggcatacacctgtagtccccagctactcaggagggtcacttgagcccaggaatttgaggtttcaatgagctatgatcatgccactgcagtccagcctgggcaacagagtgagaccctgtctcaaaaaaaaaataaaatgttagcataggcttttaaatcatgtgtttttcacttacagtgaggctgagtagaaatctggggaagaattaaagcagagattccagggatatgttagggcagagcaggactcatggaaggacaagggggttggttttgttttcaatagaattgagaaggtagagtttgaaaacacatttccagaagtccccgtgttggttcccactggatgcttgttaagattatgtaatactcttcagtgctatgtctgttgtttaagtgttctgttcattgggattcttttggttgcaagtgccaaaatccaattcaaatgagcttaaataaacacgggaattttttggcataaaagtcctattaactacaactagattttagttcccaaatgatagtgttaggatctctctatcatctcttgaatttgcttttcacaagctgcctctcactgcaaggtaactcagcgggaaggagaaaatgcttcatttccagtaattttagcaaaagcttcaaaattggcctttatatgctaacttgagtcatatgcccactcttaaaccaattatggtgagtggaggatatgagggtggtgctggatagaaaatgctgattgggcagccagacgacataggtctattcctggagccagaacggagattagcctcactcgtatagcatctactaagagtcggggagaaatgattcctgattttaaaaaagattagaatgaggttaccaagtcaggagaagctaggcacccaaaacaaatgatgtctacttgtcatcttattgtaaagtagggttgcaccccaggatcccatcccgaagagttatttctagatgtgagaggtgtataccatgtacaacaagatccactgtcctggaaacatgagcaggattcaagaaacttgattctcctaaaactgtatctctgctgaatatatcccactatgtccctagtgccaagaagaatgcctgaacctaataggcccacatgaagcatttgttgaatgagtaatttaaaaccaggcagaagggatacagagtttcagtttgggattatgaaaaagttctagacatgaataatggtgatagttgcacaacattgggaatggatgtagtggcactgaactgtgcacttacaaatgattaaaatggtaaacttttatatgtattttgccacactaattttttttaaagaagaaggggaaaaccttaggcattaaggaaaacaagattttggtgacttctggatttttgctttccatttaagcttgccttagtgagtcattggacctcaacggctaggcagtcactgatgggagcagaaagaagtacttatccagcacttctccactgaagttgagcccaaacattggctgttccctactttacagaagaagatcaagggatacaataaggttgggattgatggacgtcaggaggatttgctttaggaatgcacgtgatatatgaaaagggttcagccagaattcacaaactctgttgtctcctatggccagccaggcaggtaagaatgtaaatgaatcagataatgtgagtcaggtggagatccacagccttcctttaaacaggccagtcactgctcatctcagaccagttattgccttgaagaaatacaggttcagtagtgcctggtctcatggtttttcatgagaagccgtatgtgtggaatcttatatgaaatgtttccattttggaaaatgttagcaatcacttttttttcttttttttttctgagacggagtcttgctctgtggcccagactggagtgcagtggtgcaatctcagctcactgcaagctccacctcccgagttcaagtgattctcctgcctcagcctcccgaatagctgggattacaggcacgccccaccacacccagctaatctttgtatttttagtagagaccaggtttcaccatgttggccaggctggtctcaaactcctgacctcatcatccacccacctgagtctcccaaagtgcagggattacaggcgtgagcctccgcgcctggccagcaatcactttttaaatgttctacagtagcatggtaaacagaacacagctattttccagatctttccacttacttccagtttctttccaaggatagactcttcactttttaagaaatgacagtaatgatctcatgtatttgtttatttatttttacgtttttcagtttaaggtgacacaaatggttaggacagataccatcaccccaattttactcttgaagccactgagactttacatggagggacttcagcttgcacccagatcatgcgaaaccatgttctgtgccatgtgagactttaagaggttgctttcaaaactcccccgcaggtttccttatttatcatttatctagatgaattcttcctcccttacattggagaaaacagagtttctcaatttcccatgactctctttgttagtcagatgggagagaaaagtcattacctatgcgaacctgtagaaatagatttgtgtatttttcagtaataaataaaataaccagggaatttaaatcatataatattttccatcttgccagagatggatttttttttcccctggggaaacttttaacttaagaatgtgtttcaatctccttgatgtgttggaataatcattaatgtttacagttgctgtagcaactagaaatgctggcaattgagtaggaagggagcctgagagaggaagataagctgtatcaattattgaacatctgtcaaacagttagccaatttaaagtgacagacaaaaagctagaaatcgaaggtgggtacaatgtatttgttaagttaacaacatcagttatgtattgttttgccactattacagagggataattaacacttatttgcatccacataaagggagcattttctatggcgaatatacagttgcaagtgtaaatttttatgtcataatcatcttaatccatctctcgtggatgttagtttgcagtttcaatatctatttgacagacttttgcattttttaagagcacagaagtgaaacactatgcctctgatcatatgcctctccaggcactctcctctccttatcctaaaaccactactcatttatgcagaagcagtggcctaaatattggccacacgtgtctccagtactctgtcttactctgatggcagttatcatagatcaattaaaactcctttttcctctgagtctctggcattctcaaaaccctaacacagcacctggatagccaatgccagttaggaaggactctgtagtggagtctatttgcaatccctgtctgttaatgatttctcaccttcgcttggcgttttattgtttacaaagtgttcttacttgcatagtctcatttggtcatcaaacctctaaggtgggggttgttatcccttctttacatgtgagaaaactgaggcttagaaagattaagtgatttggccaagatcacagagttagacagaagatacctacttacctactgccttttccactgcactgtaaaagaaaagatcatcaggtaaaaatccagggtgatgggtttcagtactgccctaatcacttactaactaaaaagaagaagaaaaaataataaaacaagaaagtatttaatccttctttagatagttctctctgcttctaataaaggagaactgaacagattttttcctaggatgctttcagctataatctgtaatacatgaactctaagtaaaatctagttgctaagtttctcaattacagcatttgtttattaccaggccacaccctacctcgtggctgcactcccagtttcttcccagatctcagttttttgaaagtgagagagcatattaattttataatttttgctacttctatttgttagcataataagcatgctaacactgtatacatgatcacaagatttaattttctggcctggctttgtttaatgttaagttttaatgagtcaccttttctctcttcctcattttcttttctggaaagcaggattattagctccaagagatgagtcaaatgaagtaacataaatggaaataactttaggaaaataaaatactgtctatgataagatattagggtagctttattccttataaattctgacctgatctgataatattaagtagatgatgatttagaatgggtcttcagaataaatttaaaggaacatgtaagtcatcaaatgattctattcaccatctttgccttatcaacaataataataataaacattaacatttattgagtgctaccatgtgctcgacactgtgctgattataagtagcaatttggctacagtattgcacgtgatcccccaaccctcctatggtgtgttattattatctccatttttcagatgagaaaattgagtcttagatatgttaagtaactttccatgctcacaaagtagtggtaaaccaaggtttcaagaccatgtacgtctaaccccaagttctagagtagatacttgaccggttataaataatacttcacacacccaaggtaaagatatttattttaaaatagaacaaagcatggtcttgcctagatgtcccataaagagctgtaatcatcagatgcccacttttttcctttaatttttcttgaagctgacttttttcttgcaagtctttgtgttattgtcttcaaagaattacaagagtcattgggaagaatccaccatttctaagaaccagtttttacgcagaactattttaagtggtaccagatggataggaaattagtatacaactatttttcaagtggggcttaggaacaatggtaagaaggggccattagtaaatggaggaaggtaaaataagtctctaaggagaaaaagaaatgacaagggtttatattatattaagaaatttttcagatactttttatcacaggggacggaaaaaaaaaaagaacagtgtccactagggagttttttataaaatgaatttattgtttttgttttgttttgttttgtttttgagacggagtctcactctgtcgcccaggctggagtgcagtggtgcgatctcggctcactgcaagctccgcctcccgggttcaagcgattctcctgcctcagcctcccaagtagctgaggctacaggtgcccacgaccacgcccagctcatttttgaatttttagtagagatggagtttcaccacattggccaggctggtcttgaactcctgaccttgtgatctgcccacctcagcctcccaaagtgctaggattgcagccatgagctactgtgtctggcctaatttattgattttttttcaaagcatattacctgaatagaatatttcttctgagtagattttcttgaggaattcaaccaccacatgtactcacttctctgcctgtcagttctgagtcctagtttcttctcccagaccagcttgtcaaaaatacattagacatgagcatggacactttgcgctcgctctctgttttggcgtcttgaaaccagaggaaaaaagacctgtttgttcagtttgaattttaaaaatctctgattggctgatttaagtcatgtgatcctcactgaaccaatcactgtgtcctgaggtatgattggtctcctgtgactcactcccatctctatgctggccttgggggaatgatgactgccgttccccaaaaaccaattgacgaagcattgctaagaagatgaaaagtgcctttctggcaaacctggtaataaagccaaactcatagatgattaatctttcatctagtcctcttcactgcacctcaaggcagaaccggaccattgcagccagtgatggtcttttttgtttttaaaggtccaaataaaagaacaaaatacctttattttgaaaaggatagttccattctttacagaccaacagaccgaatgcttttgttattggtttcacaggagcattagcaagacgcagggaagcggggaaaagcatcttgggccataatgaaaactggcattttatttttctttcttcttctttttttttttttttttttttgagacagagttttgctcttgttgcccaggctggagtgcagtggcacaatctcggctcattgcaaacttcacctccccggttcaagagattttcctgcctcagcctcccaattagttgggattacaggcgcctgccaccacgcctggctaatttttgtatttttggtagagacggggtttctccatgttggccgggctggtctcgatctcctgacctcaagtgatccgcctgcctctgcctcccaaagtgctggcattacaagcatgagccaccctgcccggctgaaaattggtattttcttagcacatttgattaagggttaatttgtgctcgtgatttaaatgtcagttgtctgaattttagatcacaagtttaatcaaggagaatgtggaattgtttaataatttggtgaaaaggttgtgtgttgttaacttgtgtgggagttgattatattacttgaaagcttgctcagtcagtcatattactgcttgaagccttaaagaaagtaaataattagagttaaactgacattttccaccattcaacatttttttcattattcctgagaatccattttagttcccatattgaatcctcttttttctttcttcacagaaattgcttagcttaaagtaagaagacagattttgattatgctgtgagaaaaagcaaaatttctattaattatgatttgtccagtcaaaattttcctacgaaatatatttaagtgctgatggtacgagtgacccgtacaatactgatatttcaggatttaactggtcacctagttccctgaaattctcagtactcctgaatgttgctatggggttaaatactgtggcatacaaaagaaaacaaggttgtcctgatccctaccacagtccccctcaaccacaggcctggcacatcagtcagggtaatcactgctggactgccatgtcattggcttagttaagctggaggtttcagttgcagtggctcctggcataggaaaagaaatctttgtcatggtctcaagagatgtctgttttaatcccaaatctaattccactgatagtctttgtggtcttggaatagcttatgtaattttctatatctcactttccctgtctctccaatggaactaatccttattctacttatttctaaaaattgtcagaggcaccaaatgagataatggatataaaagtgttttgaaaatgtaaagaagtaggaaagttgtggttctgctgatggagatggaggcttacttagtaaggtgaacaaaagtatctggctcactggatccagtttaactttccttgtgcatagagatgtcttattcagtccaggtgttcctgtcacctttgagtaactgtgatctgacctgtgtccaggtcacacgggtgtcatctggtaactctagttttcatcaacatatgtcatttagcgtaagtcacatcaggtggactaacttcgctgctgcatgctttcctttctgcctttactgagtccttctcattcttggccagtcagtcatattttctttctgtcttagtaaactcagcaaaactgcaccagagtcagaaataaatggaaagggaaggatttttaacgaaaggggctcactcattctgacttaaaacatgtattttgatagtccagaggttttttttgttgttattttttccctcctctgatttcagtgaatttgatttaccattaatggtctgatgaaagagatatactttcttatttacaagcgacttctttctcaactaacactttgggcctggagttcagcaataatactgttgctccaggaaacttctggcatttggaattccacttcgattcaactaatgcttagtaagttgatttcacaaaagtaaagtgtatgttctctggccatatgtattcttgtccacaagcagtcttcaagcctggaagatggaggagagatgagcaactgaactattctaatacagttacaaacaaatttcaacgtgtgaaataatgggctggttgctacgaggcaaaaaagaaacaaacacttattttgttgttgaggagagaccacatgtaattttcctggtcaggaaatggctttttgcaaaaggtggtggctgagataagtaaagcagggaaacacgtcctgagaagagagtgcacaagccttgtcagagggactgaaaagcacccggcacacaaggggatcagtgactatttttccactataccttaagcaacccttcttagcagtataaacctttcttaaaatacaatttcgtggggaagtgcaaatttcaaaaacagagctctctgcttaaagcccagatggacgggcacagccctcccactgtgtcttctctttgcagctacaagcgacccctgcaggaatactatgtattgtatgaatccattaatcacggatgcccttactcagcctccctaaagttttgcaactcctcgcttgagggatcctccccaagagtatacattaacaaagagtaaagagtagaaagctaaaattaagtaacttggggtcctgttatggaaggatttgaatgtgagctggatgcattttactttatccaggaggcagtgggactcacagaggatttgtgtgggaaggaaggacatgactcaaagctgccctttggtaggattaatctgacagcgttgtatgggttggcctgcagtggcactgaacctgacacaggcaaaagagcaggatgttcttaggccagtgacagatgacggtgagacaaaaaacctctatggaattcgaatccacaggacttggatgctgattttctccccagcaatgggacccacactccttcctagagagaacctgggatcaaaccacagggcttgtatgaagcgggcataagtgtggagctgaaagagttgtatcatgtgattttgttctgttctcctgctacttgagaaaaagccatattctttctgagactgggcattgaactttgatagttgtctctttagcttttatgtgctttccacattatctgaaagtattctatacttggctgtcaaagggtatccatgcttcaagggattaacacttttaaaatgagctttgtgtgtttgagctctttgtaaaatatggtgatacctttgatttcttaaaataccaaatttttaacaaatagctgaaagaaacattctttatcccccatgaacagtgtttccatctgcccatcatagtccacttcagctgcatctctctgccatggctttactggtttgatggtttgatcacactgaacagactgggccatctattttttgttttgtttttttgagacatagtcttgctctgttggccaggctggagtaaagtggtgcgattatggttcactgccgccttgacctcctgggcgcaagcgatcctcccacctcagcctctccagactcctgagtagctgcgactacaggtgtgaaccaccatacccagctaattttttatttttgtagagatgtggtcttattatgttgcccatgctagtctgggccattctttgtcacagtcaggcaagggtctaatgtcagttctgtatgatttcagcaccccacttttatcccatcaaaatactcatattagcttatatttgttttcttcagcaccattcttataccaacaaaagtatgcaactaagggtcagttccatttatttatctttgtgtctgtatcctaaagcaggggctacaacctaaattgcctatagattcatataggactggtatatggagtagggaatggtagaggctatggcaaactggagactgagtgcctgttcctcagtggaaagctgctattcacctttgacaatcatttgcctgatggaatgagagcctaatgtatccaaaccttttaaaacagtgtttctcagagtgtggtcttcaggccgacagcatcagcagcacctagaaacttgcaattcttgtccctccctgttccacctccagaataagaaattccaagagtgagatccagccttttgtgttgtaacaagcctttccagtgattgtgatgcttactcaaatttgagaaccacttgttatagtggacattgtgttgtatcactcagactgcttttgaggactgatatttgaggactatgtttgtttcaagaaaagcccaatatcaaggccaggcacagtggctcacacctgtaatcccagtactttgggaggctgtgatgggcagatcacttgaggtcagtagttcacggcaagcttggccaaaatggtgaaaccctgtctttaccaaaaaatacaaaaattagccaggcacagtggtgcacgcctgtggtcccacttgggaggccgagatgggagaatcacttgaacccaggtggtggaggctgcaccccggcactccagcctgagtgacagagtgagaccctgtctcagaaaaaaaaaaagaaaaagaaaaagaaaaacccaatatcaagatatatatttgatttttagttttttattatttatttttaattgacaaataaacattgcatatatttatggcatacaacattttaaaattcgtatacattatggattggctaaatcatgctcattaacatgttcattacctcacataccattttttctatggcaagaactttgaaaatttactctcagcaattttcaagaatagaatacattattagtaactatactcaccatgttgtacaatagctctcttgaacttattccttctgtctgactgaaattatttattctttgaccaacattcctccaacctccctgctccccagctagcttctggtaatcacaattctactctctgtttctatgtgttcaacgttttgtgattccacatgtgagtgagatcatgcactgcttgtctttctgtgcctggcttatttcactttgcataatgtcctccaggttcatccatgttgttgcaaataacagtattttattatttttatggctagatactattccactgtgtatatatatcacattttcttcattcattcatccactgatggacacttagttgattccatatcttggctattgtgactagtgctacaataaacatgagagtgcagatacgtctcttcaacatttcattgcctttggattttcagtttcataatatagggaaactataacagacacatccacttgtcagtctcagtctgtcctgtgcactgtcactcttcagcctccactccagtctgaacatgctaacaaaaaggatgctttcctggtttttttttttttttaatgacttcttcccttgcaggatgcaaagtttactgactccagatctaggcaatatttctcaaactttctcactgatacagttctgagagcagaggagagacagggaatgcagaattatatgctgaagccattcactgccaaatacaagattttgttgaagcctttccatttgcctttaaaaatcatataagttgtatgtcctattttgtcatatactcatatttggcttattgtctaaacaatgagttaaattactttcaagttaaattccgtaacttccacccacaatttcttaaagaaaatctgcaccctagaaaaatgctcaatttacccccaaaaaatagaggcaagaaaataagaagttacatgtaagagggggaagttataagtcatactcaaacatattcaagagccatatacctgaccagaaaatgcaccttttgccatcttgcttttccatacctccactgccacatctgagcgagtaaatagcatgtactaaaaatatcttgaacaaagcgagtagtctcttagttggaaggcttatttttagaaatacctggcacaaggttggatgagatttagtactaggccttatctaatccttgcctcatatgggcaccatttcatttctccaaaatcagtactgcaaagacggtgaaaagctttcactttatgtgccaacacaaattgattggaggtaattgcctgaaacactgtactgagaatgattctcagtctgtgtctggcagagtcaattataaatgttagccatgggtgtaggagtggcgactggtggtccaagtgacagatatctgtcatccctgctctactcagcactaataaaaaatgaaagcagtgtctgaaccctggatggtcctgctcattgcttgggacctgtctaaaccaagttctctggaccacagaatattcctaataggggtcctgacagctacagtcatgatttcagcaacctaagctgcaaagggtcattaccgtcattataggtttaaatacaaattagtctgtcttctaattaatagaggtacaatatctctcccatttccacaccttcagatctcaactcatctaagacactgcccctccactcttgtttcccaagcattgttcactggatgacagctcacatatgactttatatttatcattctgtgtcttagtataattaaaatgtcatccagaggccccctctctcagaatccaaagtctattggtcattctcttcttgagagagctctttcatatgacatgagtggttttggtttcttctgaaaccaaacactcttgccttctcctgctacctgtttattgtgcacaatcatcagtgctatttaattcttgcagttcctggtataattcttactttctcagggaaatttttgggttgctcgcaatttctaacatttttttttcgcaaaggtcagagaaagacaaggtatcaatccatttacgaaaagataatttttgttgaaaaaaatgccaaaagaaactctaagaatttacattaatatgtttggtgatcggtgtaactcttggtttaggcagggaaggtattcttttaattatcctatttttcagatgagaaaactgaggaatagaaattactttcctgctgattaaatcccgaagccaagactcaattcatgtctcttgacaccaattccagagatctttccatggacttatgccatttttccctttgctcagcacactgataactaattccaacccctgtctttgtaactgctctccagcacacctctccatctcagcactgagctcagtgcttttgcaaacaactgatgctttgtaaatatttgaccaacaaaggaaccaatgaatacattcattttacccatttcatttgtagaaatcacttaaaatacacttttcacatctactttcttagaattatatatccatttaaattcaacctcacaaacactgtgtaaaaaacaggatacatattgataaaactatctaaaggtaaggggactctatcatgctgttaaaatcatttattaaagccaaaatttgttataatgcaaagactaccattcatgtctcctgacttaactctaatatcttccttctacaaaacacaacgcagcttaaatcaaataaataagagtgtgtgtgtgtgcacgtgtgtgttccagttcttgaccttgccagtaactacccttgtgattcctagcaagttactgggtttccttggatctttctttccttatttgtcaaatgagcatgttggatttgatgatctacatatagaatgtacggaatgatgaaagagactgagacatcatgtaatcccactcccccaatttatagataaggaaaactgatttcttctggctccaaaatacatttttaaaggaacatatggcttcctaacagaatcagctcttctgaatactggggctaccccacagtcccatccctgccacttgtcaaatgtgtgatcatgatccactcatacagtttctctagacttcagtttcctgatatgtaaaattgaaaaagttggactaagagccctttcaggtttaaaactttgaggttaagaaaggcatctttgaaaactgacatctttgccactactgggatatgactcagaacataacgaagcataatatagctctagaaataaattggtgtcaagaacaattaaagagcaaccatccagagaattctgattgatcatttgtgtaatctgttcaatgagtacctggatttgaaaattgcttgattggtgtcttcttttaaaaataagagccatacatcatttgttgttggcttagagatacagaaaaaagaaccaattaagtgagcttcagagttaatttccaatagatttggatgctgcaaaccaaaaaaaccattgctaggcctttcttctttaatgagtatcacaatacaactagcctcagtatttttcagttgagccccagaagtttcacaatccatttaatatgttgcattccaagtatctgtttactcagttgttaaaaattgccaatgggacagaaactgtctgtcacttccagagcaattagtgtgtgaaaacttatcaaaagaaatctgtcaagtttgagtaagtataaatattgcatgaaagtccctaaggaaatcaaactgagtaggatacacttttgcgagttgcagcacagaaaagtttattttgttttatttacttggctttatttttcagaatgttgatagtgcttcatgtaacccaatggattaatgttttgctctgataaaaacagattttggttcttaagggaaatctcaattgtatattgagcgatataaaaataccagatcttggtttcaaatatgaagagctcttactttgtcctagatgggacactggaatgagagttaagctagaacgagtaggttatagtccgcctcacccctttttggtgctccagcctaaccctttctagacctcagaattttcttatctttaaaatgaagaaataggacaagcgatttgttgggtatgttttagttgtactacactttttgcctgctttgatgtctacattctcattacattatattcctcctgctccttcctgattgccctgaagagataaacaaataaaaatacaatattccaggtggtgatatttgatcgtgaaaaaaactaagttaatatcttggtgagagatttcccctgttttaggagcttagtgcttaggccaacatgttctcaccagtacaccagccaagacttttctgctgaccttcccacttcaggactccacagtatttacaaatgtcagatgttgaaccatgttggttaggttccttagcatcttctgtttgaggctcttcttggcatctatggtttcttcttttttttttttttttttttcagcataagaaatggttacgctgttatattgttattacaattggggaaacattacaactttaattcaatatttgttgttgttttctgttgttctatttaatattaatgattttgtagaaactgaagtaatacagttaataatccgtatattttacttattgttttttgaattgaactaattggtacagcgtttcccaaactaggttttttgagctgtgggggttagatggttgtggtggtggtaattccatgagcaaataagtttggatgcttaaacactctctaaggagtttcaaggacattggcatgacaaaatctcttgccagtcctgaaagaaaaaagttgaaactccgttttactttgtttaatccagtacttctcaaagtaatttgatcatgtaaccctttgagttttagggaggtgggggtagaaaacaaagaattaatcatcaaagaccactgtttaggaaatgctgcaggaggcacttccggttgtttgcatctctcactaagttactttagtcacaaaagcagtgaaaccaaaggaatcaacctatttttaattagatcaaatagcatgttaattgaattttcaaaaaagtttttacttctataatgattaacctgttgaagtgcaacaccaataataactaacatctgtacagccctttagagaattcaaagtgctttcacataatcggttgctcaccacttacctgcatcacatttaaaattgtcctcattttatggaccaagaagctgaacatgaagtttaaatggcttccctaatataacgcagatttgaactttagtcttactttgttgttgttgttgttcctctccaattagaaaaagaatgaagcagatgccattttcccaatatcgactttctggttgctaaatgagcctcccgcagaattcagagagccttgcagccagtagctactactgagagttctgaaaaatattgcagggaaaaaaaaatcatttcctagccaggcgcggtggctcacacctgtaatcccagcactttgtggggccgaggagggcagatcacctgaggtcaggagttcgagaccagcctggccaacatggtgaaaccctgtctctactaaaaatacaaaaattagccaagcgtcgtggtgggcacctgtagtcccagctacttgggaggctgagacaggagaattgcttgaacccaggaggcagaggttgcagtgagccaagatcgtgccactgcactccagcctgggcaacaaaaagcaaaactccatctcaaaaaaaaaaaaaaagtttccggtatttgattccaactctccttggagaaatgtgagttgattagtattgtgctggtaaattacattctaacttccatcatgtgactttggaggtgctaatttatacttaaaactctcttataaataattaggggataggtaatcttctcattttgcataggagaaagcttaggtgctgatagattactaggtttgcttgaaactcacctgttgagtatgtaaggactgcattgcgatgctgtttgttgaaagcctgccatacgggatagtacttcttcacaatgtattataggggcttttcctcccccagattttagtttcttgaggaagctttctggaaagcacttgtatatttacactgagtatcctcttgacaccagcatggggttacttgtaatgacatgcacatgcgtaaataaaatgattagccattctcatataaacataattatatctttctaaaataatacatgtggaaatgttataatccagtgataaagggaaagcaatgtgcatgacccctcctttgtgcgtaaacagtggatttaaggcagaatatgtttcctgttgcacattcagttgttaaggtcaagtacaattgggacacattgaaggattacagtacaaaaaatgccttttacagtaattagcgttctctctacaaaactgaagtgacctttctgctattttccaaggacactttatacatttagactttagctcaggatcatatgaaaaagtgacatataagaactcagtcaactagttctgaaaccagaggccccattgcatttagttgttcccttaccctcccctcaacaaagtaatttttgaagataaagtgggacatgttggctactcagtgccagtagctagtatatcacttctccagctttggacaaatctggaaattacactttaaagagaggaatcgtggaatgcctggagctgaagcagtttgatttccttggagcacaatagttcactgcagcaaatcatttatactcactgtcatttagtggtcttctctgaaatggaaagcatgggctcatgtggtccttcataaaacatttacctaattcttataaaagttagaactttcaaaggaacatttttgatacaactgcctatgaaattcatcccactggtcttatgggataagggtgtgtgaaaatgttgctgttttatcactatctcatatccactccctcgtggatctaattttttttaatatggatgtatatttgtggaatcagtcaactagtcagtcagtgtatacttaatgagtgtttgccacagtgttaaactgctctcttactaaaatgatggaaaagtattcaacctcacaagtgagaagaaaaaatttgagttgatagtaggaggcattgggagaagactgcattgacactcaggaattattctgtttctaactagagctaagaatttgaataagttactctgttcctaggtgcccgtttctcagttaatggaaataaaactatcaaatatattggaaagcataaagtgctatgcaagtatggggcattatgatgtaatataatgattattatctataaaacaaaagaaatgatctaaatagtttccagggtggcttccagcattactatatcaagattataggcaccctgggtctgtaatttgagcattactcaatacatgttacatagtgcctgacacctgattagcaaactataaatgcttagcccttgacttaaagaggttggacatcgcttaatcagctatcagtgtatcttttacttctctggaaataaaaccttattgactgatagtagaaaggctggtaaaatgccacgggggactgtgattacttcctatctgtatttagtgggctgaaaaagagtcattggacaacaatgtatacatttttaacctgatcatttctttcatgaaaacagtagagttccagtgccaaaagacatatttgtaatgaagatttttttcctttcagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggtgagttttcaagtaattttgttaattttgtttctgcaatcacaggatgaatgtggaggtatgttatgttgttggcacatgaagctttgttgtctaaattaaatgtaagaaaagtttactgcagcctatatttggtacccatattttctccacttgtgtaagagataaacccatgaatccattttggaaaactaattagaaatctaattgctaatctcaacaggaatagaatgaggatttaggtgaatataaataacaaaggaaggtatttcttgtttctctcccacttaaactgtatacacagtcagaatgaagtgaaaggttgaacaattagctcattaatcaattctgtgtaatttagtattctgtgtccaattatccaaataacttctggatgtacagtactgaacgcatagttcccaccacagtgaaatgtagacataacaaggcttgtttgagacagaaattttaattccccacactattagaatatttcaagaaaatatatgaaattcatatattcttaattacctaaatgacttaacaatgtgtagtaaaaatcactgtgtactttgtaaagacggccgtgtatgccagactctaggagtaccatgccctttcccaccacgggtttttatatatgctgttccctcttcttgaaatgctcctcctttccttagtcccatcctctcagcttctcccttggataaactgatactggttcttccagtttctttaaagatgtcactgtttccaggaagccatctctgcttgctcaccctgccacccaaccatgctgcgtcaggtacctactgtatcgagtctacgaccataccccaaaagatctcataattctgcatcacagttgtctgtgttcttcactgtctgtcttactagcaatttgcctttttaaagcatatgtagtaccttattcacagccacctctgctgcacctggtttcgcaactggtacatcgaagattctcaataaatatttgttgaataaattcaaacaaagacataattaagcccttcaacaagggctgatatcatgatttaagcagtcgttgtagacatgttcaggtttctattctttttaaatccttttactgtctagtacacattcagatcttctattatgaacaggaatgacgagacccatcacacaagtgaggataccatcagccaaaaacattaataggaaacatctacttgacacttaatatgtgcctagtcactgtgcacagaactatatgtgaattatctcatttaaatctcaatcaattatatgataaacattttcttttgcagacggggaaactggggctcagccacatttgttaaaaattaatggctccaagatttccacccagcacccatgtcttactgactccagagcctgatatcttaaaccctcacagtgcttcgttgcattatactgtaacacctcttatctgaatttatacaagaaaaacttgacaaatgcaagacgggaactcagatttctattccccaagtttgttactctttccctgtgttttgtcagtgaactttgtgcccaagtgatgctctgaacctgaaccttccagaacaaagtattttatatactaagcagctctgaagagagggtctgagcatcctttctacatagactacactgtggaatttttgagcaaataatttagattttaaccattcatttattcatccatttaacatacatttatttagaacttcctgtgtgacagccactatgctgagtgctggtgaacaggaggctcttgcattctcctgggggatgcagacacaaagaaacaagcaaacataaacaaaaccaaaatcctattattttagatgccagtaaaccagtatgataaaatagcagctctgtggtgggtttggggggtggtgggtgtctactttagacagccatggaaagcctttctaaggaggggacatttgagctgagatctgaatagcaagaaaccggccctcttaagatcagagggcagagctttccaggctgagttaacatcatatgcaaaagccctgaggcctgaaaaaaagcactcagcatgttcagaaaacacgaagaacagttgagcgtggttgaagcatagtgagcaggtaggagggtggatagaattaaggttaaaagagagttttaatcttaattagaaataggagaaattagcagattttacttcgagtgcagcgagaagccgttagcgaattgtatgcaaaagagtgatttatgtttttaagaagattgcttagctgctatgtggaaaacggactttcagaaaacaatagtgaaaactggaaatccaatcagaatactactgcaattaattcagttgggaaatgatggggggtgaaactagggggtaacagcagagaaggagagaaatggattcaggatatagtttgctggtaaagctgcgagaacctgatcattccttaaatgtgggagacagtggaagagaaaatcaaggatgacacataggtttctggcatagcagctgagtgtatgggaatgccctttactgaaatggttttactgcacaggttagcaaaggaaaaatcaagaatactattttaaacattatttgtaaaaccaaatacataacttctcccttggcaacaggaggaattatttgttttgtgcttttttggccatctttctataataacattcatctggtatattcatatttgtccgcttgccttccccaccttgctcacattatgatcaaggaaagatcagcgttttcatccgactttgtactgcgctccagcacggtgcttgccacatggcaaatgttaaattaatatgttggattaagctacattatattcaataaaactgaaaattcttatcagcttaaagagaaaagtaagtaaggtactagctctgtcaaaagctatcagtgctatctctccagactgacagatgaagaaagtttcaaaagatatgctccagtggcattttgtaagaaatctcttaaaaatacagcccctgtggcttctacccaaatgcacttaggccagaatatctgttcagtggtattatctgttttggtctatcaagtcatggatgtaattacatattgactttgatatactgtgacatagccagggacagacgtcacacagaactgcctcttcaaaaaacaagaaacaaacattcaggaacacaagcactccagaatcatcatgtacacttcaaactggcaacaactctgccttttccctggcttttagatttatcttgatttgtctggtatatcttcatagagatgacaaatgttttgtattaaaatattttatcacaaagttagcagactaaagatctcattcttcagccattaatgcccactcattcttaatttccatgagtgttgcatggtgaaaattcatgtcttttccatttacactggagtatataaaatggacactcaaactgtgttactaagcacaaaataggttattaaattagctgttttctgaagatgagagaaaaggggaaatacaaatcaagaagagattgcaaaataaagaggacattcttgttaaaatctattctgtgacagtaaaatcaatgaaattctctctcctcaagatctgggatttggtgactgtatattagactggtaagtgcaaggtgagtatagaatttgtacaatcattttgatgattgaagcacactcaaaatttcacatcctctgtctgcctcagaaaagggaaaaaaagcaaggcaaaggagtttgaagcctgagctgaactaattgctagacttgtcatttactttgctaagagcacatgtagctggcagaactgtatttccccaatattcagcttgtttcttgggcatttcagctaagcagtctggactatgatttcttatttgtacccaaaaggccacagtgagtcataaaagttgaacagtgaaccttggctcagttcctaatacaaatgaggtgtgatgagtctcatgtctgttcactgaccatttaccactcacccgagtcctgcaaaaccctggggctccctgttcccttttccccagctcttcacatggctcactccttcctacatctcagatgatgtctcctatgtggggccaggaggtaaggacacaagccatgaggatcccgaagccaagcagtccaggcagagttcagccccaccatttattagccacgtggctttgaatgtgtcagtttaacctcattgtacttagttttctcatcagtaagataagggtaacaacatctacctcagatagttattttatgtgtcataattgaaagtactttgaacagtgacaaaacagaagtatatcatcaataactttcttacctaaaatatgctcaacaaattatatttttaaaagacagattactatagtgtatagatcatattattcttcttttttaaaatagtggataatgacagggaaaagtggaataatactctccaaagtgactaacgatgttaaactctaaagggtttaacttttagtggtaaattttgatttatttttttctttttgcttgtcattatttttctcacttttctaaaacatagagttttcaaatttttagaacattgtttgataaagattattggacctaataggcacttagagatcatgcaattttatatctttattttttgagaaacaagggaactgaagatcagagaattcggataagaaaaatggcatcaggacagattcctggtccctgatcatcatattatttcactgaggttcagaaaaggctgtttgggctctagatttagacatttgcttcgtttcttttgctttataatttttgataattttatagtgagaattatttcaaataactatattactttgcagtattcacttctgggacacataaaaatatgagttggtagatatatgtgagaacagattttatcagagtttatagttatttatccagatatttttaaatctgctttgagaagataactgatttgggaaagtacacctgttgcttaggaaccatgagagggagaaagtataattgggaagaatacatcatggttattattagtacaggtactaaagtagtccattgatccttattagcacagctgttggttataaatagtgatgagcctgctctgttatatgcttcctgcacagatctcaaagagttatccctaaatttccataaacaaaggtaacagaccactcatatagcataactactaaagaaatagtagccttcgatgataatcatattggctcttctgtctttagccacttacatggctctctctaaaatggcttaagatgaaaagaattagcagagattaggacagtcttgagaagatgagataatgtctgttacactgtttatgcacattacattacacacacagggaaatcatttagcatgaaaattcattgtttagcctttgcctttttttctgttttcctggagactggttggggactggtttggaaggtttggaaggttttttttttgttttgttttgttttttaaattttgcttattagaacaaagatgaatgttgagcaatttatagcctgtgtctgtctgataggtccatgcattgcacagtaattgttaaatatttttgaatattaacccgaattggaactccacatagaagagatgctacaaaacaaggaacaatgagattatcctatcttagagtttcaaattctctctttctctgtactctgtctctctttccctttctctcctccatttctatatttacatacattgttaatcatatacattttggatataggtatgtatatataaaccagatatattgtctttgggggttcaaatgtaaagttaacttctctaaatgtttattatacttcagtataaaattaaaatgtttaaaatgtttatgtatgttctcaaatataactgaaatacctgaccatgttttcccaagtcctcactcatttttcacagcctaatttagccatgaaaaacagtgaataagagcagcattgaagtatttaatcttctcatcttaaatcaagctttcacccagtaggaaaaagcccaaacgatgacctcagcatccttcagtttcacaacttttagtcatgtccaggactaaagtcaagagggcaagtaaagggattctggagtatagtcccagacgtaccagcagctctcataagacaaatcattaccatttctttggtccttagtcttctcagctatgcaaaatgggtgatttataataagttctatctaaagtttcttcttcttgtcttcaaggattccagtcacaactttctagcctacttaactccaatctcaacatttgcccaagccagataatatcaggtttaacagacagatgctgctcattgaatccgatttctcatcaatgctgacagctgatccctgcagaaaactaggtgcattcagtctttcaggccacagtgcgccattttgtgagccttcacctctgtgaccattatacctcctagtggctcagaagactacattccccacaaacttctaaatttaagaccaaaggagacctttaaaatagaaagcagaaaactaaaagattctgaaatattcttgttgcagcatcatgcatcctccattatggtcttgccaactggtcactgtaaactttcctaatactgctccatgctacattagatcctcaactgggcatcaacagccactatttttcttcatgaaaagggagctttatttgtaggccacttaattaacctagtgggtttttgaacccagtcatttaggagatctcttctagattggagacgtgatctacaaccctttattgaagacctggcatttagacaggcaacaggtagagatatgccttccacttagacataattttatattatttaagatctagagtttataccaaaacactgctttattttactctcacttctaattgcaacctttgtgtggttttgtcacagcaatcatgtcttgattttaattctctgacaacatcgcagttgaggatctgtgggcgtaaaacatgttttatgaggagaacatctaaatgactaaaggatgtgagatattttgctaaactgccattgctaatctgatttaatagcatcttaatggctctgtgtattttgaaggtttgacaagcttaggaacttggcagtcatctttagacctctagcatagccaattccatttcaggtccatgggggctaaaggtcttggatggccatttggctactcagttagaaagcatctgttaagtgctcgttgtgtgtggcacactatgaaataaaaagacatgatttcagcctgtgggaacctacagtcttagagaattccaagttaatgaagggtctaaagtttcattctttactggaattattgaattgagttctgaataatacatttatagagggacttgaaatgaaagagggaagcagaggtgtttagcctagaattgagttgacttggggcattcttttgatcatgcatttaaccaacgaatactcattgagtatctgttctctacttgtctctagagatgcaaaagtccttctctgccctcatggattatagcctggctgagaagcctaattgcagttagaagcaggagtggggccatactcaggggagaatagagaattaaagcagattcacttcagtttcaattttggtaagaactaccttggagcagtgaagtgtacagggaaattaggtgtagaatcacagcttaagggtgaagaaaccgggcctggtcttgggaatcaacccaaacttccatgaagagtcagacaatctaagataaaataaataattccaggcagcaggcagattatttgttttaactaggaattggcaaactctttcccacaggccaaccttgcctgtggcctgtttctgtaaataatttttctatagaaatgttgggtattcttggctaattcctagattctctatcatttttgctgttacagtaagttgtgcttatccgtttgtttttgtttgtttgttttttgagatagagtctgtctctgtcacccaggctggaatgcagtggtgcgatgtcagctcactgcaacctctgcctcccaggttcaagcaattctcttgccccagcctcccgagtagctgggattacaggcatgtaccaccatacccagctaatttttgtatttttagtagagacagggtctcaccatgttagccaggctggtctcgaacttctgacctcaagtgatcctccaatctcggcctcccaaactgctgggattacagatgtgagctaccatgcccggacagttgtatcttatctttaatcacattatctaattagttgttgcttatatatggaaggtactgttattcttgtgattcagtatttggcaagcttgctgaaatttcttgtagttctaataatttgtctgttgattctattgattctctcaaactttgctatcttctgcatttcctctaagccaaggatcagccaactagtatttatgggcccaccacctatttttgtaaataaagttttattggcacacagccactcccatttgtttaccttatggccatggctgctttccagctacaatggcagagttgagcagtaacagggactgtatagcccacaaaacctagataaaattcttattttctggccttttacagaaaaaactttgttaacccttgacaaaatgatatcattaaatatctgaagactgtccattaaaatacttgttatttgtggctccaaagacttgaactgggaccaacacgtacagagatagagtgtttagttcaatacaacatggatacatggataactttttagtaggaaaaacataggagtacttccttgaaggaaggtgaaaattggcttaaaagatgacattataactaattgcccaaactggaaactattagctcattacttcaggaattcaggaaaaccagtaccgtccagcgcaagcagaggtatttggcctctctgcctttaaatgagacagtcttcttgaaaaaggttatctctgcattttcaatattgaaaaggaaggaaggtggtgcaggtttgattaaagtcaaatcataagatttattttcatctctcacaggtttctgaggacaccttaaaaccttgactgtaagaggtgatgtgacaccttgagataccttgcctctcctgttcagcagtggggaggttcttgtctcaacagttgttgccccatactctgggaattcacctactggatggtggtggtggtagagaagataacttggacagtccactagactacatatatctccttcaacccaggggaaaacatgccttttttcaaaagggcaaaatggtaaactcagtcaggtgaatttgtgtgactaattggatatttccaaatgtttttaggttagtgatatatacatcatatgacttgtttctcaagaaagtcaatgtggaacttttcataaaacaatttttgcctttttttttcaggagaaaatcccactctgtggaagttagtaaatgtcccttctgtagttaaatttagtaagcacagatgccagctaaggcaggtgttggcaaaaatcttatggcacgcaactctgcaaactggtctccttctgccaacagagtctctgcaaattgtacttaaacaagcacgatgtgttgctgatttctctttcatattctctaaattgccagttgttttgttaaattctgtgttcttacagacatcagcatcaactttaataattgtccaggttttgaaggagatacagttgccacaagttcttctacagagtccagactctggatggacttggtccctcaagttgggactccattgctagtactctcccaatgactagcccttaagatatgtttattaatgttaggtggaacttcttgcttttgctcatagttaggaaagttgttcttaaagtgtattcttcagaccagcagcatcaacatcaccttggacttcttaaaattgcaaattcataggctgcatctcaacttactaaatcagaaactcaagcctttcagttgatttcaagtttgagaaccattgttttaggaaaaatacttaagaactgccaaccgtgtcttcctcatgaaatcacctcttttggttattcaataaacagttattgcctgcatgtgccccattactaagccatgtgctgaaaaagagtagcctatgaatgtcatgaatataaggatcagatctgtgttaccacagtgtgcccccatttgtgggcactgcatatggcttattattggtgtcaaatgaatatttacttatttaatttattggaatattaatacaactaagcccctgtcttctaaagactttgatatatggaatttcaagtgccgtaaccttcattactattgttgtatctctcttactccaaagaatataaaacgttggcaatgaattataatgaattaagacatttttactttatgcataaaattatgttaggtgtttttatttagatttgaaagcaagagttgtctttacaggcaaatcatgtatttcatatagcagaaaagtatggctgaggttgtatattttggttgaactagactaaattatatgtgttccttacttctactttgccttggttgtgtagacctgggtaggtctttacatcttcccaccttttttaatagttcgaagatgaaaagggggttctggagcaattccatcaatgttcgcactcttttagcctacttctgtaaatcactagagcagctgtgcaccaattaattgcaaaagcgtacaggtggtcagcagaatgacttgataaatgcactcttattttaaggggcctttcatttcttacaaaacaaaaaaggaaacagcttttaaatttaatgcagaaagtaaaggccaaaatagttaaaataaaaaaattagtcaaataacaacatatcctgtgctagttgtaaccaaattaaatggaacagttcacaggtgttccaaaacgatgttcataatattgttgaagaaaattgcttctcttgtttttatgactttaatactaggccaatctttatatacagtgaaaaatttttaaacagcagtgaaatgatgccattctatctctgatccttctctttatgtactgtactactgccatatatacacattaatctattactgatgactctgttattcacgttcctgtagccataaatatggatcactgtgtatcaatccagaaatcactcactctgtgtgactagataaacaacatatacagatcattttagtaaagaatgatcttaagtgagtgaacttgtactagaagctataattatacttaataaatgacttctatgcctggaaagaagtatatgtttgacttaatggctattatatatcacagcataaacactgcattcctacatcttttcctcccttcaacaaatccttacccatcacattttttcccatattactggtattgggctaagatttgtgaaggatacagaaaaaaatgagaagaatttctatccctaaagcaggtaagagaacaacagaagagatgctctctgtgtgtgtgtgtgtgtgtgtgtgtgtgtgtgtgtgtctttctgtctgtctgtctagctagctagctataaagatgatagaaaacagcattgctatttaagaggtaccctgaagtttatatgtaaaatgttttatgtcagtagttactcactgaacacctacaagtgaagagcctgcagtggaagttaggaatatagctatgaaaaagacagacgcattatttggtgtaatatgttttgccatctaaatggaaggcagacactaaacacatgaataaacaagagaattataaattgtgataagtaacatgaagcaagcaagacagtagtagagaataactctacttggtgtgggcatgagaatatgcccacacaaagacttgcaagtaaatggtcatggaagcattattggtaatagctaaaagtggaagccacccaaatgcccatcaactggtgttatgggttgaattttgtccctcaaatagatatggtgaagtcctaatacccagtgcccctgaatgtaaccttatttagaaatagagtcattgtagatgtaatcagtaaagataaggtcatggtagggtaagatgggccatagatccaatatgactggtgtccttctaagaacacaatgggaagacacacatacacagaaagaatgtcacgtgacaaccgaggcagagatggactgacatgactataagccaatgaatgccaaggattgacagctaccaccagaaggtaggaaggattctgcccagagtctcaaagggtgcatggccctgtcaacacctttatttatgacttctatcctctagaactgtaagagaataaatttcttttgcttagggccactgagtttgtaatgctttgttaaagcatctctaggaaactaatacaaccagcgaatggagaaggaaaatgtggcatatcctacagtggaatattattctgcaataaaaaggaacaaactactggtacctgttacaacatcgatcaatctcgaaaacgctatgttcaatgaaaggagccaggcacaaaagaccacatattgcacaatttaatttataggaaatattcagaaaaaaagcaaatgtacagagacagaaagcagattagaggtttcccagggctgagactgggaatggggattcattgtgaatgggcatgagggatcttactggggtaatggaaatgttctaaaactagattgtggtgatagttgcatgactcagcaaatctgctaaaaaccattggattgcacacttaaaattggtgcactttttagtatgtaaattataccttaaaaacttgttttttaaaaaaaattatcaatggaaacagacaaaggtagaagtttttatcatttgggtcatttaaagaccattgtgggctagagagtagggcctacagaggagagggaaaggcaggcagtaagtaggtaaaggattctgggagagaaaatgttcagtttgggcctaaatagataggattttaggacgcggagataacagttcagggatctgggacattgcatctctgcgttgccagtgatattttagttctttcaaacaaggttgtgtgacatatatttgctccttggtggaattttcatgatcagattaaataaacacaattttatatgtgatatttatagacagagagaggctgggaaaaaacctgaccacttctaagacctccttggcttttgtattctaaccttattgtctcatctccctctaacacatgatacactgcaaggcaggctgtcttgatttcctgggaagacgaaagacctccttctctcaaggcaattctttttaattaacactgctctcagagtatacagccatatacacagcactaaaaggtgttaacttgctcactgcgctcaaagtcatactactgatatttatgggatgatgattcaacggtacgggctgtttgttagcaagttcaacagctgtgtgtgaatgttgttgtgagtatgcactgagtctttaccaggccagctttgtgcagatgctgaaagaaaggccagcccagactcaggggcaagagaactcagacagcagaggctagcccagaaaggaggaataattttgtaaccgaacatgtcaagcatgagtgtaatgtatttgaacctacttttgtagtgttattcatttcgtggtgagaggccttcgtaagagattaagatgaggagtcaggggcctgagtttcaacaccgactggttttctgtgggactaaagataaaccgtttaactcttgagattacagccttgcttgtaaaagaaagggatagattagaactgtgatttttaacctatggagggataagcgtcccttcaagaataggttgctagccgtggatcctctctttagaaaaatgtgcatccaggaggaaattaatacccagattaaggttgctgaaccaaatgatatcaaaggtcccttccaaatccaacactcctcatcattccaggaaaggaagaaaaatgaaaacaagaagaagaactattatgttcgagtttgcactattgacaacatactttatagcaaagttagctagactgtaagtcatcagacacccagggttgattctgtttctcacagtttgaggagatcctcttgatgcttctcaaactctgaaatggctgatgaaaagggtcacctcggtggggtgcggtggctcatgcctgtaatcccagcactttgggaggccgaggcagacagatcacctgaggtcaggaattcaagacgagcctggccaacatagtgaaacctcatcgctactaaaaatacaaaaagtagccatgcatggtggcacgtgcctgtagtcccagctacttgggaggctgaggcacaagaattgcttgaacccgggaggcggaggttgcagtgagccaaaattgtaccacagcactccagcctgggcgacagagcaagactcagtctcaagaaaaaaaaaaaaaaaacaggcaagggcccacctctgcgaagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccattttttgtctttaacctttccttctaaggttcagtctctttttcctctgactatgggaagcctaaaggagagatgaaatggagagccctatctttttatagtaagccaggtaattccaaactctttatgggcacagttgaatcaaagatcataaaaactgatcagagatggaataagaataaatgtattagaacaattagagcagtggcaaattgagtcaagcatgtattgataagaaataattgataaggccaggagcagtgactcatgcctgtaatgccagcaatttaggaggccaaggcaggtggatcacttgaggccaggagttggagaccagcctggccaacatggtgaaaccccgtctccactaaaaatacaaaaaaattagctgggcatggtggtgcacaactgtagtcctagcaactcggggaggctgaagcaggagaatcgcttgaacccggaaggcagagattgcagtgagccaagatcctgccaccacactctagcctgggtgacagagcgagacttcgtctcgaaaaaaaaaaaaagaaaaaggaagaaagaaataactgataagtatttaattgcaaagcatggacttagtttgttagactgtgttaccttgggcataattgtagagtcattttccgggatataggaaaagtgggagaatatgaccctccaaataagtgtgccattggcaaggtaggtgtaacttaaatgttttctgtagctgtatcttgttattcttttttcacaggtccaaaatgtaataaaaatacaggcatttgatgttaccttgaatatactaatttatgattcatttatattggccttggaaatgaaagtaaaagttgtggccacagaatgattactcagaagaattattttattatatagacataattaagcatgcaggtatttttgagtacttttattaataaatcttacaaatttttctgcagtatacttccaaagagataatttaattttcctgatgactagcacttcatccccttctcctttttttccttaagactaccttaaaacaatacttttgaggggcaaagttgtatgcatggagaatttaatccaggcaaatggtgtggttctgcgacacaaatttttctgtagcagtaactgggagaagagccacaattcatgactgctggagataggacctgctttaaatgaaggaattaattgtgcacataatgatgtgtataagcattctgcattaacagaaaaatgagttttacattttatacattttaaaagaatctccaagacttagcccctttatttattcacaggagtgatgggtgaatatgagcccaaaatagaagtgcagttcccagaaacagttccgactgcaaaaggagcaacggtgaagctggaatgctttgctttaggaaagtaagttctggtttgcgttccttctcatcctcccttcagcttgagcaggtatagagtttttcttgcactgttcacagcgatggtttctgaggtgacggaaaagcaagtgaagcctttctctttgtaattctgtgtatgcatcttggattctgcccctcaccatggagagaggacatgtaatggtgcaagaaggattaggctgccacaactgacatgaccacaaaggaaaggagaatgggcaattctgaaaaagtattttgttctattatcatgacctgtaatgtgcatgctgtctaacccagaatgacaggaaaacaatggcctccacttgaggtacagttaagctgactatgtggaaaaatacggactttcattttggccccagtttatagaggatgcatcagacttttcttgaatttctttttaaactctcagtctcttctctctactttggatttccttctcctctggctagagataggtaagacgtgttgttctctaagagagtctgttttacaaagttgtccaaatattgtttacaactttattattcagtgtggacttccttgagaaaagcctacttctaaactagctaacttttccttacagaatatatcagacagcataaagaacatgaaatgcacatcatttgggatttttatttgccagtaaccagcaataaagatttggcataaacagtataaactattatctgaagtgagaattttgacatcttctttggattttaatgatccgtgtcaatctttatgcccagccccatctatctgacgaatccattactaactctctttttcctgcgcccaaatgttgactaaggcaacaacagtaactttttttttttttatttttcggtagaggcaggatctgcgtatgttgcccaggctagtcttggactcctggcctcaactaatcctcccacctttgctcgtctaagtgctgggattatagtccctagccactgagccaggcaacactaactccaccaatccttatatcagcgtgtaatctcttttcttatgatttttgtgttttacagcaatcatagaagaggttcctttttccattttattgtcggttctaatagaaaggttgttttggtttccatgtgttttcaagtcgtgacaaataagctacagtcgtatctttactttggtacagtacaatgcagtggtaattttttatgtcctgaaaacttatcatattaaataaattaagacataattataggattgaacactctacagacattaaaagtcaagttgcaaaacaacatttaagacatagaaaatgcccatgctaagagaacaaaagcagattgctaacaggataatatgattacactttttatttttattttaaagtatttgtgtataagcatttatatatatgaaattaaagatgagagcaggtaactgggtagtctagatatacatttgatgaattttttaagatgacaccttgaaaaatcatctgtgaaaaagagcagaattcacgttgttcacacttcaaagggggttatgaattaaactctattcacactgtttgaatagtgctggaataaaaacaaaaatcccaaattggcttcttcagtctacacagaaatgtttgggtatgcacatccagctgctgaaacacatcatcactgcccacttaagagcaggaagactacatctcagtatggttatttttaaaggcatatattaagtgcatatctcatcagtataaagacaccgattatgtacttttcatagaccttttctgcattttgagttagtgtctgtctaacgaacttaaattcttctaaaacaaatatagtagagttgatggctttaatgttttaaataccatctcaggtttcccagagaagattagcaagtctttagtctaattacttctctgtgtgtgtatttgtgaaaaataaataagtaaataattgtatcccctgccaggcagccacaatcttaaaagctgtggttagctcactaaaccattgatttgcagattcaatgatgccctctctgcaatttaagatttgttccaacagttatggcagtaggatgatagatgccttgagagtacataaagacctcacagatggcatctttctttctctcactattttaagcgaagtttccccaacccatcttgcaaatggactgctgtaagttggtaaggttctcaatatataaatgacaaggagaaaaaccatgttgtccaaaagaatgtaccttgagtgaacccttcctgtatgtcagcaataggttgtgtctcccaaattttatgagctcattatttctactatcatttattcattatttggatatttctcaaagtagggcacttgcattgttggtacatagatttatggaaatatattgtttctgttatctattgctacataaccaacttagagggaacaccagaattttattatatcttacaatttgtgggttaagaattcaggcagggcttggctggctgattcttttgcttttagtggcatccttcaggtctttcagtagtatttagctgacagatgaactggtctagaaagctcacaagagtctcacacacatttctggtattttgttggggacgttggaaggctggtgtcactgagactgttatctggaagccttacgtacggcttctccttcctggcggtctcaaggtattcactcttctcgtaggacagctcagggctgccatgagacagaaagcagaagctgccagtttcttaacacctgagctttgatcctgcaacatcacttctgtcttatttattagtcaaagtggttaaaaagcgctaccagattcaaggggaggggccatagacctcatctcaatgggaggaatgtgaaagaatttgcagctatctttaatttgccacaaatgcacatgaacatttttattttcatattttttatttagaaaaaaacatgtatgggtgaaaccttgtctctactaaaaatacaaaaattagctaggcatggtggcgggcgcctgtagtcctagctacttgggaggctgaggcaggagaatcacttgaacccaggaggcagaggttgcagtgagccaagattgcgccactgcaatccagcctggtgacagagtgatactccgtctcaaaataaaaaaaaatatattaaaaaaaaaagaaaagcaaaaaacatatgaggaaacatatataacatataaaaatctgtttttatttcaatgatgatattgtataggagatagatcacttttttttttttttttgagacaaagtctcgctctgtcgcccaggctggagtgcagtagtgcgatcttggctcactgcaacctccgcttcccaggttcaagtgattctcctgcctcagcctcttgagtagctcagattacaggcacctgccaccatgcccgggtaatttttttgtatttttagtagagacggggtttcaccatgttggccaggctggtttcaaactcctgacctcaagtgatctgtccgcctcggcctcccaaagtgccaggattacagatgtgagccattgcaccctgccagatcaccttattgaaagttaagaaaagttatttgattttaagaacactaaataagtaatgctagagatgtggatatgattaaagttataatggagatagaggaatgaatgaagtttgcaaaacacccaaccttatatgtgtagaaccaagaaggaagcgtttaggttcagataaaaggtccagttttctctagtttgattcactcctttttattcttgctatcagtccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatggtaagtgtatgatttcagtttatcatttatagtgctacagaacttcctgatattgaaatcataagctgagaggcattcaggcattttgggagagatggtgcagaataggactgtgtgaaactcatggtttgctccataatcagccctggttgattctgggtgtggagagtgagggtggggggcaagggtgttgacggagcagagaggaagacattaggctgatgtgtttggaggatgggtattagtgtgaacacacttgcaaagaagtctgtttttcctctttgcatcaagctgtaaacctgacacaggaaacgttttattattcctactcctgatttatctttttttttttaagctctgtgcttttcttcattagaattttgatttgaggcttgtgctaatcttttgtaattgctcctatttgttagcaatttaatgtggtaccatgaacatttcaaaatgcacactgtccaaatttagttcttatcagagtggaacgtgacaaatctctctcaccccaaagactttttatgtgcagctgctcctattccaatcaaatcatcagcattgatccaaacaatataaatgtaaaaccactagcacatggtcattattgagaccatcttggaaaccctgttaggatactgatttgaaatctcgaaaaggatttcattggataggcattttgaaagcaaactgagttctgccaaattggagcatgccagaatcccatctgtctgggatacagaaaacaaatactatagattgataattatttaagaatggtttaaacaaacaacaatgcatattaaaatgatgagagtagttctgtagggcaagttgtagcaaaagctttaaatgttcttatttcttgcagtaattgatcccacaaaagtctatttatttcactaattcttcttccaaagcattttggttttaagatatgaccgaagttctaagccctccagtagacagaaggggacccctcttggctaagggggggcccagagtaacattgaaaaatgagttcttggccatgatgggagggtaatgtcagacacatctagttatacctgctcccttgctaaccgcaatgagcctttcttccctaagggctaaacacaatctagccctttgaaaagactccatcactgacatcaaccatgcacctgatgctgccccttattttttgcctgataagagaccaccaacacagaatggttctgtcattctagggaggatgtgccgtgaggggtttcatgtcctctggtctaccttttgacatcacagggccaaaacctccaccctcagatgctaatactgccatttttcatacccggaacccatgaagggttgcacatgcagatggttctcctttcataaatatccatgactcctcctgtagcttattaaatatgtatattcatatttatatacatatgaatatgtatataaattcatggcttctgtgtatgaaatatacatatattcatatttatatacatatttatgtacatatgaaaatatgtatatttcatacacagaacccatgaaactcagttgcacatgcacatgtttcttctttcataaatatccatgattcctcctgtagcttattaaatatgtatattcggccattccactcagcacaaattcctgtttgttccctttgctcctccttggaagtgcctgtttacagcttctggccaagggaggctacgcttcctagcctgtcagaatggccaccaggcagactaataaagctctcccttccaaaaagaaagaaagaaatggaaggaagggagggagggagggaaagggaaaaaggaaggaaggaaggaataaaagaaaaagctatggccaaagaattctgatcgataatcacgtaacattttttaaatcttgattggaaactgggcagagatttccactatgagccagccttcaatgacctcccctaagtgactctcagcatttcattttggactcacgttcccctgatgcagcttctgaggggagagaacacacagagttgtagaaagtattaatacttcacttgatgagctgggcagtagctgtttgaatacatctgcacttctcttttatcattcgtctgtcttcaagaatattaaaggactgactctcctcatgccagatgacagacttgatatttaatctttgctttcctcttaaactgtcatagttggtatcttagttgatgggttgtaaagcaaaagacaccacagttaactgactgcaaaatcatgagactgtaaattacagatttattcagtgagatgctatggctgtgtatttttaactgtgtagggctcgtttttctcaccaatgtaataattattttttctatatcagataggaacaatctgtaaatattcagataattggccaacattttctcttttttcttggttgaatagtctcttcagttcagtggtggctgttcctaaatgttatttgagtagcttaactaattgaataaagtcattttaactttcatgattttctgttaactgaaattcctgctctcagtatgttaaactggtatgaaattttctgcaaccaggggtcggcatactgctttcctgtgggttagaggtttcctgcactggaaatacagtactccaggattactgttatggaaaatcaactttgtcactggctcccagccctgtgcagggaaatgtttttttcagggatcctgccctggagatgaaaatcaggttctaacaatgtttcctttttaaatggagttatctgcagccatgcatgggaaaaagagcagaataaaataaaatttgcctgctttctgaagataactcagccttagctcacttgtcagccacgcttggtgttaaaaacttgtcagatcagttgacttccacagcacttggctattgcatttatgtttattcttttgtttttcctcatctagcacatcagtgacaaaaattatctaattgttttcattgtcacagccacaggagagcttaattatacataagcacttggctgtcatcttttttcctctcacttttttctggtctgggtcttcccagtgctgtgttcctaatatccagctgcataggtctccaatttaaatgaattatgataattaaaatcaccatgtagatgataaaaggtgagaaagtaccccagtcacttatccatgaacattctgtctttgttgacaagaatttcttacaacctaggaattataaaccatgggtttgagcttagaaacctgcttctttgggttccaggttgtttattgcattcatcagctctccacttcagcaaccagaagtgtgctaactcctattcagggttggcaaaatggcaatttttttccttcttgcattaaaaccattttgcattaaaaccattttgccttctttcaaaagcctactaggcatgatgattgttcccagtgtctgaataatggaagccctattgccctttggtttgtccctactgtagccatgtctttaagttaccctgtgctactcatgtttggtatgtatgaagaactgaagcaagttcagagatagaacatttttaccctaccccatcttcccaatttgtttttgctataacctgtacggtctagttgaatctacttttctcagtctgtttttggcattaaaaacttcctaaaaatagatttattttcagtggtaaaatgctatggatctctgttactaaagataaacattttccaaaatgactttaatacattatttacttgtttaacaaatttttttttattgcctaccatgtgggagacattatcaggcactatggctgcaagacaaaatccctgccctcaaggacctaatattttactggaagttaaccaaaatgcactattaagcaaataaattaactaggaaattttattttttggtaagagtgataaagaaaataatgaggttgattggccaggtgcagtggcttatgcctgtaatcccagcactttgggaggccgaagtgggtgagtcacttgaggccaggaattcgaaaccagctccgtctctactaaaatataaaaattagctgggtgtggtggtggtgcatgccggtagtcccaactacacgggaggctgaggcaggagaatcacttgaacccaggaggcggaggttccagtgagccgaggttgtgccactgcactccagcctgggcaacagagcaagactccatctcaaataaataaataaataaataatttgatatgatagaaagtagctgagagcaagagaaagatttcataagatgaagtagtcaggaaagacttgtctgggaattgccctctgacccaaaacctaaaggatgaaaatgagctaggctttcaaggggaagtgcattgctggcagaaggtgaggaagtgcaaagactctgaggcagaaaactacttgactttcttgatatgcagcagggaagtcagtgttaactaaatcatagtgagcaaggggcaaaggtttgaaacttgggaaggtgacagactgcagtactttgtaagccaggcacagagtttgggttttattctctgagtaaaatgggaagccattacagcatttcaaggcaggagggtgactcgatttgattaatgttttgaaaagaccgctcaggttgttttgtggtgaatggatgattggaaaccaagagcaaaagccggaccattgccaatatccaggtgagagacattgttggttaggacgtaagagaggaagagaaatggagagacttgagatatattttggagttagagccaataggatatgctcatttcattcctacatctgtctagtttatagatatggaaattgagtcccaaagagattaaagtaattgatttaagtttatacagtaaaaaacagagctagatttcgaatgctttgctagaggttctgaaacttcagtgtgcatcacaatcacttggaagtcttattacaacacagaattctgggtctcgttctatgttcccagtgggaacataccagatggaggctttgatttggtaagtccagggtagaaccaagcatttgcatttctagtaagttcccaagtaatgctgatgctgcttgtctgggaaccacatagtgagaatgctctatgtttaggttgtccacccatggtattgtgaagctgaagattaaatgacatgcaagagaaggtgttcctgctactctggaaagctaacagcttactgtcacatcaggcattttagccagtctacacaaagtagaatgagagcgctaaggcaattatctttgaagaaaggaaagggaaatataaaatgtatttaattcacttggtaattattcatctttgcacttcattctgtctctgtagtcacttcctttttgcccaaaaagactgatagaattatagtcatcatttagtagaatgaagtgtgaactacaagagcctgatatttaatatctttgtacagtttcttctctttgtaacaggtgttatgagagttaaaccatcttcataattaggaaatggggaatctaatatttgagcagtaaacaaggctgtatttcacagaatccagtaatacttaagctggaagcaactgctggggccaaccctttgatttttataattaaggaaaataagatccagagatacaaaataacttattcaaggtaatgcagtgaatgggaatcacagctagaactgcttttttctgctattctacctgtgttacttttcctgccaatacaacattttaatacaataggtaaggtgaaaaaaatccatcaatcatccggatactctttcttgcgttttccattaccagtgtcacaaatgaaaacatctggatgaacaactgactttttcactttctattttctaagttggtcacctggttattgagtccaaaaaaaccctttttttcttcttcaaattacatgtaagactaaatgtctagagcctttgtgctacagtcctttgcctctaaaggcaaaactgtaggcttgatgacactgcaaatggtgtttgagtatctctaaggtcatcaataaatgaatacttaagcatcttacagcagagcatactaattccccatggatgtgctatgtatatgtgatcacaagataatattcagccctgcaaagaagcttaaaggacagagtaaccaaagactgaacacagtacataaggtaatttcacagtagggcaatagtttgcttaattgtcctagacagaactgatattgataccctcaattcccctgtcacttaagataaagtcaacaatttttgtttctttctttcatctgatagttccaataaagtatgttgctacagtttttaaggggtacgcattaagcaaacgttgcgaataatagagagaattaatacaggagtggaggcataaagtcctcacctaataagaaacgttaagccatgaaaaaaagagtcatatcaaggacaatatattgaaatgcaattcaagtcatctcactctatagtcccagagaaggcaaaatgtcacagttacatttttttattcaccaatgaatattgtttaaatttacttataggaggttttgcttaagttgattcatttatctagaagttcctctgcttgtctaagcaggagggctcaaactgttggtttaaggactcctttttaccctgaaaaattattggatacctcaaagagcctttgtttatgtgagttatatctacccatatatgccatataattaatttaaatggagaatttaacttagaacttaatttactttaaaataacaaaaatacaaccagtatatgttagaaataattaacataagaaaactgactatatttttccaaataaaaatatttaatgaaaagagtagcttggtttatatttttgcaaatctctgtaatgtctgtcttactagaataaaagtgcattctcctatatacttctgtattcagtctgtcatgatattttgttttgattgaagtatatgaagaaaatatggtctgacacatatataattggaaagagaggacataatggactctcttaaggaaacctggggacctacaatggttcttagattgcactttaagaaggatacattcaaaagaatgctaccattgtcatttgtgttagggttggacattttttgagaggctctggacagagaatggatgttggagccaagcaggcctgtgtaccattgctaactgagctactttctgaatctggatgttaatgtctctgggccttacctataaaatgagtacaagtctacttaacctgaatattattatgaggtttagaaatgatgtgcataaagtgaagctgattagatattccatatattagtagtttccattattggttgcatttgggactgaactcaaggtgtataagggaaagagaaggggatggattcagctgagtaagagcagattgagggaaacactaggtagaggctttgaagattaaaaaaataaaagaaagaaatatagagaaatgaatctgtgtaaggttagagtcatagcttgattgatctgggtataactgagtaaatcgggcccaacagcctttttgaaaatccacatattgctgatttacaatgtttttattctataactcatttataaagttctgaactgacttattggagtggaggacaaagacccttattcaccaagagctgtgaattcaatgggcatagttggacagaaagtaagagatgtaggtaaaatcagatggcagaagacttcattttcatttatgtatttgttaatttattttcgagacagggtcttgctctgtcccccatgctggagtacagtggtacgatctcagctcaccgtgattctcgcgcctcagcctcctgagtagctgggactacagacaggcaccaccatgcccggctaatttttgtatttttaggaaagatgaggtttcaccatgttggccaggctggtttcaaactcctgacctcagatgatccacctgcctcggcctcccaaagtgctgggattacaggcatgagccaccacacctggtcagatggcagaagactttcaatattaacctaaagatatgaaataatgataatgttctcctaattttcataacatttacaggaggcagagcacattcagaaatcttacttgttatctcgcatacagattacttcctacagttatatttgctttatgtattcatgaatacctattaatagaaatatgccagctttgagttgccttctagtgtatcttcatatagttggtttttatatctgaacttgagtttatccttgctatccgtgctatctgtaaaaggattggcctatgggagatgccatctcccataccattgccagaagcaagtcagttgtaacttatgtggagatgaagaagccataaataagagtgtgtgaatgaagtacaaattaacagaaaaactaggagaactatgaatcctgttggtttaagagacaatctaaaggctaaaggtttcacttattaaaatcaaaaggaggggctgggcgcagtggctcacgcctgtcatcccagcactttgggaggccgaggcgggcggatcacaaggtcaggagatcgagaccatcctggctaacagggtgaaaccccgtctctactaaaaatacaaaaattagccgagcgtggtggcgggcgcctgtggtcccagctactcgggaggctgaggcaggagaatggcgtgaacccagaaggcagagtttgcagcgagccaagatggcgccaccgcactctggtctgggcgacagagccagactctgtctcaaaaaaaataaataaataaaaatcaaatcaaatcaaatgaaaaggagtgttagacatcattaggtccaaacgaatctgaattcaaggagaaaacaggcttccaatccccagactgcatttccaaagccgttcttataatacaagatatcagccagtatcagcaaagtatgtgtatgtttctcaaggtactttttttagcatgaaatttcacaagaaattctcaatatttaatacaaagcaaggctgcagcaaggaagcagccttgcgttgtgttaaatattgagaatttgaatgaatgtagaagggagtgccttccaagaaccctcagagcttcatggaattgagtttgaagacccctgtaaggagactgattggtgtgtggggagtggatgagagtctgaagccagagaagcacagattatcagtgctgaacaaacaccaaagatggaccttgccctgaaatccaacatgcatatttcttgtagagctggtccttcttttcagtgacttctgccaactggaagtcaggggtttatgagaagactgtaataataaactggaagactctcttaagtagcattggaaaatgactatttctcgtgccaatactaggaacactgaatttgaggtaatatgagaatttcttgatgattctgtcaattgcataagaatcccaggcaggagatagagatttgggaagcatctatgtatataggtggtaaactaaagccaagtaattatctccagactcataaagtctactatcattaaaattcttcagcaatgtcagtgaaactcccgcattccctggagatgattcatcttctccaaaattgtgtccgcaaccagaaataactgtgaatgtctacaggtcatctttgtaatagtaatttagagggttttttttttttttttttgctatcacatcctttcttttatatttttaaatttctaaggcctaaggcatatgttggcatttctttcagttagaaatttctgtttttagaaaatcgaagcgccaaatactcctgagaattgtttgacccactgagtttaaattatatctgcctgcaatataaattattattggataagatgcttgtacaattccagtggctggaatacacaaacgctgatttaggtcatttctggcagttattgaacaaaagattgaaatgaagagattgtttatctatccaagagacaaagtgtgtcacagagtcaaatcccagcacaagcatttaacattatatttgaatttgtagtttgagaacaatacttaaggagtcctagaagaattcttttgtttcaaatcttgaaagaatatggaagttcaaaacagatggttctcttttaatatgtgaatgtgtttaattctgcttaatatgtgggctctgtatatattacaaaaaaaaaaagacatttagaaatggcttctgaaataatagtattgaactaacctgttcaggccttcctctgagttgatacaggttgagtatctcttacctgaaatgcttgggaccagaagtgtttcagattttaggttttttaggattttggaatatttcgacccaagcctaaacatgaagtttatttatgttttagatataccttatacacacagcctgaaggtaatttatgcaacattttaatattttgcataatttaatgcatgaaacaaagttttcactgtatttgactatgaccagtcttatgagatcaagtgtgaaattttccacttgtggcatcatggtggccctcaaaaacttgtgaattttagagcatttcagattttagatcttcagattagggatgttcaacctgtgtttagacatggagttgtaaaatatagttgaaccttgatattaggcgataaataccctgtacccaatgcattatcacaaaaggggaggggctaatgatgtgtcttataatatgcttaactgggatttttgttatctaaggactttgaactaggtaaccccccccaaatatggagatacatgagtcattttcatcaagcacatgacttcatttattctagtttgaaaaactcactcgtttagatatgattcatccaatctaagtgagcaggagtgaaaacgtttactacatgggcttttgccctgtagatttgcaaatggcgtgttaagatagactgtctctctttgtcacatatataatatgatacttcatttctgatcttcatgggcccacgttcagatattcactttgagaggaatatgtttatatcagttcaaatttgtcttctatgaattaattttactttaaaaataaagaaagtgccaggtgatctcccacagacactgaattttttgttgatttcaccttggcccgcacaaataactaccactgagtattctcatctggttccttgacctccataaccctgtgggaagagacagaatgagccctcagaagtgcttaactagttagagctttgcaaggccttttcaaaattctctccagtccctcccttctctgcctcacctgcttcttgagattgcaaggttttgcttccagctttctgcatttttgcaaaaaagcaataagaaagcccaagtgttacaggaaatctatgacattgaaatctctctctctgcatgtgattttgatgtttcctttttgaacttcaacttgacattgcttcataagttacatttgcccttccatttttttcctcactctctttcaaaagtttggcttcattgttaatattcctcacatacttctgtggcttttcttgtttgctttgttttcatggactctgtaggggtcaatattcagcaggttgaatgtgaaatcaggcatgcaactgcattagccatcaaattctccaagcagagaacctttttagcttcctttgcattagcagcaggaagataaagaacaaggaagacttgcagctcttttaagggtgtaggttataacccttcattcaagttgatgtttgttgatgttctaaatttttttgaagttgacccttttggcctcccctcatatgcagcaatgcatcatcccatcagtagaggatttgtaaaactgtgttttgctcgttgaaaaacataaaattgcttatagatgagaaaagaaaaaagcagcatttattcaagggcctagagacctctgctggttaagtgatttgttgagtgtctttctagttttgtttattattgaaaaggtgaaatacagtttggcctcaacagtagcaatttccttttgaattaaaattatggatgatttgaaacattgttgagtgaagatactgaggtcaagtcagctggaagagatgttaagaataatgagtagcatctcctaattaaatactgatatcaactttgattattaggtttaccttggtaggcattaccctgtagaaatgccctgtgaacacataaagttccagaatgacagctatggttatcttctgcatgactttgggctgaaggtcttctacctgaatatgtttatcattattcttaatggcatgaattgtgcttgaggcaagatttgatatttatgaagactttttatggaacatggaattaacattgtctttatatctattgaaaataaggaaagaaaatgtgacttcaatgaagtacagaaaatgtattatcatttgggcagcgggggtagtggatagcagtgggcaatgtgggaattaagtgctactttgaattcttgtgttagactgtgggcaggacttgatttcctgaggaggtttgataaaaatcagaactcatttaaagatttggggttctagggtcatattcctgtagataacattctatcaatacgaaatcaataataaacaatgatgatagtcttaaaggagaaaggaatcataaaattgatctatacaacatgtgggagtgaagtatattagtgagggacaagctaagctattctcacaaaggaggccccaaaataaagtagcttagatgaaaagtttatttctctctcacattattttcctcaaaaatggcaggtggatgtggagctgctttgctccacacagtcattcatggtccaaggctgacaggtcagcattttcatcctatgtagcttccatgtctgcacccaaggctatttcaattgctggtcttttccaatcagtgtgaagggaaaaagaagaggttacggaaaatatctttaagtgaataacccagaagttgctctcaccactttcacacacatacagttggcatgaacttggttacatagttacctctagctgcaaagcaatctggcaaatgtagtgcctacctggaaatataccagcctggttaaaagtgggagggggggtgatgggaagatattctctactgaaaggaaaaaaggaataatagatacttacaggagagggacagttaattttgccatatggatattggtagttttatccattttgcatttagcgattaaaagactacaatatgaaccacaaaaatggtattcagagtagggtataggcacctccctgaatgtctccccagtcttgttatttgcataacatctggaaaaggaattttattataagtgtacttttgccctttgattgaatatgataaaaatagattgagtacacactgaatatacacctttctttgctttttggatgcctatagctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggtaagcaagttaatggtaattgtgccttagtcttgactataacgtttaatatagcctcattgccgtggaaacgggagaatggtgaattgtttctaaaataatatgcaatgaaacagcattatggtggaaaaagtgagagtgaatgcaattgataaatagaaagtgcacttaaatccagttctccagctttcaattaagctcttgcactagatctgtggtcttcaaagattaacatatgtgactttataatgggaaagttatgcaaaaggtctggaacatgaaattgtgctaagatacaaaggaacatacattccagcatccactacaagagaaggggcattgacacaatacaggatatccatctaaatagagaaacactctgacaaagaaatctgaatgaagcaggggtagagcggagaccctgagaatgaggaacaattgtgtccaatttaattttccttatgtattttcctgccgaacctcaaatattaattgaaatttgacattttcctcaggctccaaattgagaggcagtctttcatgctcagatttcttcctccagtaggccacccagaaaagagtgcctgctcggagcaatggccctcacatgaatttacatgacaggaagagaaaggggactgttttgcctaactcaccccctgcctcatgcaccttctccatttgctggaagggctccagcttgtccatgattctgtcaattataaaagccaaactcagacaaattgcaggggtataggtacctaggtactggtattttccttcttttgtgtaattgttaccaaaatgccagggagttggtctaggtcctgttgcttgctgtgcagagagccaatcactgagagagtgagtattgccaggaaataaggctttgttcaggtgctttagtcaaagagaatgggagatcagtctcaaatccatctctccaaccaactaaaattgggagtttatgtagctggggaagggatgcagctgtgtgcaggaaggaattaggtgggggtacagaggcaattatgacagatgaagggtctggtgtctcactgtctggatgccatgatctagtgaatttgagtcccttgcttgaggatcagcctcctgaggagtgaactcagtgagaccaatgtaagtttcaagttttaaaactaggcaggtcaatttctgggtttattcaaaaacaggtaattatcatttctgtgggacacttgggcttgtttcttaatgtgagggaacatgaatatctagatttgatcaaagtctaataaagtgtccactcagctaactcacaaccctgcggcaaacagaaaactagtacctctttatatatatgtagaatggcaggtctcctggagaggaggagatcctttttgatacttatgaaaattgacacataagttgtatatcctcagagtgacaaataaggaggatctcctgtgccacgtactaactttgcccccttcagattggccgccaccagatggtcctcagcttaaatcacaccactgacagcaataaactaagggaatattaaactattaatacctacattttttagtaaacctcaaccaatattaaatatttgcctctgtttcatccaagattgtaatcctattaaccttcaaagtatcacctgctcaaaatgtgagtgttttaagcactctaaacagtaaatttagttttatttccgaaaccccctaactctggtcagtacaaagccttaaagtgaaaaagcattttaagtttcaagttattctatttagagaggatattaatctgaatggctccactattaaatcaatgagaactcaagagaatcctacaatttaaattccatttaccaactgatgtactggttgttccatttagcatctgacctgctacaaatttagctgacagataaatagatcatgttatgtaaattgcttatatgatggctgttttcttcccattaagcttccttgatattacacatggtaaaattgccttaaagtctcagttgtagaaggtcattgtttttatgttcctcttttctttcacaggatagaattcaaattgagcaaggaacactcaacataacaatagtgaacctctcagatgctggcatgtatcagtgtttggcagagaataaacatggagttatcttttccaacgcagagcttagtgttataggtgagtctttatactggcaagaaaaaaaaattaaaactctttagatcactaaactaacttgttctttgccaagcataaatgttcaatccaagaaaaggagtaaagaaatctttaggccaaagatgctactcaagaaacaagtaataagcaagtctataaacaataacaagagaacgctttctaaatccgcctcttctgatgcttacaatggggaccatgcttcccttggcactcatttttattcctctattgactgcacttctaaattgagcaaagtttttgagatgctttttggagtctgctgctgatttggtgcaaacttgagcttggagggaataagagctgacttggtttggaaaggcttatttgaacagctgacagaataaaccctgctcttccacatctgaatttttccagactgtgcattaatgatctttcttccaactacatgtttgatcgtgtgccacttcctccctcctcttcagctgcattgacctttctgttctgcatactcaccatcctcccgtcctctgcaggccactggtacatactgagtgcatcgtctgcctgaaacgcttttccttcccctcttcatttctgtaactccttctcagttcgcatcttccatcttcattggtgcttcctcagaaagtcatgcttgggtcaactattcctattacagatttttatactatcttttacctctcctttatgaaagatgccacagttacagtttacacttttttttgtgatctttctatctttttcttccactgcattttaacctccccgtgacgtcaaggatcataattggttcaattcatcattttattcccaggacttaatacagtattgaagcacatagtatgcactcaataaacattgaatgaatgtaagaatgaatgagtgtgttaaatgaaggaagaaattgagagattattttattaaatggattaatagattaggtcagtaaagaatcgaaaacatagttgagtgaaaagataaatctatggacgttaaaaaaaaaagttaagaccaacagcttgcattatcctgtagaaaaattttgaatttgtctattattataaaagaagagatgataatgacaactgaaaacacaaaaacaaatgcaaatgatttgggaactgcctcctattttagaggctttcagtagtcattctccttggtgagagcataatggaagactatgaataagagaaaaacagcacacaaaggagctaattcacgtgctctgataaattgtccagtttcagagtcctgactttcccttatgaaaaacattcattggtgcctagcatgtaaatcttgcatatagaagtaaatgttctcaagtagaatgtacttccattctgtgcaatgtaaaaaaataaaaagaaagaaaaacttccacactgctcttctcactaagttcgttagcactgactcaaatcctatcaaagataacgattgtgagatttcatggggatggagcctttttcaaagaggcctagtaatggttttatgctcttggcatagatagcatcagcatggctaggcctactggaatcctaaacacacatacttctcaccctataaatattaggaacaataattttcaaccccttccaggacacatatgatgattcccttctgcccggatttgctaactattggtacttggaactgagtcttttggagtacagttcaccatggcaggattgcttaggagtttattccaaaacaagtgtgttctctactctactctatatcagctagttggaagaacagctaaaagtgagatgtggcctaatgaaatgaatcatagtgtctgaaaaccctctatatgagcgctagccaatttatcagtctagggacccttttataattttaagagattttgtagatccctttattaaaataagaaaatttgatagaaacaaatgactccaacaaagtgagaaaagctgcttaatgatttatatctagagtgcctacccatagctgaaaataacagaatatatgtgtatgcgtatgtgtacgcataatggcttaaaaccactctgcacagccctcccctctctccctctagtactaggattcaaggcctgttagctgggaatcactgttccaacttttacattaaggagtttatttaaaaatcatttccaattggaactgtctaattacaaatgaatttttgatctgagctcttaagtttcccgacgccagcaaactagaagtgttagtctgtttaagctgctataacaaaaatactgcaaacatggtggcttatagacaacaaatgtttatttctgatagttctggaagctgaaagtttgagaccagggtgccagcatggccgggttccggtgaagtcccccttctgggttgcagactgccaacctctcactgtgtttgcacatggcagaaggggtgagggtctcttgggcctcttttataagggcactaatcccattcataaggtgcttcacccttatgaagggcttcacctcataggggcttcacctcttaaaggtcctgcctcttagtaccatcaccttagcggttaggatttcaacataggaattttggagggacacaaacattcagactatagcagtagagcagtcaagataaaatgaaaatgcctgagaaattatttaaccatgtttcacataagaacaataaaggcatgtcatcaaattatttaggccaaacaagttgtaaaaatgtaaggcttgcaggaattcaggaaagggaatttggctagggggctgggctggaaagctaagccctgaacaatttagattttgacaaacacaaagaatagtccagatcagaatgaaatggctggaacaaaggctcaaaattataaaatatctgggatagtttcctgcacatagagaatcttcagtgctttttaaagctgttgactcctcagtggatgaatgggcaaacaacatttggtatatgtgaacacagtagaatactatgtagccataaagaaaaggagaaaatcctgtcatttgtgacaaaagggatgaacctggaggacatcgtgctgtgtgaaataagtcaggcacagaaaaatatcacatgatctcactcataagtagaatctgaaaaagtttatctcaaagaaatagagtagaatgctggttgtcagggtcgggggaatcggcgggggagggttgggaagatgtcgttcaaagaatacaacacttcagttagatgggacaaatacattcaagcactctattgtataacacgatgattatagttaataacaagatatcgtactctcaaaaaatgctgagggagcggatgttaagtgtttcaccacaaaaatgataattatataaggtaatttatgttaactagctggatttaatcattctacaacgtatataaatacttcaaaacatgttgtatgtaatagatacaattgtgtctgtcaatctaaaaagtaaaataataaaaaaaataaaaattttgattcaaatacataaagcatatatcggaaaatttaaacttgaaaaagaaagatggtggccgggcacggtggctcacagctgtaatcccagcactttgggaggccgaggcaggcggatcacctgaggttgggagatcgagcccagcctagccaaaatggtgaaaccccatatctactaaaaatatatatatataaattagccgagcatggtggcgcatgcctgtaatcccagctactcgggaggctgaggcaggagaatcacttagacccgggagacagaggttgcagtgagccaagatcgtgtcattgcactccggcctgggcaacaagagtgaaactccttctcaaaaaaaaaaaaaaagaaaaagagaaaagaaaaagaaagatggagaagtcattaaggaccaattttggagattcttgaatgacaagcttgcaagttccctatttaatatcccattttcccttccaaaaattcccagtaatatatttcaggtaaattgaagggcagttaaagattgagtgtgtaaacccgtagagtctctcttaagtgaataagggagaagacatctgcctatttaaagatacatagaaattaatattggttaacttgggtaagacataatatgattgttttccacaagtcactttgttccttatatagcaggaatagtttggctcttttggatcaaataactaaattgtcattacctatgctagaatcatgaggatgctgaattgaacaaagaaacaaaatggaaacaagataatctcttgttaagattatctcttggccgggtgtagtggctcacgcctgtaatcccagcactttgggaagtcaaggtgggtggatcacctgaggtcaggagttccagaacagcctggccaccatggcaaaaccccatctctactaaaaatacaaaaatcagctggacatggtggtgcatgcttgtcgtcccagctatctgggaggctgaggcaggagaatcacttgaacccgggaggcaaaggttgcagtcagctaagattgcaccactgcactccagcctgggtgacagagtgagactgtctcaaaaaaaaaaaaaaattatctcttgataatctgtataagaaagaaaaaatatatatgttggttccacctattgattaaatatcaggaacctccaatgctatagaggagattccttttaatgttgggtgatagccctacggtcatgaataagagatggttaggaagcatatatttaataggtttttcccttggttttattttatgtgttctgtcttggtatttaatgtgtatgtaacatgtctatttaatggatttaaactgctaaataattaatctgtgtgctgggtgatttactcactggatgggcaaacgccatagagagacttttatcttgaggtcagtatattggtaggcctggttatgagtacatcaaatggaagtgtccttgtctgtgactgaactatgacaattggcagtttatttttttcccaaggcaactcctcctagatcttttctgctgtcttagcctgagtcatggatgagattcacttgtgggatatatccctgtggacatccctgaggtgctgtacaactccctgggtgataaccatcattccactcctctcccccactcatgaaggtgtattacaattagagtaaatagagtcttgtaatcatggggaaactgaatcttctatacgtaacttaaaaagtaaagataactaagttaggtattttgttggtgaaaaaataacttttctaaagtaatagttctacccatgtttagtatttgtgtccactcagatgatcatattggcgatggggactgctgattaaattgccaaacttgaaatcattgggtaaatatagaggatagctaaggtctccaaagcaagtctgaggcaagtattcaggtatctgcaattcactgaaagagtgttctccaggaaaaacctgtaaggaaaagcagaataaggaagaaggaggaaccaaacaaggatggggtcttaggtaaagtctagcctaagtctaatccagaagggagatttctggaacataaactgtacctcagacccatttccaccttgagataatgaggctagctttttaaaaaatctccatgttaatcacttcctaagctacctcttaagtggggttccagaagtggtgggggtcaaaaatctttgattttgcttatatatgtgagaatattgtgaaaaaagttttttgattttacagtgggaggagccatccctaagggtgagtgggtatctgcccagtggtcttttgaatatgacttgacttttccaggactgtataatggaggagaagtagcttctatcctgaggaaattatgtctaatggttcagtatcccgggggttctcctggcctgtgtggtggaacacatctgaccctggcaggacactcaaataccatcaagtaactgatggcccaattaaagtgaggtgcaaccttgagcgattatctggttaatttggcatctacccaggtgattggctcccaaattagaaaaacattaaggctaaactaaaagttatttcatagggactttcacaagtgctcatctgcatctgatttctcaactgcctcgttgagccaggttacaaaataatcagatgtgctgagtgtgatcagcatcgaatgagaggacacatgcctttcttacccaactgcagtcatccaggcaagagctttacttaagttgtcatgaagaggggagctgtgcacttggctctcaaaagcaaatttggtgtctttatcaagttattgatcatatacgtaccagtagtaggaggatgtcattactcatcttactgtgaaaactgacagaattacacgtgaaagcctttgcaaacctaaaggtgtttataacaatataagaaggtttgggcttttttttttttctcttagtatccataccaaacacttagagatagccatgaaatcaccagtaaatcccagttctgtgcttctcaatttttgctgcagattacaatcatctggggaactctttactatcctgatggcataccatactcgttatcaactaattcagtctctgatcctaggacccaggcatttttccttaaagctccccaggtgtgattccgaagaacaacagaatttgagaactattgctttaattgatcaggtttaaaaagccattgaattttcctaaaatattgattatcaggctttatcgtgcatcacagtaatctagaggacatgttaatacacagattgctgaactctaccctgagaatttctgatatagtagctctagagtggggcctgggaatttatatttctaacaagtgatgttgatgctgatgctgcttatccaagaccaccgtttgagaaccactatcctaaaataggaaatctgtcctacacagagggcttttgttgttgtttttaaaaattgaacatagtctccctaccaaaacatctgattttggatcaaaaagcactctgaatccgaagtacccctgtatgagagaaagagcaggcatcagagattccaaccatggctgaaggccccatttcaacaagagagtgaataggaataaagcacacagaatgtcttgacagactaccatgtgaggcttgagctaaagtgctgcatggcatgactctggtagttaaagccaactgaggggagacattgaaagctgataaatattatgataaatattatgatcatcccttacatcaattcccccaaagaaatgcagtgagtcagagtttaaaatattactctagaatgcagcctaaggcatcactgagcattaatactttatatacaatcctataaccaaaatatctgaatcttctgtaaaactgctgtgaagagatgatccatcttgaagtccttagtccttttcataaaaatatttccaataaatttctcataaaatgtagaacttctctcttaaaagaagaaaagtttgcatcttctagtaaagaggcaaagtttttcatcagtcagtaagaaatatgttatttttctctttgcccagtctgggattaatttaactctattgtattaattctagtgagattgttttctacccttcccctgtttgaattgagtcatattgtaaatgtatttactactttatgtcttttaccattatctaccccaagttctttgaatttgtgaatgaataaataaatgaagtaactatttttccccctccaccaccttctggcaaaattgattgcatttggggagcctaatctaaggagtattaattagactgacattcaagatttggtagtggggggtgattcatcaagatagtcaaaagggaagccccagaccctttttccccaatggaccagttgccattgaaagaaataaaaccagttaagagatttctgcactccagtcaagtgtaaagccaatagcattaaagcactgtagaaaaatttatggcactcgcttgctggagcacctcccactccccacagcgtagcacagagctatcagtagaaaacttccaattcctaatttcttgctggggagggaaagaaaagagtggaaggtatatccagtgtttttacttttgagggggaagtactacctaagggagtggtttccgttttgcctgaatctaagtgatgacagaaactgggctatgtgggaggccccctgagaacaaagtcttatcaacatggcttggtctggtatcaggctgtaccacagacactaggggaggtccagtaccaacagagggaaatttaatgcttcctgcagcactagaaagtccacagtacctgataaagacaccaagggaagctcctgagtagaaaccaacaaatcttcaattaggggattacatacaaaagcccagagaagatgcatcatcagaaaaggcttgagagatttgcggaatctctagctggactgattgctctcagactgcaaagactaggagaagtgtctgattttttaaatgccagaattccagcagaagataataaagcacacaaagaaaccagaagacatggcccaaccaaaggaacaaattatatctacagaaatcaaccctaaagaaacagaggtatatcaattaccaaagaattctaattattctcataaagacgctcaaggaattaagagacagtacagatagataactaaaggaaatcaggtaaatgatgcatgaacaaaatgagagtatcaacgagataaaagatgaaaatgagcccaaagaaattctggaggtgaagaatatagtaagtgaattcagaatatagtactcaatttactagagagattcaacaacaggcttgaccagacagaaaaaaataatcagcaattcaaagacagaacattagaaattattgaggcagaggagcaaaacggaaaaaataagaaaagtgaagaaagctgaagggtctatgggacatcatcaagtgcaacaatataagtgttatgtaatttgcagacaataaagagagaaaatggcagagagcctatctgaagaaaaaatggctgaaaacttcctgagtctgagcaaggaaatggattcacaaattttagaagctcaagaactgcagctaggatgaatccaaagagatctacactgagacacattataatcaaagtgtcaaaagtcagagaccaaaagaaaatcctgaaagcagcaagagaaaagcaacccatcacaaacaagtgtgcatctgtaagattatcaacagatttttcagcaggaactgcatgctagaagggagagagatgatctactcaaagtgctgaaagaaggagctgccaatcaagaatactatatccggtaaaactgtccttccaaaatgagggagaagtggagactttcccagataaacaaaagctgaatgagtttatcaccactaggtttaccctgcaagaaatgctgaagggagtccttcaagttgaaatgaaaggatgataaacaacacaaaactatatgaaaatttaaaactcctagataaaggtaaacatacagacaaatataaaatcctgtaatattgtaggtacaaaaatcacttttataaaaatctggtatagaatgttttaaaaagtataaaaggtaactataaatctatgttaataactgtacagtataaaaggaggtaatttgtgtcatcagtaacaaagtggggcagcaggatgtaaatagtttttatacatgattgaagttaaattgttgccagcttgaatagattattataactttaagatgtgctatataattacagtggtaaccacaaagataatatctatataatatacaagaagagaaatgagcagtgaatgaaaacatatcatttttaaaaataaaggaaacacaaggctgggtgcagtggctcacgcccgtaatcccagcactttgggaggctgagacaggcacatcacttgaggccaggagtttgagaccagcctggccaacatggtgaaaccccatgtctactaaaaatacaaagtttagctggatgtggtggcgcatgcctgtaatcccagctactcagcaggctgaggcaggagactcacttaaacccgagaggcggaggctgcagtgagccaagatcacaccactgcactccagcctggatgacagagtgagactctgtctcaaaaataaacaaattaaataaataaaaattaaaacaaataaaaatcgaggaataaaaatctcctcttttgaagacagaaagaggagaaagggtaaacacaaaagctacaagatacataaaacaaatgaacaaaatggcaattgtaagcccttccctatctctaattattttaaacataaattgattaaatgccccaattaaaagatatagcttgactgaatggattaaaaacaaacaggatctaactatatgctctctgtaagagacacactttagatctagggttacacgcaagctgaaaatgaaagaatagaggaaaataatccgtgcaaaccagaacctaaagagagcaagggtgaccgtattaatatcagacaaaataaactttaagacaaaaactgtcacaagagacaaagaaaaacattatataatgataaaaggactgattcatcacaaagatgtaactgttagaaatctgtatgcacctaatattagaacttccaagtgtatgaagcaaacattgacagaactgaagagagaaatagcagcacaatagtaggatactttgatactctattttcaatcatggatagaacagtcagacaaaagacaaataaggaagcagaggatgtgaacaaccctgtaggccagttggacctaacaagcatataaagaacactgctctctactacaacagaatatgaaatctactcatgcacacatggaacagtgtccaaaagagaccatatgttagggtacaaataagttttaacagatttaagaaaattgaaattatacgtaatatcctctcggactatgacggaatgaaactagaaattgatagcagaggaaaaacgggaaatccacaaatatgtaaaaattgaacaactcattcttaagcaatgaatgggtcaaagtagaagtcacaatgtaatttagaaaatatcaggagacaaatggaaatgaaaatacaacataccaaaacttacggatgcagcaaaagcagtaataagagggaggttaataatgatacatgcttacattaaaaaagaagaaatatctcaagtcaatgccctaacttcgcaccacaggcaactagaaaaagattttaaaaactgaaaaatcagtagaagtaatagaataatatatattagagcagagataaaggaaatatagaatagaaaaatactaggaaaaaaatcagtgtaaacaagagttgatttttaaaaagatcaaccaaattgacaaacccgtagtagactgagaaaagagtgtactcaaataagtaaaatcagaaattagagacatgaaacagatgattcagaaataaaaagagtataaagaccactataaataattattcactgaaaaattggataacctggaagaagtagataaattgctagaaacatacaactgcttaagactgagtcttgaaggaatagaaatgtgaatagacttagaactagcaaggagattgaagtagtaatttaaacttcccaataaagaaaatccctggaccaaatgcctcagtggagaattctaccaaatacttaaagaagaattaacaccagttttccccaaacccttccaaagaattaaagaagtgggaccacatttaaactcattctgtaagcgcagctttatgttaaaaccaaaaacaaacaaggacagaagaaaactacagaccataaccctgatgaacattgatctagaaattgtcaacaaaatactagcatactcaactcagcagtacattaaaaggattatacacaatgtcaaattggaattatacctgaaatgcaaagatggctcaacatacaataatcagttaatataatatactgcagaatgaaggaccagaaccacgtgatcgttccaattgatgaagaaaaagcttttgacaaaattcaataccatgtcttttttgtttgtttgttttttcactctgtcgcccaggctggagtgcagtgttgtgatcttggctcactgcaacctccacctcccgggttcaagcgtatctcccacctgagcctcccaagtagctgggattacagacgcatgccaacatggctggctaatttttgtatttttagtagagacggggattcaccatgttggccaggctggtctcaaactcctgacctcaagtgatcctcctgccttggcctcccaaagtgctgggattactggcatgagccactgtgcctgccctaattcaataccttttcatgacaaaaacactcaacaaagtagagaagcaaactacctcaacctaatgaaagccttatatgaaaaattttacttctttcctttccaatttggatggcttttatttatttacttacttattctttgtctaattgctctgcctaggacttaatactaggttaaatagaagtgctgagagtgggcatccttgctttgtttctgatcttagagaaaaagctttcaatttttcactgctaagcatgatgttactcatccactttacagtcagaaaattaaaaatggaattaccatataatctggcaatcctaacatttggtatatattcaaaataactgaaaacagcatcctgaagagagatttgcacacctatattaattgcagtattattcacaatagtcaggaggtggaagcaacctaaatgtccatggatagttgaaaggatagaggaaatgtgtttaagtacatacaatggactattatttctgttatgtattacaacatgaatgaaccttgaggacattatgctaatgaaacgagccagtcacaaaaagcaaatacttcatgattccactttgtgagatgtctaacatagtcaaactcatagaaacagaaagtagtgttgttaccaggggctgggagagaggaggaggaaatggggagttgggtaatgggtatcaacatttagtgttgcaaaacgaaaacattctcgcaatgagttgcacaaaagtgtgcatatagttaatactactgtactgtacatgtaaacattgtcaagatggtaaattttatgttatgtactttttttttctttttctttttttcaatttttttagtatttattgatcattcttgggtgtttctccgagagggggatttggcagggtcataggacaatagtggagggaaggtcagcagataaacaagtgaacaagggtctctggttttcctaggcagagggccctgcggccttccgcagtgtttgtgtccctgggtacttgagattagggagtggtgatgactgttaaggagcatgctgccttcaagcatctgtttaacaaagcacatcttgcaccgcccttaatccatttaaccctgagtggacacaacacatgtttcagagagcacggggttgggggtaaggccatagattaacagcatcccaaggcagaagaatttttcttagtacagaacaaaatggagtctcccatgtctacttctttctacacagacacagcaacaatctgatttctctttcctttccccacacttcccccccttccactcgacaaaaccgccatcgtcatcatggcccgttctcaatgagctgttgggtacacctcccagacggggtggcggccgggcagaggggctcctcacttcccagtaggggcggccgggcagaggggccccccacctcccagacggggccgccgggtggagacgctcctcagttcccagacggggcagccaggcagaggtggcgctagacgtctaggtggcacttcctagacggggtggcggccgggcagaggctgcagtctcggcactttgggaggccaaggcaggcggctgggaggtggaggttgcagcgagccgagatcacgccactgcactccagcctgggcaccattgagcactgagtgaaccagactccgtctgccatcccggcacctcgggaggccgaggctggcggatcactcgcggttaggagctggagaccagcccggccaacacggcgaaaccccgtctccaccaaaaaatataaaaaccagtcaggcgtggcggcgcgcgcctgcaatcgcaggcagtcggcaggctgaggcaggagaatcaggcagggaggtcgcagtgagccgagatggcagcagcacagtccagcttcggcatcagagggagaccgtggaaagcgggaggcggagacgaggcagagggggagatggtggaaagcggaatagggagaggaagagggagacggagacggagaggtgtactttttaccacaatttaaaaaatagaagatttagcagtatttttcaaacttgaagactcatatgtattacttgggaattttgttaagtttagattccaatttcaggtctgaggtagggcctggaattctgcatttctaacaaacttcaaggtgatgccagtgcttctgctctagggatcacattttcagtggcaaaaagttgtgaaatcatagatctcttctctgtcttgtagtggatggagttccggagggtgtacatttaacaagcttctggtgatttttatggtcaattaaattgagtttatttgaggtgccacagatctgtaatctgctttctagatccctttcttacccattcttaagccatcacagcagagtacctttctaacttataagattgtgtagaggttggaaggaggacaggactgttctgttggtataatgaccctgtgtccagttaatccatgcttccattgctacattatccaagagtgcaacatgacccaacaaaacctctatcagtcatgtgaggcattttttttttaacagaagaagagcattggcaccaacaatattccatctcttctttttccagcatgagaagaccatggttcttctagactcctaaagaaagtcatttgtacttagtgtaaggcgtgttgcttttggtaaagtcttttgaatgtgatgaaaatgaacatagcacaaaggcaaaatatatgctctcattgcctgcaaaactgtttctggtgctttattgaaagagcatgataagcaagatatcagtcactgccgcattgcataaacatagctcttctacattgtaatatggttctggtgagcctgcatgtctagaatagagcctgtatcactgaagtgcatgaaactgctgtgataacttgtctcacaaagcctcagggaacacattatttgagcaagtaaactcaaggtgaagttcttaccttctcagtcctgggtcagctgttggacatactggggaggaaagaggagaccatgtgcttctgccgaacaagacccaaatctggggaaagctgaacttccagggtgcacttgccctgttaccttctcctaagtacatgttgtgggaaaagtagggaaaggcggttagctgctagagctagctcagcagcaggagctcattctatgtatctcttctcaacccagcgttcagtgacttcatgttgatagcttgaaattggccaaggtaggaatatttacaccacagaaattggcaaggactacaaaccaaattctttggtgttttattttattgttttgttttatttagagagccacttgtaaaacatttactatcacaccagttcagatgatttagtagtataaacagcccatgtggtatttcttggataatttgtttcattagactgaggtacaactccaaagaggatgtcatgtcctgtacacaggactggaagttcacgaagccattcataaccctatatgaaggggagaaagagatgtagtgttcaggcaaagcctcatgagacgggaatttcctgttttgaactgaatccctgatttctttcctgcaacatacattcattcatcaaatattgattatcaacttttttataatacacaaaagggaaagaggctcttacttgaattatgccagaagtcagacaaaagaaagattgttgctttttggctggtcatggtggcttacgcctataatcccagcactttgggaggccaaggcagtaagatgacttgaagtcaggagttcaagaccagcctggccaagatggtgaaaccccatctctactaaaaatacaaaaaaaaaaaaaattgccaggtgtggtggcacacatctgtagtcccagctactcaggaggctgaggcaggagaatcacttgaacccagaaggcggaggctgcagtgagccaagattgcaccactgcactccagcctgggtgacagagcaagactctgtctcagaaaaaaaaaaaaaaaaaaaaaaaaccagatcgttgctttttaaaaattgacttaattcttcaataggttcattgattaaatatcaactttgtatcaagcaccgtgccaggcccaagggatatacagatccaggatacatattcttgccttcaaggaactgatgttctaataatagctaataacaagagctactatttcctagctactgaaattctagggttctcactatcatagtctaatgactctcttctgttcatttagcagacttcgcatactgtacactacctgcataaccaaggacttgagtttgtataagagtttaagacactgacatgtaaatgaaatatcaccaatttggactgatataagaaagtcgatgtgattacagagtgtttaaaatgcagactgtcttattatctttatatggataggatgggtcaaaggaggttaacaagaatttagcagctgaagccctacttaaagcattatataagaattaattttaatcaacatgttgattatataagaaataatgttctaaaatgtctttaaaatatttttctgggaataagagaaaacctccacctatgtttatgtaactgatttttgagttttcaagtcttttataaaaaaaaataaaaggccatacctaatcctacttgttggcagagaaagatgagagatcttgaaatggctcccgtgctcaaagtatttgtcagttttcatagagcccgaagtgccgatattgaagatgtatttcttatccataccagcatgtaatactcagcaggaaaaaggaacaaaaactccaaaaggtcacatactgtatgattacacaccacacacacacagactctctctcacacacatatgtatctaaaacattctcagaatgactaaactatagtaatgggaagaggtcagtggtttccaggagttacagaggggaggtagaaggaggctggatatgactgtgaaggggaagcaagaggaagatccttgtgacaatagaatagttccctatctcagtttccatggtgcttttgcccagtctacatgtgtgatacatacacattataccaagtatcagtttctttgtttttgtatttaactgtatctacataagatgtaaccattgggggagacggggtgaaggatgcacaggacctttctgtattatatttggtactttctgtgggtctataattatttcaaaataaacattttctgttttcaaacaatgatgtgtttctcggactctaagaaaattttcagcagaagaaaagtccgtgataatggtgactggggtagtgcagtagtggaaatagcagtggagaggggacgtatgaagttcttaatctggatcaaatactgtgctaagtactttatgttcaatacatgtattattttatttaatcctcaaaataatctcatgattgtaaaattcttttgtttcataataacgcccaaaggaataggagtttttaaacccaagagctgcccgtggaagaagcattattagagccatcaggaaacagggcattcagtgaattagaccgaaacaatagaaggatggatattaggaacactagaaggggcacatcatgctaacatcaaaatggaaaaatcatctacttcagagttgtgttgagagtctccttgtgaatatcattcataataagagagcactgacttgttttttaaaagacagggtctcaccgtcaccaaagctgcagtgtagtggtgtgagcctagctcactgcagccttgaactcctgagttcaagtgatcttctcacctcagctttccaagaagcaagggctacaggcattcaccactacacctggctaatgttttattttttatagagactgagtctcactgtgtcaccgaggctggtcttgaactcctggtttcgagtgatcctcccgccttggcctcccaaagtgctgggattacaggcgtgagccaacacacctgacctcagagaaggctgatttttgaatcagccattctaaaacagtggacctagaaagaagaaatcttctaccagtagccttctttctagatagcaatccaacaggccaaaagaaatttggggtctcataatctgataccaatattttctcctcagtagtgaaaagatttgaattaatgcatttactctaagcttgtttttagggaatgatgaggtaatagttaaagaaagtagacaacggttaaagtaataagaaatgctgaacttccaaaaaagctggccttaatattctccatcaactggcagtgttcccagtgatgcttctatcacagactgtgatagaactggcattacacaataatcctttcttcttcaataatgtagtaagacatcacatccatatatttcccaaataggactgccactgcatatctagttaaggagctatcattctactgtttctcttgagaaatgacactaaagcaaaaaacttttaagtttttgaggggttctattggccacttaaaatacccttgatatatgaccaaaattcatttaactaactaaaaacaaatagttgtgaattacatagagggcttctctcagccagatgcttctcatagataatctaataaagatcattgaaaaataataaaaagttgcatttctcacatggaggaggacccataatacagttcattctaatactgagggagtggtgccctctagcagtgcatgtgagaaatattatcatttaagtatattaaatacagcaaataaggagctcccagtatctcagctactctcagacataaggggcaatttgacagttctgagctactagaaactactgaagtttcacttccatgtgcactaattttttaagtgccagcgaaggttagattctaatagtgcccttctggggatttaccaataacttttaaaacctcattacctgtgaatgtcaaatagaacaggtccctttcacttttccttcaaacctcccctaggtcagtgtttgaggatgagaataaagggtacaaataggaaaaaggatcatcctacaagctgaacagcatctctggtgcaaaagatgctcacaaaatgggagaatgttaagaaatccattaatagctcaagtattcaaaaactgatggagttctgacaattttcccttaaaagtaccacagtttatggttacaactgataaatttgcagggttagataacttcagaagctaattaagtaaattgagttaacaaaagaaaagaacttgattttttttttttttttttttttgagacggagtctagctctgtcccccaggctggagtgcagtggcacgatcttggctcactgcaatctccacctcccaggttaaagcgcttcttatgcctcagcctccccagtagttggattacagaggtgcaacaccacgcccagctaattttgtatttttagtagagacggggttttgccatgttggccaggctggtctcgaactcctggcctcatgtgatctgcccacctcagcctcccaaagtgctgggattacagacatgagccatcatgcccggccttgaatttttaattccattttaattagtgaaagatgttccagccagtcttatctcgataagatatccaaaagattatatgcacaccaatagtacattacaaatgcttttgaaactgaaaggtgtgttttctggtttctgtgtgtctgatatgctatttcaaatcctgtaaaagcaaaatgtagttttttgacaaatatgcccatgtgttgtgcacagtttgatttatgtaaactcatttcaaatgctactgcagaatttctcctgaatggatgaaaaatgtccgcctaaagtgataaaattatatgtgtagaaagatacagttttaagaagggatttttatatgatacagatttgtaactctatttcacaaaatatcatttaaaaaaaaacttcaagaatacctgactttttttttttacatttttctgtcagttcaggggtttgcattgagtttgctctgctgaaacacttttctgtgacttagcttatatgggattggtaagtaggggaatgatgtcagtataacatagaccctggatttgttcaggtattttactaagtagcagcaaccaaacacaaagcctacgaacacagattaacacagctagccaagggaaaatacctactgcacatgattcccattcatgccacattcttcctgttggtgcagtgtggccacgtactccaacatgggagtgcttattgcgtaattctcaatctttctgcaatttgcacttatttcatagcttagcaatctcaactcttccttctttcttccatcaagctaccttctcatgcatgtgcacacacacatacactgtattttttgtagtagttattatgaatttaacttatctttttaatcatgtttatatttaattatgtttgataattactaggatggttattgtttttgtagtgttctcgttacataaatattgagtaggtgtcctgaccctatctttttcataaaccctacaatttttattgcatgattttgcagaccatagaagaaatgcgtttatctcattaaagcaaaaacatctgtacatctgtacttgcactctacttattaattgcacttattatcattgaattactcccagaattatagacttccctcataaatctgaggtaaacagattgagatatcaattgcctactagattcatttttaaaattttaccttcgcatgagaataccagccccaggtgtacattgcatggccctattaaaaagtgacctctccatctttatttgtttctaggcagttaccgaaagtatttccacaacaaaagaatgtaatcaagatttgacttgcttccactgaagcttactttcatttttaaacatcattagcctatgatttaggaacttttaagaaattggcccccattaccccccaagcccccgcattcacataacacacacctcaagttctcctttaagtaatttgtgatttatatttcaattttacattcaacatggtcttaaatattaaattccaccaggtcaaactgcaatgagtcaggcttttaaaatatgataaaattaagattccaagaaatgaatccttccattccaaaatctcttcttgcacattaattcaattaactcagaagaaaatagatattttccaggaaaaatgtcttttattttacttttgtgcgaatacaaatatgtatcttttgttttaggaaagaaataattctctgatagtatttccataggactatgttactggtgttagcatgagtgaattttttagaacgctagtggtgagcatataatagagctatctcaacacctacactccaagaacaagtcacagcttctcctaaatgagccaagcattgcattgggcacttgcagtgaaaagctaaacaaaaccctgtgtttaagaagcttacggagagtgacaatagagacagttcagcatgttctctaatagagatatatatgaagagtgctatgggacaaagcagaggtggcgaccatatcagagagcaaatgctttaacctacacaattaaaaaaaaaaatcttatggcgttcctaattttgtttctttccctttcaattttctgaaattttaaaatgtttgttcacttgaacatacaataaattttctttaaaagagtccctcaacagggagatgagaatattctgtgtcttgatcttcatggtggtgtataccaaattcaccaaactgtacacacacaaatgtaccttttaccaaatgcaaattatacctcaaagtttactaaatccatcaaaacatacagtgctacatactttaaaaaaattagcttcctccctttgatgaccaaggtagcaataagtgtattagagaaagaaaaagatgctgggtgtggtggctcatgcctgtaatccccgcactttgggaggctgaggcgggcggatcacgaggtcaagagctcgagaccatcctggccaacatggtgaaacgccatcactactaaaatacaaaaattacctgggcgtggtcatgcgtgcctgtagtcccagctactagggaggctgaggcaggagagtcacttgaacccgggaggcggaggttgcagtgagccaagattgcaccactgcactggcaacagagcaagactctgtctcaaaaaagaaagaaagaaaaagactaaggaattatctcatggaaggctgtcttgcataataattattttttgtactgtctttcagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaaggtactgtcttgaattattttcaatatttggttaacctgtaaaaatgtgttggtctgttattaataattctaaggggaaggtggggtgactatctgctgttcctgaactaagtgttaaaaaaagaacagaagctttggaaggatgagtggtaagttattgatctttatagtccttctggatttgggaattctacaaagcactccgtgcagagatagatcacatgatccccgctgaagactgccagagctgcctgaagatgaacagttagaaacatcctccttaatttaagcctgaaatttttgtagatttccccacctttccccatcctaagtcctttggtatatgtaaataagcccatgtcttatttgctatgacaacccttcaattatttggcagtggctattatgtctcctgttagtttctccttttttgaggctgtctcaaaactcattcaaaactcattcttttcaaaactcatacttcaaacagcagagtgttatgctttttatttcaactacatatttttgagaaaacaggttttttttctaatatctaaactcttcatctgtatatttcttatacatgaattacatttagaatgcatgtagtgtatacaatgcaaatatataggagttatttgaggttttacattagcttgcacgaaatggcaggtgtctctaagaccttttcttggctgtcacccctgtaaaatatcccctacctttttctataatctacttaatctgttgcaaaatggtaattatgcgtgaatctgtttgtcacctataagacaggatttgccagctgtatatataatgattttaattaatgctaaaggtcaggtactcaaggatgcaagaaggaagcctataaaaatgtgtacgtatctaccctttacacctgtacacctttggatttgcatatacatattagacctgatgatgatggtgttgtccattttaatgtaaacctgatatggtttataaatggtgtattcatactttttttaacacttgctatggactaaggagtaacaaatgtattaaatttgtggtatacatccctttctgatttctggtgtatcaagaaagcagtgtagttcattgaatgttgacatggcattcaaatttgtagccaaacctgaaaatcaatagcataattgcttattttgcagtcatcaacatgagattcattttctgttttatttacttcagtgtttcttaaaatgtggcacgtgagattacttttaatagctatgtacttacttttaatatagttgaaatataactagtatgtaccacatgtatttctcagaataaggctacattttaaaagttttaattttaaaatgacactaagaaaataataatatgggtattagacatgtcaaaaatcatgaatgaataaagttataataacactgtaggtcaatcaggagaagctaagctatgctactgtaacaagcaaccctgagttctggcttataacaacaaaaggcaatttctcttttgcacctagtgtacatcaggggtttggtagtggctctgctcctctctaaggccagcctggtggaccaagatgctctggacgttgccattgcagaaggaaaagagccaaacatgcatgggttcttaaagcctctacttagaagtgcaacacttgcactttcactcacatttcattggccaaaacaggtcacatgttcctgcaactcagcagggaaatataatcttgctatgtgcctggaagaaaagagacaacctaatattttgaacagtattaatgactgcttacaactgctacagcttaaccattgttacaagctaattaaattacctttggggaaatagtatgccagtatcaagaattctatatgatatgtgaatttaattgattgtttccaccacttgacttaccacaaagcttgtctttatccagatttcattctatctattcctgacttgactaataaggtccaaatatgcttcaacatttattttgcactaaaatatatatttaaactgaggaaactccccatcattacctaattcctgctatttatcgcctccaccttctctgtcagcaggctagtcccaaactatcaatattagcacttattctccacatgagtgctgtgttctcacagttctgatcctcgttcccacctcactcagaatgtattaaccagatatgatgattttgttaatgtaaatgcattaaaaaactggccaggtgtagtatataggggaatgctggggacttcagtgtttgccccatccaagggagacacctgccactcagccatatggagacacaggtcaggtgcctgctcatcttcttgttcttcaagagaaactagaaatctagacttttgtttgagcttccattttttaaatgtcagcaactaatttttattttgatgatgtacaatataaactgtgtgcttatagaccaagtttacttcatgagccacgggtttttaacttctgagaacatgaagtggaacatttcatagtttctgaaatgggtgaacaataagaaagattttatgattgttttctcattggcagagaagagattctgccatttttctcatttctttctgatagagaagagggaaaattaagtggatgagtgagaaaaagcaattgtagatgaaactgatgagtaaaaaattttagaacccctattttgggaaaggattgacctggtagaccaacatgaagtgcaaaattctttgactacacagctttgagtaataatttctaatgcactgcctcattagccttaattctcttttcagatgtagaatcttaggaaacaaaaggcaagtctttaacctttgattaaaaatattattaatcccttaagtaaaaaatactggcataacacagtgaaacaacactttatgatcaagccccttttattaatgttctgcctagattctgtgttttgaaagactttgctaaactcttacttattgacatttaatttcaattttaattaatcaactgcctacaaatgagtttacagtagtggtattagaagcaatattttaaaaattaaaaaggttttgtctcatctaaccatgtggtgatattgtagttagctaagtggatatagattcagaaacactggtttaacattaacatgttcgttatcttaaaaatatgtttaaaatatgttattgttttggcttcccattcttttggaaatatacagcatattcacactagccttatctatgttaatccaagcatctaaatgaaagattgaaaagtcaagtaatttcatagcattcttcttgggtaagcagaatatccataaacataaaacatttcttattgtcttgtgtgtgtctccagcaatcagtgtaggcaatatcaggcatttaaaacagggaagacctgtcacacagctcaagagctttagtcctcaggagaggtctctagtcaccataaaggcagttggaatcatttggatgaattgaggaattaagcctactaactgaataaggttgattattttatttactgttagtttttagacagaaggtactttgaggcaggtaagactgaagttgacctattaaaaacaaaaacattaaaatacagaaatagcagaatcattaataaaaatcctagaatcctaggattataaggagctatacaacaattgtatcaacccagggtggatgcttttggttacaagtaagagaaacccaactcaaaaggacaaacgagaattcattggctcatgtatttgagaagatccaggatggattgcaactgcaggtatgacagggcttaggtgctcacacagtatcatcaggactctgtctcgctctcttcctgtctcacctgcacctttggctgttttggcttcttttccaacaggctctcctctcctgctagtaggatgactactggagccatgtactcaccctcttttccaatgtatcgcaatgtccactgatcaggcagacgtgagtcatgtgcttatcctaagaggcacatggggaagcccatctcaaaccacatggactgagaatgggacaggggttttcccaaagaaatcgagctgctatcaccagaagaagagggaatggatgctgcgcagaggctgatgccaaactcccaccataattacagagcccatcttccatgccagggcagggatccccacaatggctgggcccacatccttccctggttactaataatgatggagaccttactaattgttagattatgtccttgcaacttccactcatttttggtttcactttgtggaattttactgacaaatcagattgttctccaccacccctcccttccctttctatactgggaggctaccctatgttctctttcaattcttttctaagcccagatgtcccccttgtatctgattttcttcagacagcgttgtttggcatcctctcactgttttggtcatttccaagcggttttaataagggaaaaagtagctttatttatctccacagaaaaggatgatgattattattgttatactagagagaaaaaatgaccttcagcgagtttggattagtaaggcaagcaagtgaatgatataacatagaaagaccactccctgccaatgtttatttttaaaaattaatgtggtgcttagacaagaaagtttagttgtctggaaaaatcactgagacaaaatattttacttttcaccgaagccaaataaattaataaactgtcactctcattaatgttgagtaaataaagtcttcttattcttatgcttaagggtttccccccacccttttaaatattagactaatacattatgtcaagcaaatggataataagcaggtataggtacgccactgaatttttccaaaaagaatctcacacctacagtctgcatgtcgcaggcttgggtttagaacagcagcatgactctgttttgtgaatctagccaattccagtttcattccatggatgcagcactcactgggtatttacctttgcttagcactagagagagagaaaaaaaaggagacatgaacctagctagccctcacggtgctcatagactagcgcagaggcccagtagcacaatatcaatataaatttttcaacaatcctgaggcatatgttataaaggtgatgtattgagaaggactactggaaaatgtagggcagcgatagattgtggaggccttgtattttatgtctgtggagtttagacttgaatcagaagaccatggacagaattgaaggattttatgcaagggagtgtgcagtcatatgcatgctacagaaaaattactgtgcctgcaacatgcagaaggaatcagggtagggcaaggttgaggatgcagagagggcaattccaggtagcagtctaggaagaaaatcacaacacgtggatcacatcagtctcctgagagtgaaagagagaagggtgatatacggactattaaagggtagaactgaaaacacttaatgacctagtaagtagaaggattgaaaaaaggaggaggaaaaagaggaaatgcctcctaggatcccatctttaggaactgacgaatggcagttcctaataccacttgccgcagtagtaaacagagaaggagcaagactgagagggggcaaataaagaggttactgttagcatgttgaatgtgaggtgcctgcaagtggtgacgtcattcaaacggggattcccattcaagtgtcacctgctcagagacacttttcccagtaacatacttaaaatggtaaaaccctcaccttcttttcctaatttatatattttatagtatttgtcaccatcccacatactatgtattaacttttaattgtttatttatttattattttttagagacagagtcttgctccattgcccaggctggacagcagtggtgagattatagctcactgcagccttgaactcctgggcaaaagcgatcctcccacctcagccccctgagaagctgtgatcacaggcacatgccaccatgcctagctaatttgttttgttttgtttcgttttgttgcttgtagagacagaggcttgttatattattgcccaggctggtcttgaattcctggccttaagcaaacctcctgtctcagcctcccaaagtgctaggattacaggcagaagccaccacaccttgcccacattttaaccttatcatcgatcttctccaccctccacccattggatcgtaaattccatgagaatagaaatgtgtgctgcatgtgcgtgcatgtgtgtgtgtggccggggtggggggtgggagtttggcttaaacagtacaaatttaggccgggcgcagtggctcacgcctgtcatcccagcactttgggacgtcgaggcaggcggatcacgaggtcaggagatcgagaccatcctggctaacacggtgaaaccctctctttactaaaaatacaaaaaaattagccgggcgtggtggtgggcgcctgtagtcccagctactcgggaggctgaggcaggagaatggcgtgaacccagaaggcggagcttgcagtgagccgagattgcaccactgcactccagcctgagtgacagagcgagactccgtctcaaaaaataaataaaaaataaaaaataagtacaaattgagattcttatagttctggagataaaaattctgatatgggcctcattggtctaaaatcaaggcttcagcagagatacactcattctggaggctctaggggagaatctgtttccagcttctacaggtcacctccattccttggctcgtggtcccttcgctccatcttcagagcttaatgaaaaagtgagggaggcaagtcttaatcggtagaggtttatttcgccagggttgaggacatggctgggaaatacatacgtcactggagcatctgttactggtgctcttccaaaagggggtttgaggatttttcagtatttaaaagggaaagagcaagcaagagagaaaaaaaaggagggagggtggacaaagatgcagatgcttacagtctttatttatttatttatttatttatttatttatttatttagagacggagtctcgctctgtcgcccaggctggagggcagtggcgcgatctcggctccctgcgagctccgcctcccgggttcacatcattctcttgcctcagcctcccgagtagctgggactacaggcacccaccactatgcccggctaattttttgtatttttagtagagacgaagtttcaccgtgttagccaggatggtctcgatctcctgacctcgtgatccgcccgcctcggcctcccaaagtgctgggattacaggtgtgagccaccgcgcccggcccagatggttacatttttatgaggctgtgatcggcctcaggaaatgtacattttacgtgtgaaaagagggcatcaaggaaaaagtcagttatgcattcgtcgcagggtcagccaagggataatttctggttttgtccttttcctctccgtgggaagataagctggtaattgacgttgtcagggtgagattcaacggaatttggttttagggctagtttatacaggggatatgtatcctgaaagatttaggggctcacaaggaatttcatttgtgacgcaggccatctggggagatacgtggccttctgtcattgtgggaacctggcttatgggtgaggctgtgatacagggttgtgaaattacagctatcggtctgggaacaaaaggaaagcagtgttgcgtgactcagttcccaagcttaactttttctttggcatagtgagtttggagtcccaagattctattttctttcacgctagtaaaggcaagttcttcccccatcccaccactctgacctctcttctgcctccttcttccattttgaaaggccttttctattgggctttctgtatatgttttattccgttctttaacactacaacactgcctggcatagcataagtgctatgtgagtgtccaataggaaactggaagtatagatctgagttctggaatagagacagagatacagacatcagtagataagaagccatggagtgcattggagtgcatatgttcatccagagagagttctacagaatgagaacatctatggctcaaaggaaggtaccctgaggaacagacacattcagagaatgagcggaagccacgcctgctgggaggtttgaaggagactcaaagaggtgggagaacatctaggagaaagtaacaaacagaagccaagggagaagaaaggtgcaacaaggagtaagcgcttggtgcttccaagaccctcaaaaaaataatggtgcaagcatgactgctggatttaggaaccttaacgttaccttgggcagagtacttttaggccactgtggaccagttttgaagacacaataaaattgtataaacatccatattcttaggcatgtcttgccaaaccgaaatacatgtttaggtctgcctgacccctgcagtgtaatcagatcaagtctagcattctgtgaaaatatccaactgaaataagaatgaaattcatgctcatgtgtcttgtctatagacactggtatctgcctccaaagtgaaattggatcataaccctaatttgcctctcttcccaaaggcttttggaagagttgaaattcatgtaagacatggaaggaaatcccagtgcagggctgcacaactctgtgttgcacacaaggtgtgaaacccaggtccaaagacgctggcagtctgggaggcaaagcaaatgtgatggcaggtatttgcccagaaggccgatggaatcctggtgtggaaagtaaagtttattgcttcaggcattctgtctctgttctggaggcagagtgtctatatatgtgctcttaatgagaaacctgccctcaggatatctcttacagttgctgcagagctataaagctctgttattaggaattctgccctggggaacaattatgttattgcaataattagaggcagttcatctccataataatggaaatcctgccttgtaggcaaaacaacatcaaagcaacaggagcgtcattgctctagttagaatctgctgccctgcttattggtagtactatcattttaattttgcacatgcagttacgaaagagagcttataccgctcttcaaattcagacctagaacttcttgccgttacttcagtttgtctctcctagagccatggataaaatagttacggcgttgagctctcctgaagtgcagttgcaaaagtgtttagggagattggtgttttaaaaatgtttgtcagaatccacaggcccagtcctctgggagaccccataaacttaccctcagccaaagccttttctatgtgggtatagtatggcatgttattttatggccagggttaaaatgatgactaaatccggtgactacctgagatgggtctgaccctttgctctagtcatgtggcatagtaataccagaagacatacatgtggttatataactcaagacatatatatggaatttgtatatgaagctgctttttaaaaagtgtccaatctaaaggtaacatttgattttcaaaaaaaaatcttttgaagtgtctcacatattaatcccttccttgcaagtaagtcctttgccactcccctggttttcaggccttattgtctcttgtgtgaattttgcaatgattcaaccaacctcttaaatgatttcattggaaccagccctcacccaaatcttctacaagatgaaacttaccacaataaacctctgagaaattcaattgaatgaatatctgtcacgtatctccctggtacaagatgtatttgagattatgaacataacctaatttaaatcaaggttctacatgtgtcacggaaaagggacgaaacagtttcttccatgatttaccagagacttttttttatcttatcatagttataaacttcatatttacagctattggttatttaattaatgttcattttccctaagaggctgaaagggccatgctgaaaagtgccatttgtgttggagcatacaggttccccagttccttgtgctatacctagagtagaatagacactaatgttcttgtatgaaatgaatgaaccaacccaaatcgtctgattcttggaggggattgaggagaaggtggtggtagtatatttaggtgcaaggagcagcgggaaagaaatgtatttgaaaggaaagtagagtgaaaggtttgagcaggaggagataaaactgggacatctctcagaatccagttgagaaaagcattccatggcaagctaagaagctggcatttcactgggaaacagagtgaagtaatgattttgtcttggggcttcacacttccttttaagttatctcctgtcctccatcggttgagttcagtgtttgtactcaggtagtgtctgccgtgacttaccatgcacccacctgggaaagcatttcaacttcctaaggcagtgtttctccattcctagagcaaagatccagtggttgttcccaaatttaggtctgcagctcagtgccaggctgactgcagcaaaatcaactgagatgtgttttagaaagcagagtcccactctccatcttcaaagatgctttctcgggaattctgagatggggcccaggaatcagaatacttgtttcccataggattttaatgcacactcaggtatgacaacgtagcagtggcttcccattgacttcaggatagacactaagtcttatgagatgaccagtaaggctctatatgctactcaggctcctgcctgctgtctaccagctgtctcacttcactcacctttaccctcagtttttgagccacacggaccttctctcttttcttcaaatggcttcttcttcctcttgctgcaaagcctgagaacgtgctgttctccttccctgaaatgctcttatccaggccttgaaaaactaagtccacaggccacatccaaccctccacctgtgtttgtacagttggcaagctgagaatggttttacatttttaaatggtaggaaataaatcaaaagaaaaatctcattttgtgacacgtaaaaattatgccgatgtcaaatttcagtgcccacaaataaagttttactggacaggacacagccatactcattcattcacaaatggcctgtggctggcggcttttacactgcaagggcaagattgactaagtgggactgagcctacccagatcaaaaagcctgaaatatttactctctggctctttacagaaaaagtttgccaaactctgatctaactcatggtacatttctggaaatgtggggtattaaaacatcttcatagtaacatgatcttcccccaccttgggttttttgtttgtttttggtttgctgtgccttttatttgttctttgtgacttacacttttgattaaattgtcacttccagcatgtccgtcttatgcaaagcaaaggggaagtgaatttggtgggaggtccgaattatctcactttgctctctagagcagtacctcccaacttttgccaggaagaacttcttttcatgcccccaaaatctgaactccctggagaaatcagagcccaagggagctttaaatgtgaagacacagagggtgagggatggtggcagtggagagaaaagtagatacctggtcatcttccccatatttctgaacaaccagtaaaaaaatgaagtaatgggaaatctccatccttggttgaggatccatggttttacgtggactattttatacaggtgctttaagtttatgctgataaatatttatgaatggtctagttccgttggggaaggaaagagaagacagcaatcacaggacttggtttctagagttttataaaattcagctactgtgaccatgtatacacacatcaaacaatttagaaaccaccagtgaagcacaaattaacataatatagtccaaacagaatccacagcagtgcttagggaacagactgggaagagactctcagtcaggcagagtctgccaaaatcgacttccaacaggaagtgagtttaagcctttgtgaaagaaaatgctccacagagagaggaagagagggaagggagaagtctccatgctggagcccatgtacgtgcagcaagtcatgtacaagaaatgaggggaagagagggactcagccagggggaggagttgccatctgtagcatttagatggaagaggtggaaggacaaacatcaacaggaagaagctacaggtttaactagagttgattaacactgtaaaataatatgaatgaatataaaataatagtgccagaaacacggtgagtcagcttaactgtgaagaagtttgggaatctctagccattaagtagaaatgagactttgatctctcgttatatcactaatgtatttttgaatacatttgaggctttggggatccttggggattcaggttacttattactttggctctagtcctgtatttcatggttatcttgtggccatttttatctctgtaaaaaaaatgagcattttcaaccccccatctgtcaataataatagtaacacccagcgcttgttttttttttagtctttactatgccctctgcttaatttcttttaatcctcgtaaaaatgttatgggatcagtcctattattgggactccatctttcagataaggaaaccaaggctggaagaaagcaatttatttaccttacttaaggttgcaaagcttgataatgttaaatctggaattcaaatctaggtctcactcattgcatctatgtctaccaggtttgcctgaggaaggaacaagcactagatgcttctttctaagctttaaaagggagataaagctttcgttacctccctggcataggactggcatagcagcttttcctgttactcatttcatattttcagtaataaactggcagctttcagatccatagctttatcatttcctgagagggagagaggtaggatggtctgatttcagggctgggttagaaccatgtaaaccctttggagaagaggtaaattaagtccttgaactacctcagccgtgcctttgttcagagaaaatagctgtgtatcatcaagtggagttaagtgatcatgaaaatattcaaaccaaagtggcatgtcattaagagcaattagaactgaagtgatgtgactggatattaaaaccagacaggcagtgctttgtgccttctcagtagagacaaggcagatgatttgggttcctcctaactttgtcatctctagaaataaaatctgctagacttcttagatgtattgatgccatgtaaatattgaaggtctgggatcatatactaagtttgacccctatatttccattatagagttttctcctcatatttcagtcacagatatgccagagttaattagatctctactagtaaatatccatcatgatgtttctaaatcccttttgccaaatgatctaattagagcaacacttggctttctatataattacaacatatggcacctagagggtacatatagtagaattataggttgcctgatgagaaatccaggtggtgggtaaaagactccattaaatagagtaggtgtgtgtgggtgtgtgtgggggggtatgggcatgggtgttaatgtacacaattcctcctacaattctccctagaataagtaatattttgtaattcagctgtccttcccacatgaaacaacatgattatatcatggaacaggagttaaaatttaaaagaaaacaaataattgatgacattaggataaattttttaaccttccatgcccctaaaaatgatcacatgtagtaagtcagcaaggctgaaagcagctctgtgtaagatgcattatgtgatgggatgtattcctccaagcaagatcacttacccaaactgctaaatataaaacaaagatgggaccataaagaaagaatggtttcttaatgcctatttgtaatctctggaagtagagtacccaacttcagtaggtgaagagttcagtgttggtttgttgaatttgaaaagcttatcctgcactgttgtgctggagcccagtagcaagggctcaaaagagtggattctgcacatccattcccagctctctgttcagcgatagctcacattcatagcttgatgttagccatcggcagaatatttacaccatggaaataggcccacttcaagggcagtttttccagagccactgtggtaaacattgacagcacaccactagctgtgggcatatgcagctcagagttggccacgccagtttaaagtccctgggacagatcaggtggagaaacatgactttccaaattgttacttttgaagtaataagggtgtgggaggttcattgagagaaaagagaaaagcaaaagggctgtggacagactcttctgatttatgcagagtgtgcatgaaagagaaaaagaaacagaaaaagttgtcagaaagctaaacggagaaccacgaaatagggctgctgtgaaattctaggtatcatgaatggacagtggtcaacaatgccaggtgtggccacaaagtcattcaggatgagaccacaaatgatatatatttggtgacaatgaattcacaagtgaccttgaaataaatactttagataagtgcaaaagctgtacaggctgcatggtaagcagccagatgcagtggatctttttgcaggtgttaggtaaggaatcggaagcttagatatactgcaagagagtgacatatttgtggcaaggatctcattaggatggaggagattggggaatatttatagcttgagggaaatcacactgtgtcgaagaaggagttaaagatgtaagggaggggagatgattctcaaggagagagcagaagaatggactagaaatcaattattgtgggaaatgatgaggaacctctgttctctgtgggtaggaagagaagatgagtaaagtctcagagaagttaagggtaaaaggagttgaggaatttcatataacatacctttgacctcaatctcaataatatgagagtcaaggtcatcttctgaaagtctggtcatgggggtgattgtgcacttgagcaaaagggaggcctggactgtgttttatggtcaatgtgatagaaataacatttgaattgagctttttatattttcagttgcttccacacacattgactttcccacatattgatttgctctaaagggttttattccaaaagaggtggtttgttccaaaggatgcataaaattgttatagaaaaaatgaggttgactgctcttaatatcaggaaagatgtttttcaggtgaatgcaatgtgttccaactcagaaggaaaacaatgcaatttaaaattactattatcctttctcattttctcaaggactttccctccttcaatcattcctgctctttctctacatcatcagactctcccttttcttactgttcctattggattgttccttccagcacatctgcatcttcctcatccactttgcctcctttgctctgtctactttccctctctctccaggcaatctcctcccctcccatggctgtaaacaccatgtgtgtactgacaaccctgaaatgtgtgtcttcagtacaggattctcccctgagcaatgtatggttaacattcttcagaaggaactcactcctgccaccagtctccaccctgaaccttagtcagttatacaccacctctctctgatcgcttgagcctgaaacctagaaatcactgctaatttctgtttcatcaccccatttatcctatgcatcaataaattttaaaaactttacttccaaagaacataatctatctccttctttctatgtgcattgctggtgcactggcccaaccaccctcatttcttgtccagatggttgcagtagccccgacgcgtcgctctgcttctatactcgctcccttccaatgtgttctctgtaccatagccagaatggtaatggaaatcaaatctcatcacaaatgcttaagatagaagctaagctgttgaacacaacctacaaggtatggcatggtctggctccttgctgtattatttttgtgttttgtttcatttcccctcccttacatctttaactccttcttcaactgcctctccctacctgtacgtgccagaggtctgaggccgtgtataccgcacttctcactataacaccagtgcctcctttcctcttcaatttcttctttgcatttttctgaatttgtaattccatatttatgttttcattgagttgactgttatctgccttcctaaactggcctgtaagctgtgtgaggacaggatctacctggttccgttcaccactatttatccagcactagccctggaatacaacttagggctttagtcaataagtgttcaataaatgaagaaagaaatcaatggacttacagcctcttttcacgaggactagagacttctccaaaaataaaagcaatagtaaagataaaagtaagtaatttagggagttggaataatggagaattgtcagtagaaaaataaaaatggcagcaataaaattagcacatagaaatactttcagtataattcacaggtctggttgtatctgtcttgctacccaatcaaagaaagaaacataattagttataattatcgtgtttataaaattaaaaacaattgtttgtccaatagtaaaatcttagcaaaaccttcctcatgagacgcaattactgcagttgatataagatttcatagatgtgccttataattttcatacatttggcaaatcatgtggtgatggaggacaccttagtaaattaacttctgtgaggtagggccaaatatagagctttttaatggtgaagcttgatgtaagggtacagttgtaaatactacatcaatatttcccaacacgagttcttgagatggggtgggaggtgatgtatagggtataaagtggtgttctataatcaaataagtataagaagtacaatttaaacattttgtattgcagactgtctcagaatccttaatatgttgattacagtgataatcttcaggaagcgtggttcccaaatttatctggaaatcaattttgctgcacagaatacatcaagggactagggtttcagggagcaaaaacttcggaaagctttcctctaagtggatgtaagactttatttactttaggaattccatgattaattttcacaaccatgattgtataaggacggattagaaggaaatgcaagattataattgctggcaaagaatagggagtgcacctattgtgtgtccccaatctagatgaggtgtatactatacagtagggcaaagagaaacgtgagggcaaatgtcagaatgccgcctttagggtggaacaaagatgcaagttccttgggagaatcagcaagcaggagaatcatttagctcacaactgattcctgtccacaaagtcaacaacaaagaaggctgggtaaaagctacagagagtctcaagtttttcctgatgtatttttccacaggctgttagacctaaaactgaatagctaaatcgaaagcaaaccagctatcccaatatagcataacagcatgaacaactcaagcctgcaattagcccagggagaacaggactttacttctagttccctcaagtgtggaagaagcaaagagagcacagtcaagtgagaaggaacactcggcaggttcttagcaattgcaccatcttcgttcttgatttaacatccagcgtttcatgttgattagtgaatacttggttatagagacacaaattttatttagattgtttgtttatttttagactcctaggtaatatataaatatataaatatatttatatatatatatatatattttttttttttgagacggagtcttgctctgtcatcaggctggagtgcagtggtgcaatctcggctcactgcaacctctgactccctggttcaagcaattcacctgccttagcctccccagtagctgggattacaggcatgcaccaccacacccagctaatttttgtatttatagtagagatggggtttcatcatgttggcgaggttggtctcgatctcctgacctcgtgatccacccgccatggctggtaatatttataatggccacaaacagttccctagcaattgatttggaagtgtttgcaatgctgggaacagatacccatatgatgcactttgcctacagatgtttgtatttgtatatgtgattatataataatggaattgtagttccatagtaaaaaataaaaataaaaatccattgatgaatttttcctcagtagctctaataacctttacctgtatcactcaaacataatcacaagccaaggtcatggttcagagaaaaaatgaatttttggggggttttttttttggtgttgctttgtttggtttggtttttgttccacaccctcaaataccaacagaaatataacacctcctttattaaattttatattaacagcaacattttgagataactagagcataaattttttttaccatttcattctcggaagcacaatagcacagagttaaaaaataaatctaagtagtagaattttaaagctaagagcagcatctagtctaagaactccttgaactggctcctcctccatgtgactgcattcattttctttctgataatcatgaaaagttgagctccatgatgttggtaacgaaacttttattatttctgctcctccatagaaccattttgtatttatttttgaatatgtcacacattttgctctccttgaatactagactctattaaacacctaccgaaaacacagcaaagcaaaatgtaagaaaactaacaggaataatttcaaatttcaaatgatagcctctgcctttatttaacaaatatttgaggcaactgaagtaaaaaataacatgaatgctctcttgaactttaccagaaccttgtctaaggctactgctactgccttagattgcgtgtcctgaaacaaactcagatgacaggttgcatacagaaggtttataggggagtgctctctgaggatacacctgcagggaagtgagaaaggcagaaatgagcagagagagaaactgtcctacaggttggttgcaactgggatttcagctagtcccactgagagctctggagctcagatagcccttcagaatggtcttaccttgaggcaagggaatgtggtctttaaatccctggatcagccagtcatgggcctcagatcatcacctataaggggtataagcttagtggaggcagttccccgtttcagggggtaattcagtaagcgacacagctttaagctgccccatattcttgggcagagtttttggaggtagaatgctttggcctgaaggagggaaatctgggtagagtactctttcctataattataagagatgactgtatggcacccttatcataggaagaaacatttggaactactcattatttttaaaaaaatgtcttatgttagccaattagtcttcaacaggatgcccggaggaatctgtctgaatttctcatcatgttcaaagcataagttgtaattgattctttcttggcaagggaacgcagtgtgattcctctgcctcatttcctttttccgatcctcccctcaaaaagcagactcagggaatatgacctagacagtatccccatttttagccttggggactctccattttatgaattccctttttccttttccacagacactctctcttaaaatgtctgggcacctccccctctcagcctttatcctctcttgcttactttttgtcaaagattgtcagtaacttcatttgaggaaggaaagaagggagggaggagacaggaaggaaaggaagaaagcaaatctgaagaaaataaaaaacttcgacatcagatcaataaaaccacctcttcgcctagttcctatgactttttatgcaagagggtcagtgtcttttctctgctttgagttgcaggaaagaaggacactttaattagcctaagttagtacatggccattgcctagaggatagatttgtgtcaaacctaaaaaatcaagggctagaaaaatagaacccattatatatacatcacaatatagttatgcattcaaattcatttggaatttttcaaaagtgagatagaagattttaatgtggaaatgttctgtacaacttatagatgcatgtcatattaggtaagagtagggtccagagagtctcatcttctttcaaggatgtatatcttttcctgtagctaatataatctctgattattaggatttcagggctaaatgaaactttagagataaacagatgagtgggtttcaactaccagttgaaaactctggttttcagccatccctgggggatgcagcatatcactattgttgaaaatggttcattgcacactgattgtcagaggaagtggggatggggaagaggtaaggggagaagggagggtcaataggagtgtatgagaatctcaggcaaggggatgctttggaaaatccctcctgaactttctgtcatgcgtggctttccaagccgtgggatttattggtttccccaggacttttgttttacatttatggtaaaactgaggttagatgattcatgacatgtctcataattaactattgacgtgtatatgctcatgtaacgtcatgtctcactgtaaagcaataaagctttctagcaagaagagtatttagaatcccaccagaaggttccaaaaatcatccaaccaagggttcactgaaatgagctttctttggcaagcacagtatattagctggctccacgtttaattttttaaaattaagttccaacatttataatttggtacatgccctataatccagacttcggacatctcttcaaaaactgaaggatctgcaacagacagcttgcttttttttttctttttttttttttttttgagacagagtctcactgtgtcacccaggctggaatgcagtggcgtgaacatggctcactgcaataatcccagacttctgggttcaaacaatcctcccttcttagcccccatgtagctgggaccacaagtgcacaccaccatgcccagctaatttcttaacgttttgtagcagtggggtctccctttgttgcccaggctggtctcaaactcccgggctcaagcaatcctcccaccttgtcctcccaaagtgctgggattacaggtatgagccactgcccctggccagcctgcatttctgtatggcaatacttatccagagctaagaagagttatccttttagcaaaaacatgaaatcttcagttagccatacaatccttgtatcccaaattaagatgtggtgtcagttgctgcttatcattgttttcgcattgtagtttttcttacagtaaaaataaaagcagaatattttttgcgtctgtttctctatcaaagagtgaaaataagaaaatgtagtcaaaaagaccacacacttcaagaaaatacaggaaaagaatatgttctcttatgccccataacaaattttcctgtgtacaggcaaagcatgtcatgaaaaccttcttgccagcttcattcatttttatgacctgcttacctcctataggcaatagtgcttgtacatctagatctagctctatccctttatgttaccaatgatcattcagaaggagaagaaggttttaaatccctcagactacctgtgaagtctggacaagaacctagttcctcacatctataatagtacagtgttctttttattttaccatgaatggttaatagtggaaactctgtgttttctcttccctggagattgtactaatctactcttgttattttttggttttttgtttttctttttgtcttcatttgctctgtcatactgacgtgaatggcaggttgtcaattaaccctcttcccagattgtattaaaatctgagtataaaagctacagccagatccctatctcttccattatagataccagacatctaacaacacccaagtgagggttttctttataatttttcctacacagctgattgtcagcctaacttagtgcctggtagataaaacggagaattaaacttgccttttaggccaggaaattattctgttctaacattattgctcatattaaaaccctgtgccattaaagctgtctctattaaatgaatatgtgctgggtgcgttgtttattcaatttaattgtagggaaaaaaaaaactcatacgagggaaatggttttttgaactggtttttaccagtcacaagccatgtgaatgagtgtccaattaaatagtggctcactaggacttgtgtaatagtaacatctgttaccttaattaaacaagttactatataaaggcactttcatagctcactttgttagagtaggttctgacctagaaactctaggaaggtttgttctctttgtgggattttgttggcggtagcgttcccagttggccccattaaactatagacctgacaagctctgtgatctacaaacctacaatacgttcaagcctacagagcctagaggaaggagggaactgaagtttgtgatgcaaagtggaacaaataaaatagtaaaagtgctgggtaggagtgcttcgtactcattttgatgaacttgggtgttgtgactgagaggcaagtggtggtggtaacagagaaaggagagtgaacaagtatttattgaccctccattgcatgttaggctcgcaggaaaatctgtatctgcaggcataggtctacaatcctgtatccatatctttgaaatccaaaaagctctgaaaacaaaaaaatatttttctgtcttttttcttctcttgttaatctatttgtttatttctggcaggtttggagcaaactcatttggtggcaaaaccaaactgaggctattgatagactttgtctttatttaccccatgttgaatcacagaaataataatatattgggttgtgagatactacatacaccagacttttcttgggatgttatataaaataaatatactatggtgttttttaatattcaaaatcctgaatgccaaaacacaactttccctgagagtttttgataaggggttatgtattagaccatttttaaaaaggtaaaataaactaaggctcagtgatattgttttgctcaaaaatagacaactaatcagcccttccagtgacttcccattcacttcaaatagtctctgcttgccatatcctgcagtgtcctacatagccaggcccctacttatctctctgaccatatctgctgctagctagctctttctcttagctacaatcacaccggctttgcagatcctcagtgacatctagctcttttttgcctcagggcctttacacttgcttttcccactaactgaaacactttcttccctgatctttaatgaacagctccttcttgtcccatatctcagctgaaatgttgtctttgcagagagacctcaagcacattcaaaaaagaccttgctcctgtcatgccaaccaaaacgagtgtgatggaaagttagctgaattcctactggattcatagatgaaataatatcagaaagaatacagatattatgaagtttgttttttctgcctaacgtctagtacttctttgtctgaaagaagcaccctagcgatgctttcaggaagggccttttcccattatttgcacccttccttgcttttttcagtgccaagtgctctgctgttctctacccagtggaccgggttatgggaaggcacaggctaagccaatcagaccctctccttctttcaagaatcagaattttcctatgggcaggacacagagcagagacattgggtggcagctccctggggatattgctccttaaattctactctctagacccccagagctactactggttgctgtcctttccaagccctatttgttctgctttttcttcagtttgtgagttaccccatatcttttcaataagttccccattttgcataatttaactttgcttttttgaaacagactttggtctattttagttacttacaatacccaaaccctaactgatataggcaaacagatagaacatctttaatttgtatgtttttctctaaatctaacttagaaaagtaactctttaatggcatttgggtgttcatcttagtggttaaaaataattatatcttatcccatttgaataaaacaacttaagaagttgaatatctacaatttgaggaaggggagcaatttgaaacattttgcttcgcaaagatgtttgcatccagcttaactgcttacccacctgattaagtaccttatccatgactaatggagttgtcgaacatgtggacttgcagagactcatggaattaaaatggatgtatcccctccagagagccctgtttcctcgaagggtagctagcactggagtgggatgctgtgtattcccacaggcatgtgctgacatgggagttgctgaaatttggaggctgaaacattttggctgcctttgtgcaaactcaggttgtctggcatctgcatcctcccagaatgagtcattgtatgtccatgcttcattgattcttgctgaaggagatttggacaatgggcctgaacctgccaaatgagtttgggaagccccaaacacatcggtagcttgttatataagcatcttgtgctcagcagttaggcctgccactgtctgtgatgagtagcaggtccctgtcatagtgacatccagatgaggttatttgcttacctctgtgcatgacatgtgagcccaaagatgctggactaggtcctcttccagcaaaatggtgcgcattgcccagatggtcttgcataagctgagaaagaatagagaaggcaacgtgtggccactcacctagactctcatttgagctcccttgtcagtgctttatgaatgtggaggatgaaaagatatcccagcattctttgatgaattggttttaactctatatggagaccttcctgaatcccaagataatctaatctctatttccacagcccatgaacttatccttataacatctgaagttcaaattatttatttagaatttgtgtcctatactagaccttacatttcatgacaacacgagttgcctatcttgatcattgtcatatcttatgcacttagcatagtacttgacacataatggacattaaatacatatatgatgaatgaattcactagctgtatcactttgggcaggttacttaatctctcgaaacctaattccccatctgttcaatggtgataataatggtaaccatcttagaaagggttatatgaggtaacccacgagaagcttagaattgtgtcttttgttgttatcattgataataaataacgaacaatgaatcttccctctactttcaaaaagggaagtcatatagaccagtggtcccctttttggcaccaggaactggtttcgtggaagacaatttttccacagatggcgggtggggtgggaggtggttttgggataaaagtgttccatctcagattatcaggcattagattctcataaggggcatgcaacctctagatccctcaaatgcacagttcacaatagggttcaggtcctgtcctgtgagaatctaatgctgctgctcatctgacagaaggcggagcacagactgtgatgcttgctcacaggctctcacctcctgctgtgccacctggttcctaacaggccatggaccagtaccagtctgtctgcagcctgggggttggggacccctgttctagactactgtgtaaatttagttcgtgcataattcgtctaaacttattggtaatacatagatatttactgtcttctccatgactccaagaagtgttttaactttacagatgaaaaggtcctacaaggaaggtttcagtcgttcatatgtgtatatcagaaaaacaaaggtggctcatctctccacagtagtttcactggtgatattttcattgcaaattcctttttacaggtgtcaaaaatcatagtatgtgggaatgtctgcctctagtgaccttcaatgcactattaaaaaaagaagttttgttttggattgccaggattttaaccttcaaactagcctgtgtgtcatggatccctgcactagaaggcttttagaaaaacagataaactaaaaggaagctttacagactgaacatcagctacaggaagacctaggtgattcccaactctatacccaggtgccaggaaggttctaaaagtcagtaaacacagagaggccattctactacccctggcctgaggccccaaattctggtgaaaagttctgctgcccttgtagtatggagctttttaaagcaaaggcagaaatacttagaaaaagaaagaggatgagcataagatctaccttctcccaaagcagccttatcgaaagccttagtgagatggtttctaggatatagttggaacctgtctggactcacagctccctatgtatgttgaactcttagtccaagactctcttggatcttgaggtaactacagtaccataaaaaggactagatttggggaatggcatcagagccagagctttgccatctatgtagtcttgagcaagtcacttaatttattgtacttaaaatggacttaataagaaacacctgcaatgttctgctcagatttcattagatgggaaagtgctttttatatggctctaacctctaaccactgtagagtttttgttacatgcatttttaggtctatgtgcattttttcaaaatgaaattatataataccttattgttttattatttgactctttgattgacagtatatagtagataccattccctactgaagaatataacattttcattctatgtttttattttttatggcgcaatcatatggcattgtatgactttgtcaattcactacaaatatttattacttaattttgaacagttcagtttcttctttagaactgctgtttaatctactacagttcacatcaattgcatcaaatctctagtattctaattagaatgcaataccaactatgggaattaccaagcagctgtattttgggcatcttcaccaacatggttatagcaacagcgaggatttgttgagtgagtgcctaatatgtgctaggtattttacatatactgtaccttgtataaatctcccccaaactctccagctcattgtcattctgctcattttgcacttgaaggaactaaagctcatcaacatcaactaacttaatcgtagacatagagatgactaagtgacaaaactggaattcatctgtaggttatttgacttcaaaacgacataaactgtgtccactatatgaagcatcttgcttgatctcaaactcagcacatttggatttgatctcaatgtcttgcccttgtctcaaacatgtctccaccgtgtgccaccattttatgaatggtgccatcatctaccaagctcccctaactggtagcctttccttccaactgccctgagatgacctttgtgaatgttaattccccccagattgttaattctaatgaccagcttccattcttcaatttctcagcaccatttgacacaggcggtagatcgctcctccctctgaaatccttgtttcacttggcatccaggaccgcataggcccctggttttttttttttctagtccatccaggccacttcttctccatttgtctattgggtcctcctccattctacaacttctaaactgacccggggcacagtttttgggccttttttgtatatgtcccttcttccttggtgtcttcctctagtctatagccttccaacttacctaaacactggagaagtcatttatatttccagcctgaaattctcccagaatttgagtatattgaatgatatattcaacacctacctaggtctttgcaatctatcctaggcaaaaatgtcctgactccaacatataaattgtcttcccccttagtgaaaggagaggaaagcagtgaagctttgctgggcctattgatttggatgacacgtgttctctgaatcacctagagggattcattgattaattgagtcattaatgcaccgattcattcattcaaatattatttagtgactacatcatttgccaagtaccatgctaagaatctagataaaatgtttagggccaattatctaggaaataagttttctaaattaagtcaattcttaggaatcaccttttggttttcatactaaacagggaatggagtatttctgaatcattaattcccaaatcaacttttctaaaatatgcataatcgtttccaaaatggagatttatttagatgtcacacaagataattgcagctttgtaaacctaacctaagggaaattgagttttcattcagaaaccttatcttgattgcctagacatcacccagcatcctctgacgcctctgcttgatgtccttatgtcagcctgtcctcaggagagaaagaggaaacttcaccaaaatgaacaaggtctttcaccttctccctttaggttttaggaagaagctgtttatgaaagttgtcctccagtgcccattgggaacttgcaaaagatcagttactaccgatggacagtatgtctggtctttctctctttttccacatattaaattgtcattgtgtcaaatgtcttgccatcaaatacggtgctgcaaagaaattgcaattatatttatcagttttttttctctgacctttgaatttcattcagtccacagagaatccttctcggtggttcagagaacatgtgtcatccaaatcaatagagccaacaatctctgatttttctctccccctttcactgagggggagggcagttcatatattgaagtcagaaccttttaagcctggaatggatagcaaagacctacagctttagtgcatgtaatcttgcaatgcaataacctggtagtcacgcaatctggacctagtaacaggttaccacaattccatatggagttttctagtgttttcatcctgtctgcctagtattaattttgagtttctgtctctggaaaattttgtttagattttaaaatcttggtttttgttctctaatcattttctctcactataagattctgactgtcagaattaaatatgttataaaactaatgtttaaccgtagtctcattccctacgccctgccccctgccccgcaccaccccaatcacctagaatattttgaaggaagaaatgggtggtggataatagcagccaggttatctggcagcgcaacctcattttaatattagctaaagcagaaatagtcaagagggcaagtctgccatgaaaagtcttatgaaacattacaaagttaaatggaccactaaaaaacggtagacagaagagacagccaggtgctcaccaaaatcttacagttgaactttaaaagtcatatataatgagcaagattagatgcaaaatcagccataaaaataaactatttcccaagactcaaggctaaagtgcacctaaatcttatttattagcatgactgaactagcagcacagtaaatcgtaattgcatgtgtcagtcacgtggtgtttattaggccttttctgattttgagtgacaaaatacacacaaactcatctcttctatccaccatgttgactctgttctcagacaggtgtcatcctcattaccacaaaatggctgcagcagctctagacattaaatattcagatattcaattccagaaggacagagtgagaatcattttccagaaagtcccaggaaaagtctcattgtagcttactgactctgattgagtcgtataattatccctaactaatcactatagccagaagacatgaaatgctgggattaatttaagcctgggccctgtgcttcatgccaacatttagtagtggagcctactaatatctcatggcagaggctgaaagagggataggtttttaagtggctattattggatatagtgctaatggacgctggacacaactgtttgaacaagaaggaatggtcaaaagtgacagatattgtgaagaaattggaacccttttgcacagctagtggggatgtaaaatgattcagcatcaacatcatgacatgtcctcaaaaaaattaaaagtagaattaccatatgattgaacaattccacttgtagagattactccagaattaaaagcaaggactcagctagatatttgtacatccatgttcattgcagcattatgcataataatcaaaaagtggaaacagcccaaatgtctattgatagaagaataaataaacaaactggggtatacagtggaatattttccagccttaactaggaatgaaattctaacacatgctgccatatggatgaaccttgaaaacatcatgttaaatgaaataaactggacacaaaaggacaaatattgcataattgcacttatatgaagtacctagaataggcaaatggatagagacagaaagtaggataatggttacaaggtgatgggaagggggtaatgggaagtcattgtttagatgggtaaagagtttgctagagatgatgaaaaagttctgaagatggatggtggtgacagttgcacaacagtgtgactgtacttaatgccactgaattcaacacttaaaaataattaaaatggcattttttatgttatatatatattttaccacagtaaaaaagatataaaaaatggaaaataggcaaagacaaaaatcaaaggggcaatatatactcccatctaagttaataaatgatgggaatgttacttcttttttatttttaataggtaaatgatgctaattttatttcttatttttaattatttaattgataaaaattaaatattcaaggtgtacaacatgacttgtgtatatattatataatgattaccacaatcaaattaattaatgcatccatcaccagattgtacattagacccccggaattgttcatcttataactgcaattttatactctttaaccaacatcttcctatttatttcccctacctccagagcccctagcaaccatggctctactttctgcttctacgagctctacttttttagatttcacatgtaagtgacattatacactatttgtctttctgtgcctggtttatttcacttagcataacatcctccaggttcatccttgttgctgcaatggcaggatttctttctttttaaggctgagtaatagtccgctgtacatatttactagtttctttatccattaatcccgtgatggacacttgggttgtttctatatcttggctattgtgaataatgctctgatgaatatgggagtgcagatagctcttcaacatactaatttcattttctttggatatatacgcagaagtgggattgctggattatatggtagttctaatttaaatttttttttgaacaaccgtactattttccacaatggttataccaatttacattcctatcagcagtgtacaagtgttgccttttttccacaccctagtcaatgcttgttgtctcttgtctttttcatagtagtcattcttagcggtgtgagaagatatcttattgtggttttggtttgcatttctctgatgattagtgatactgagcaccttttcatatgcctttggccatttacatgtcttctttttttatttcaactttattttggattcagagagtacatgttcaggtttgtaacatgggtatattgtgtgatggtgaggcttggactacagatgaccccgtcacgcatgtagtgagcatagcacctaataggtagtttttcagctcacatcccctccccaccttccccactctaacagttcccagcatctgtttttctcattctatgtccatgtgtactcaatgtttagctcccactaataagaacatgtggtgttttgttttctatttctgtgttagtttgcttaggataatggtctcccactgcctctatattgtgacaaaggacacgattttgttcttttatatgccgcatagtattccatggtgtatatgtgttgcattttctctatccagtacaccatcagtgggcactcaggttgattccatgtctttgctattgtaaatagtgctgcgatgaacgtaaagtgcatatgtctttttggtagaaccatttatttttctttgggtatatattcagtaatgggattcctgggttgactggtagttctaagagccactgtgactggccttttgatgatattttgatttgtctaatggatttctaatttagtatttctctgatgggaggctgttgcattttaaatggatgtttccacatattgcaagactgtagcatctctaggcccaggcattcctagtcattctgacaaacagaaaatctccatgcttcccaaacgtgctgtaagaagcattgttgcctccaattaagaaacactggtttatgaggaaagaaagtgccagttaaactggctgaatggcagttttatttcatatggtacattaataagtgagcaccccattttatatactagtttctcattagttcttatatattttaagtaatcaaaatgacccaggcaaggtaagttctgaaccttcagggtgaggcctagatattggaccatggaaattcactggcataactcagtttattgaattctcatggcagcccaaccagcaccttgcctgctacctttgtaatgtgcttcttctaaatgttagcataaacaatctgcatttttttgaattatcccggtgattgcttccctggtgcaactatgattaaaaataagacagataagttctaccccaagtagcttacaaaatgtaagcattataatacaatacagaaagcaagaatccccttaagtagcagtaaaatcacaggctgcaagaatgcagggcaggcagaaagacttccagctgcaggaagcagagacagcttcataaaagaggcaacacttaagaggttcttacgtaataagtaagcagtacatttgtagaaaggttggagaggggtattctgggtatgctatgagtaatccagggaactaatgctcaacctaggaagtctagattttatgaacttatggatccctttataactccagagcaactgacagaaagatggaatagcattccattggctagttgtcttgcccaaataacttgtttgacaaaaaccgtgcctccagggaacagaagggtcagtagtcatttgagtatctgcatatatacaaagacacatatacaatgagaacaactgaggcagaaattgaaagcaaagctctcagtgtctatgtcagagcctttccccagacggtgctaagtaaaatatgtaagcacttaaggttagctataaactattcctttgggcaaggaaataaatattattacaggaaactacagcaattttttgacatcaggaaaagaatatagtcctgcaaagtccttttaggtcaaggaaattagcttctaggggaaaatatatttaaaaacaaagagtcagataatgttttcagagcaagttttcagaaggcagtctatttccagtttatgctatctatagagcgtctgtgtaaagctctttaaaaatgtaaacacctaattgcatttcagtatgataagaccataaagtctttaagtctccacaggtatttatgagttcttggtcataactttgaaagcccttttcataattatgcctatcaacatattgtgaaaaaaaatcattgaggagcttacccttggctttagaaatagtatataccatctaattattattttaatataaattatttccttaccattagattaatatctagcccagagcacatgtaattgagaaatctgtttttttatttttagaatcatactaaatttttaagtgactgatttttcaaaaaaaaaaatcttctactcatcagaaacagtttgggatctgtaaaaatcccctagtttattccagacgtaaatttccccaaagacttttagcacctattaagtttttgtctccctaggtatgagagtttgctgtcagttaagaggaaatttataagaaaatgttaaaaccagcttaaataactttctagttctatttaatgttggtacaacttcaatgaaaacatttcaagtcagcatttcaaattcagctgccaagactcaggtaatatttcctggactcaatcatatgggcatgaaacactgcagttctatcttcaaagtcctttgaaatctgtctcatgatatctttagaagaaaatattccaaaatgaaatgaagaacttcattttcagctgaattttcttaacgtctgtcaccttcttaggtgtgggttctgaattttaaatattcctctttttgaacctgtggagattgtaaaaggctacatccctagtgaaaattggtttgagataattccctggaaaacttttgtcaaggtgtacagttgtcactttggttcatgttagaaccaggagaatgtaatatgtaataatgactaatgcccctttaaaagagcatttctctcttttcttgtctgcagatatttctcatgtctataggtaccgcacgggcaagagccatactttagataaatacaggttttgagtttttttgttttttgttttttgtttttggttaatatactgtctctctcaaaatcaaaaataaaagctaaacacttgaggctgcttataatacaagttatatataataggcctgttaaaataaaacatttagacctgtagaagaaggggaatgtgtactttaataatgacttagttagtattattagtgttttgagtttcctaggattctgagccaaaagagaaatcggcaagctgttaaataaagttcattatatgaaaaacggtgttgaagagagacaactttctcctgactttaaattatacattaaatgtgttagttgaatccaggggcaggttgattgcagtaatggcccctgctttgcacatgtcctgcgtcatgtcctttggtagtgccttcccactttcactcttgacttggccagactgcttgctttggccaatgaaatggtagtagaatggatgcaagcaaatgattttgaaagtccttgcacattggagcctaccccttgcggcttttcaaatcgtttcgctaccatgcgaacaagataaaggcctattgtgccgggcgcggtgactcacgcctgtaatcccagcactttgggaggccgaggcgggtggatcacgaggtcaggagatcgagaccatcctggctaacacggtgaaaccccgtctctactaaaaatacaaaaaattagccgggcgtggtgatgggcgcctgtagtcccagctactcgggaggctgaggcaggagaatggcgtgaacccgggaggcggagcttgcagtgagccgagattggaccactgcactccagcctgggcgacagaacgagactccatctcacaaaaaaaaaaaaaaaaaaaggcctactgaatattgaatgaagaggagacaatggcctagtccccctcatcaccccagccaacacctagctgaaacatagactcaagagcaatgaaaagtcttgttattttaagcaactgagtttgggggttgtatgttatgtggtgatagctaactgatacagatatttagacaagggatatctgctaatataatggacagtgtcttgtacagtagtttttcagcaactgttgaaaaactataggactgtctccttatagcaaatgacaacccttgagagcataccttacataaaaataaagatatttttattttcctcactgcctgttatatcaaatgttgttaaatccctgctagagacaacatacccacctctgaaccagaccaccttgttattagaagagagccatcctttgaagtcacacacaacaacactgcttaatggctagggaaacaaaggctattattaatctaaaatgctttaaacagggcttagagagaatgaaataagcagactggagtttagccatggtgcaatgctttgagggcgaaaacaaagccatccatttagataagctttgaaaaacactgtgtagaggggaattcttctagaaagtgtgtcttaacttctacaatccatttgatactcaaaatttttgtgttcctgctttcagtggcacttcctataaaaatccattgccttttccttcttcatcaaagtctttttaagcttggggaaaatagacttgtcaaaaacatgtcaaagacaattacatttgaaattttaagtcatatgaaagatgtaatttgaaccccaagacttatagactctctggacctcaaaaattatttaggtcaaccctatatgatttttgaattccctccaggaaaaacctaacttatctggatctcttctgccaaagacactcccagtaatagaaacttctgtggagaattatgccccttagggaatttttatgtaataaaatgtttatccctagatagagccattcacttttaagccagacgcctggtgcagcacaggaaatcccaggtttcctttctgccacactcttccgaatattcaaagacagcagctcttctgtccccaggttcaccaaagtcatttctttgttcaccaggctaaatgtgtcagcattcttgggttgcagttaaccaaaataactctagctaactcaagcaaacaggaattttattggaaggatatgagggacttagaaaacccctggaagaagcagttttgaaactaaatgaatctaaggtgtccctctgggattaggaaacaggaaaggcagaagctgtatatttacaggaatagtttgatcagggtgcccctgctgagttcatcaggttctttgtcctgctgttccaggaggaaggagttatgtatgactattgtagctttggttgtaagacacagggaaagggagggcctctgaccacagccttaccagattgaatccagtgagaacagctatcctcaaaagaacatatgagtactatgaaaacgggaaaatggatactgagtaggcgaaaacaacaacaattaaaataatgttgaacaccattctttcatcttcatgtgaagtggctttgagtcccatccgtcttgttcctgtgaatcatccagtgtccttagctgccctcttagttggtgttaattttttcaatgaccctctcaaatggtggtgccttgtagctctagctgcagtttgatcagcgcagagtagaatggggttatcccctcccgcattctggatgccgtatatctattaatgctgcccaggattatgttcatgtttttggcactctcatctgcccatcgagtcagactgagtttaaagtcacctaaaacctagtaattaattttctcaccgtttctctagtctatgccacatctgcccccatcattatcatatctcttcctgtgcctagaatgcactcttctactttctgttattgcctagttaacacttccttttccttcagacctcgctcgtattacctcttactgagactcaatttcccttttatagatatttataatactatacacttttcctttacagtacctcatatgatataatttcacatttatgaatgtgattatttggcgtcaagatggtctagaaagaaaatctaaatttcttattacatgatctagcccaaaccttagcagccaatctcatttcttaccactccactcacccatcccactggcctttctgttccaggaaaacacaaatcctgctgtttccttagggcctttgcacttgatgttctctctcattccccattctttgtctgaccactacttatcatcgattagatcttagctcaagtaatacaaagagaggccttccatgtttaacctaaagaaattccatcatcttttgtgcccccaacacacaccaaaagtccatttctatcataagactgtccatattttcttcttagcacatattactgcactaacttatcacattcatatttgctttatttgctttattgttagtctctccttccactgaaatgtgagatccttaagagtaatggcattatttgtcttatttattgttggatacctaattcccagaagagtgcagggcccacagtggatgctcaggaagtatttgttgaattagtgaattgaagaatggtcataaacagaataaattgtcttttccaatagagtttaagtttcatgaagggagcaaccgtatcagttttgttcactattgcatctttagtacattgcctgacacatagtaggttcttattacaaatatgtttcatgaatgcaataccatatttgcactattagtgtttttgagcattcatagggacatttatatttcagggatatttatgttcagacctgactgatacacaatatgtgagcttttcctctcaattccctatcatgaggaaaagaaattggcatcttatctctacctccacccaaagtaatcggcaatttcattggagaaatttttagccaccactgagactagttctgcataagaaaattagactgagatctagcaatttactagggccatcagtttaattatgaatatccaatgtgagtaaatcagacttcaaatgatacatgtttttcaccaaattgcttagtaactctgtcaactcttccattcattgatctctaaaattggaagacttgaggtgaaattccagtctcctaatgtgtagttcagtgtttctctgactttgggagcatataaatcacctaagaaccttaataaaatgcagaatctgattcagaaagtttgggatggggcctgagattgtgtgtttcttataagctcccatatgtgacatagctgctgacctcaaaccaaactttaagtaaggaactagataaccctggataataatagcaaacaccagttgtaagcaagtgtagcactttgtagttttcaaagaacttatttgtaaattaatttttaaaaatccctacaaagacacaattattcaggtatagatgaggaaactgaagttgagaaaactgacacctttaattgaagtcgcacaactagaaatttaaccaagtttctccttccacaactgcagttgtttccccttcacatcatctgtctggaccacattcacccactcattcacagtaaatttaattatgcttccatcgtgccctactcgaggggttgaagatacagcagtgaatgagaaaaagatcttaccaggttttctgatgtgtaaatggaatgattggcccttcccaactccagtggtctgtgattctattacggtgtgccatgtttaaaaaatgaaattatagaattaaggcattatcttaggtatcattttctacctctgtgctctcagaatcaataaacttaaattcagctgatcatcaccgtcatacaaaacttcctcccacattctttgtctcattgcagacaagcatatcggagccaaatttcacgctatccaatcaataattaattctcctcctaactgttcctcctaaattgtattgttttgtgctcctcctggccactgctgccctagttcaggttttctcttgtctagtctggcagtgtctagaagcactttctctggtgatggaaatattctatgtctgtgctaatgcaatacagtagccacttgccgtatgtgggtattgagcacttgaaaggtgaccaacgcaactgaggaagagaaattttaattttccttaattttaacgttaagtttaagtagccacatttgcttagccatctcttggacagcatgtgcctggatccttgcaggaacttttctgcctggtttccgctggcttcttcttatatctaaattgattttcctcattcattcaccagcatgatctttccaaaatgtaaatctgatgatatcactcccatgccttaagttcttatcctgggataaagtctttgcttcctatgtgactggcaagggtctttgtgacctgacccctttctgaacccaccagccccgctttctgcctcacagttaatgctctgacaatgagctaccaccttttctgcatgtcgtcccctgtatgtatctaactcctacatatcccttaagaatcagttcatctccatgaaaaattatcattgattcatccccacccaggacctctactatgttttcaggatactctatagatacatatatcatttcagggaaccacattattttatctgtctcatatttattggtggtgatagtggaaattcaccagactgtgaatttcctaaagggaagggttatttccaattcatctttattgactgagacactaccataggtagtgagcactactagccattgaatgaatgggagatgaaaagaaggagagatggaagaaaggaaagggggattaaaccagctagtatcaaattttaaaaataaatattggctgttaactgttcgggaatctcaatttttcagttaactttatttttttttacagttgatagctagtataaatctcagttagacatatttggatttttggaggactagtggataggtttcctataaacaattgatcatttgaatttagtttcagttgtacaaaataaaaggcattcaggcactgaaagacaaattttgcacgttctcacccacatgtagaagctaaaaattaaaacaattgaactcgtggagacagaaagtagaataacaattaccagaaggagggaggggtggaaaaggggtgatagttaatggatacgaaaatgtagttagacaggatgaagaaaatctatcattcaataacacaatggggtgactataatcaacaataatttattgtatattttgaaataactaaaagcacaaaatttgaatgttcctaatacaaagaaatgataaatgaggttatggataccccacttaccctgatgggatcattacacattatatgcctgtatcaaaatgtcacatgtatcccataaatatatatgcctattatgtacccatagtaattaaatatacatttttaatgaagaaagaataaataaaaggcattgtatcttctctacatagacagattattttaatcagccaaattatatttccttttgctaaaatgtctgagctttgactatattgactggtggacttttaaagccagaagacactaagttcagccatattgtaactgctcaatgggttcaccctgcctgctgcctagacagagcagatttatcaagacaggggaattgcaatagagaaagtataattcactcagagctggctatgtaggagacaggagttttactattactcaaatcattctccctgagcattgggggatcagagtttttaaggataatttggtgggttggtggggagcagggggcagtgagtcaggagttctgattggttgagttggagatgaacacataggaagtcgtagctgtcttcttgcactgagtcagttcctgggtgggggctgtaaaatcagatgagccagtttattgatctgggtggacccagctgatccactgagtacagggtgtgcaaaatatctcaagcactggtcttagattttacaatagtgatattatccccaagagcagtttggggagggaagaatcttgtagcctctggcctcacgactcctaaaccataatttctaatcttttggctaatttgttagcctacaaattagctggggtctaatccccaggcaagaatggggtttcttatgggaaagggctgttattgtctttgttttaaactataaactataaactgagttcctcccaaacttagtttccatcccaatgcccaggagtgaacaaggacagcttggaggttagaagcaagatggagctgtttaggtcagatcgcttttcactgtctcagttataattttgcaatggcagtttccatatcatttttcagaggaaaaaactatacaacttacccatgattaatcagtaagttagtggtgaattcagtagaaactggtgtgtatatgaacacattcttgaagtctaaatctggaaagaaaggcattttgtttttcaaatacctacttcagaggagttttgtttgcttttttttttttttttaatgacaatgattttggttgagattttacttaaaacaaaagttacaaagttgtgccgcctttggtacttcatgctgtgccagttaacagtggggtgggtcatctgtctatgaaccatgaccattttcagttgaaagttagggaagtctgccttatctcaaaagcccttgccttcaggcttctgttcagatggtatcagctggaacaaataagctgagattgcatttgctgttttttgtgctaatctcaagaacattccaaaaatggtttgtcagcagctgaactgagcacagaatctgtgggcatgaccatatttctcctcacaagaaaaatcactttttaagtttcttggaagttgattacaatgtgctttttgctccctcttcaaaagtaagataagtatcggaatctgtcattttctgctttggatgtatgcctaaacagccaaagaagcgcatcaaaaccaaggaaaaaaatgtggaaaggccaacctaaatgtatatagggtatagtccatccacagactatagctacacagacaaagtgaggtgaagaacttggcagttatctgagggattttcccagtttggttgatgcactcgaccatccagagttcctcttgttaagtaactttttgtctgaattttctgaaaaacagaaatagcactaaagatgaatcctgaactctgaataattgtattgtaagtcagaaaaaactttttgtgatcagccactaaaagggaagtcacaagaagagtccaccactactaccaccaccaccaccaccagagcaaacttgtttacagcctctctgagtcattactgtgctaggttttgaacacagagagcaaaaggactatattgcatgagcttatagactggtgaggagacaaacaaggaggtggacagttataatcaggatgggcacccatgttgacccccttcttctggtgtttcagccatttgatgcatcatctatggacacacagatgtttcctctgtatacactgtctcacaagtgacactgtgtattcatcaccactcttcaggttgcaaatgactgaaatccaacccaaactggcttatgaggcatttttgacaactttattgaagtataatttacattccataaaattcactcattttaagtgtacaacgcaatgatttttagtaaattgtactaagttttgcaactatcaccatcatctcattctacattattttcataatatttcaaagggaatctgctgactcacgtatctgaaaatttcagggtttgctgtatgtgctaagggaatatcatcaagacttcatttttgttggtttcattcttagccaatctattccctggtgaaacgacaaatgacccctagcggattatctaccaccttagtaaccccagcagaaaacatatacctcttttccagttgttggaacaaatgtcttaggatgacacacatttatcctgattggtctaggctaggtcaggtgtccactcctgaaccaatcgctttaaccaggagtgtgtgatgctctatctttggccatgtctgtgtcacatgaacaccccagcagccagagaatggtgttacagccacccaaagtacatggtctgaaagtggggagacatgatttcccaaaggaaaattgggattattattattattattattattcctagacaaagagaaatggatgctgtgcaggcaatacagtagatgtccaatccacaggaaaattgtgatcagagtgacgttgcttcttcccttttgaatcccctgtagtggttatcacacagccttttatatagcaagtactcaaaaaatatctgtggattggtcatggacaggctaaaacatagaacagaccaacaatgacagacttttactttcttattttattgttggggaaggctaaaaaattaggagtatgatttcaattattaaagctaataaactggggcttatctgagaggccacatgggagcatgatggtcagagagcggctggatgtgtgtcagaactcaaaagcagattgcagtcagactcttcccctgtgtaggcattgagtacgtagatatatacacccacacacacagacagttgacccttgaacaactaaggggttaggagtaccaaccctctgcacagaaagaaattcacatataacttttgactccccaaaaccttaactatcaatagcatactgtttttgttgttgttgttgtttgttgttgttgttttaagagagacagtcttgctctgtcgcccaggctggagtgcagcagcagcataatcgtagctcattttaacctctaactcctgggctcaagcaatcctctagcctcaccttcccaagtaattgggactacaagtgcatgcccccacacccggccgattctttcatattttttgtagaaacagggcctagctatgttgcccaagctagtctcaaactcctaggatcgagtgatcttactgcctcagcttcccaaagcactaggattataggcatgagccactgcacgtggactaataggctactattgactagaatgccttaatgataacacagtttataaacacttttttttttaattgagacagttttactctgttgcccatgctagagtggtgcagtggcttgattccagctcactgcagcctcgacctgctgggctcaagcaatcctgccacctcagcctcccgggtggttgggactacaggcgcacatcactacacctggctaatttttgtattttttgcatagatggggtttcacaatgtgcccaggctggtctcaaacacctgggctcaactaatccacccacctcagtctctcaaagtgctgcgattgcaagcatgaaccaccatgcccagccaattaacacatattttgtatgttatatggatcatgtactgtattctttattattttttttgagaccgattctcactctgttgcccaggctggagtgcagtggcgtgatcccagctcactgcaacctccgcctcctgggttcaagtgattctcctgactcagccccccgagtagctgagattacaggtgcccgccaccatgcccagttaattttgcatttttcataaagacagggtttcaccatgttagccaggctggtctcaaactcctgacctcaggtgatctgcccatctcggcctcccaaagtgctgggattacaggcctgagccagcacacccagcctacgctgtattcttacaataaagaaaataaaatgttattaagaaaattataaggaagagaagaatatattgactgtttattaagtggaagtgcatcatcatacaggtccttatcctcatcctcttcaagttgagtaggctgaggtggaagaaaatgtgtgtattagtggacttgcacagttcagacccgtgtatttcaatcccgtgttgttcaagggtcaactgtatatctatctatctatatctatatctgtctgtctgtctgtctatctatctatctatctatatatatatatatttggcctttcttattgctctttcatcagaagagtaatgctagtgaatgatctggaattcagtggtataccataagctggcaagaaacctggcaaattgtaatttatattcacaaaacatttttttcaaactatgcaaatctttacatctaacagaaaaacaataagcagaattctagaacctttggaataaataattcagtaccaatagatacattaaagtatattgtttatagaaaggatcagagttgaaaattgttaaggaacaacctgtattttaaaagtaaattttataccatttttcctaaaaggaatatggttcacagcaaatttcagatccataaaaactttatcttctagtgacttttaagattctctttcttgacaggaacttcaagaatggcaagatatttctttcttccacttaactgcaatgtgactatgaagatgctgtaaacatttgcaaattaggttgtaaatagcagcaatgaaagcattaactctcatagccacattttcggaagtgcactttacattatgtggagataggtattaagaaataaacctgaatgcttatataaaaattatgctggagataggtattcagaaataaacctgaatgcttatataaaaatccagcctcctattttccaagcacagtggtataattacagctctaatttatggcatactttgtaggattgctgattaattatacagacctcctgatgttttatattcttttcaactttgtttccctctgctatgtgaccactacaaagcgagtatccctaaatcacttattattcaggttacctaatttttaaaaagtgaatttgctattaacatcattttcttatatagcactgtaacatttatatgttaaaaattattgtactccttaatgttgcagctaactcatacacacacagacacatacactcactcctacacatacacatacagacacacacactcaaagattttaataaattcccgatatttacccaatgtagacatgtctaacagttctgcatgacttgatctgaaatattgaacacttcaacagtgcaacaaagcatgattcgttagggataatactaaccaatctcatttttaaactgattatagggatccaatttgaataatttgctgctgtggattatttggaaacagttgtagcacattttgtttgttgctcgaggttatcagtgttttcagaacactatcttcctttcatagttcttttgagtttaatagttatacaaaagccccatttaccagatttttcaataaatgtagtgtgctgatgattacaggaggatttgccagaaaactcctttacatatacatagtgcaatatcttcagatattatcctcttctttgctttaagtaggtcaggttcacaatgagctgttctccttaaacccctccccttcatatccttatcaaattccctttatcactgtcacatctaaattactatcttctgctttgccaccaagacatttttaatagtaagagcttcctgctcctttcttaagctcttctctttttcggtcatcaacttccccttggaattaggaaaaggcccttgtagatttgggctattaaataggagaggacccatgtatcaagtccttaaatgttctgtcatcatgagaattatttattggaacccattacctgtgcgacttcacagttctttttagatggtttgtctgaaaagaataaaggctcttcgttgaaatgaaatcgctttctttgctacctagggaagaaaatagttgagtctaattatttagaaacgagaggaggattgctgtaaggacttgagtcgatcatggaagtttctcctatgcaaaacagatctgaaggtacagaaaacataaaaataatatccctgggaagagaacacccaggtattaacttaagcacatagcaggctttattgagttttacagaaaaagtaaatacagctgacacaacctcgagactaaaatttttggtgacatctctgtttatcccagacactgatttctctattcagttttgtgatgtggagagtattccgaaggcctgaaagtgttcaaaaccattgtgcatagcttcattttgggggagaatgttataatttgcttctgaaaactaagtaatctctgacctctacccacacatcaagaaaggttagaaatcagtcctaatcccaggaattgtcatcaatgtctctaaaattctaaagactgaatgaattttaatccaataatcaacatatttaatgtgtgcctgtttgtatataaaggactgtataaaatgaaagggagacagagagatggatacgacctgggatttgagttctggaaatcatttgagtaaatggggtgatgatatattgaggaagtgtaacatcaatgccatgtgaatagattgggcagctttggaaggtcatgaattggccattatgcgatttgcccaacacagtttatacttattcataccattgtaagaggaagttgatcatgggagaaaggttgaaatagatgtgtgtttcacaaggtacaagattggcacttctccaagtactcagatcatcttggatggtacacagtatacagacattaaaaagcactgagcaacatagttctcttacactccttctgagaatatcaaggggaaactcatggttggtcctagcatatctgaacacttttgaaatcctgagtaatccctcttttactgaaacaaaaaaagtagttcctaggctgagaatcctgggagacaagtttacctagctggaatataataccttaggtgggtttttatcacatttatttttatgattaccactatttatggcaagtagatactggtttccatgtatcatagcaacaagtttcctttattctttaattttgaactttgaaacatttaaaaaatattgtgactattggttattagaatgatactgaaaataataacagaaatgatctttgcagctaacaatgaccagctgtttaccatgcaccatcacaggcttaaatgtttcatgggaatttttacatttaaccttctcacaaaaaacctatgaaattcaggtgcttgttaattatgacccccattttagagatggcagtctggagcccagaggggttgagactcccaagtcacacgtctagcagataaagaggcaaagatttaggctgtcttgtagtacatcaatgtggccgaaatggagagacgtcagttcaggaaagcttagaatggatgactgttggtgatgctgagtttctgtgcttcccagaaggcaaagatgcagctgttttagggacagggagagaccttggggattttaactggaccgtgacagtggtgttctatcatgatagtgaatgagctagtagattccactttcattttctctcttagaaatattatgaagttctggtattaggggttaaagcaaataaagcatgatcctgccatcaccaaagagttgcaaattggatgcataataaaattaaaacattttttgtttctggcatggccaatattgctatttgtcttatagaaacctcttctcattactaaattatatattctgtatagtgggcccccctttctaattaataattaatattgtcttccaggcattttagttaccaagtggtaaaggaagcttctgtgatttcaacttcaagttatttttcacatattctttacttttgcttctgctttcagacacattaatagggacacatatttctcaatattaggaaaagctatttcaacaagtaaaattagaaagcaaacagaaaaaaaaaagaactatttaattataaccaaagatctaatggtaaatttaaagaaaatctcttaaatgtggttacattttttacttcttgttttatttctttcctacaccctccaacactgcaggatagcatggtaggaagggtacaggctctctagtgagccctgagctcaaaactccactctatttcttgtaaatgacattgactttggatgttttaatttactcctctggatttcatttttcttaactgaaaaatcaggataatgatactcctcagaattgtgcagattaaatgagataatcaatgcaagcagccaacagcacccaataggatgttgtaagtgcttaataaacttcttaagcatctccatgcgcccaatactcaacttagtatatttacagtttttcttctgggtctcttggtccatttctgtccacgtcttctttatttctaattatttctagagacagctgcactttgttattaaactattcttttacaagctactctgctgttctgattttgttatataaagcttcctgagtgctttatatattttaatgtttttttctcattataaaagttatattacttattatgatgctttggtaaaagtatatggaagtatagaaaataacaaataatattgctttaaataatattactttcctgtccttacccccattcatcctcacaatgccttatggaattatgttgaaattgtctcaggtcctaaattctcagaagaaaggaattctaaatcttatattagtggaaacatggagatcttgcatcaatgaaatatagcaatttaagaaacaaattttaggcaaaatgacatccaaacatgtcctttactttatttccttttcccaaagacatggtgtttctagtgttatatgcttaccatgtgaataaataaaatcacaaaattttaccagcccaagaaaagcatttctcatgttcatcatgcactgtgtcacgaagaacaattaaaattaactctgtgatctttaatactcatccagccccaggcagagagttattgccaggttattttaaagggctttcaaactgttgttcagaggaagttaaacctgaatcaaaccaggttaaacaaacacaagtttattttctcttttgagcaatgctgcagacaagggcaatagggtctgaacgcagcttgttcttcaggtggcctgaaatgcacaggttgttcagcagtttattaaacccaaatcttacaacagaaagcaaattatctctaagggaactttgtcaccagggtgtctgttcaatagtgatgtctattgccaccacagagactacacggaaaggtcaatgacaggtttgcctgaaattaccccgggaggaggtgtcttcctattgacctacattaaatttgttatccaaaatacctttttttccttaagatggggagcaaagccatcttctagaggtctcaattgactctttgtaaattgcaattaccacaaaacaatctttctttctataattcaaaataattaattccttcccatcatgctgagaatttccacgtatcttttgaaatcaagtatgtaagcttgggcaaatttcagctaaaagttaaaataccttttgaattttatgaaaagagataggcaaggaaattcaaaccaaaacaagtctttttttttttttcttttcagagaaaagtcttggtgttatttgctatcaggtaggtctatagcatacagcctacccatgccaattaatctgccaggcttttctaatttctcaactggcacaaagccagagacccctgtactgtatccgtatgtcagctcttgcagtcacaggctaattctcctgttgataggttgaatatatgaatctttatctctgtctcttcattgtcacctctctactccttctacattgtgactatttcttgggcattgtattccaaaattatgctgtattgcttttgcctcaagggcaagtaaagacaatgcctttctcataagcagttcagctttcaggcagaacagcttagaataccataggttgccattttggtgtagatcctcctctgtcttattttggttataattttaataccaaagtaaatatttatcacttggccagagtaacaagaaaaagatcaaatgagagatgtagtttaatccaaccaacaaactgggttaattacagaagaaattaaaattgcaggcaggccctaatcttttttttcctactggacttttattctttgatacattacccattaccacccccaaactgtcttttatactcctcatttgattgttattatatcaccgagagagcaataattgcaagtctctgttagctgctgttggggaaaaggccaagccttctacaggctggaaggaggctgagcagtgggcatgggaggtggtgccaggcccacaaaagcagaacccctcctgcgtatcacttcctctgcccctcgtctaagggcttcaaacaaggtctaacagccctggggggtttcctctcttgatacccgttatgggttaaacagtttccctataaaaatcatattcacctagaatctcaaaatgtgaccttatttgggccctttgcagatgtaatcaagttaagatgagatcatactggattgcataggccctaatccaatgactgatgtccttatgtaaggagagggaaatttggatacagagggaagacaatgtaaagagacacacatccgcaccatgtgacgatggaggcagagattggagtgatgcctctgcaagacaaggaacaccaaaaaacaaaagggccaacagccgccagaagctgggagtgaaccaaagggtttctcccgcagagcctccagcagcaaccaacctggccaataccttcatgtcagactgccatcctccaccactgccagagtatagatctttattgttgtaaagcgcctagtttgtggtgtgttgctatggcagccataggaaactactaccacaccacacccatcgtcccctcccactgcattgctctgttctctctgtccagtatgtcttgagtggaaacattgaagaggggatagatcgtggcctcataaccacaggctaccctaaatcccggccccatgtactcaggcacatgctgctactggtttaaagtcagggttcacagtctcaaaggcctgcaggggcctggtaggaacattaaagagaggttcaagccaggcatagacgggagctagaaaacccaccatctgctcaagagggctgctgcccgtctcctccagcctattggtgccctaaggggatatgttgccagtattgccctatcttcccatatgtcacaattagccaggaatgggcttttatatgaaatcatacaattattagattgttattttaattgtgtagaaaaagcaagctcatctgtggctgtgaagttcctctggtctattaatgacaggctcgctgacacgtgcccaattctgtcctgccttgtgatgtacgtgagacctttggttgggggatgcctgtctaaccgccctcattctagggcatcgctgatggcccctggggtcagcagtcttcctttcctggagccaggcctcctgtgacagctctgccatcctcccctctgccatcctcccagtttgcttaagctgagaagtagtcttaccgaaatataagttagtcgctcaccccttgcagagttcaattaactggagtgaggtctggtataaagaaagcgatttattccaaagctagcttggggaaagaaatacagatgtcctgccttaagtataccacttcacttttggaacagaaaacgggtacttttcaaaggtagaggaggaagcaagcaaaacgtgatagctctggtggcttatctacgaggtgttcgagcttgtgactgccggcacctttgtggacaggactaggctgcaaacttaccaggtgggaaggagtttcctatctcttgaggcagtcacctggtaggagggagttttataaaattgaggcagcctcctggtgggggaaagtttctttctggggcgcctaagcacatagttagatgaacttgcccggtagggagtgtctggtgaaggggaggtaaaaggctatatttgcatttctaaagggctatgtaggaagtggggaaccaggggaatgagaagagaaaagagagagaaaaaaataattaaaccatcttagaaaaatggggctacttggtgacagtagcagtaattattttaactatgtttgggattctgtaataaattttagctcttcaggagtttagcctccctcgtaatgtgtaaatctattgtttcactttcaggctttcagctttcaaacacgttttctggaaccaatcatgtataaaagagagtagaagccttttaaggccctttgagttttttttttttttaattgcacataattttaagtgagctattttattcttgatctaacaataataaagatgatttaaaatttaacataacagtttgtcacttttttgtgtattttgtttgtttgttgaaaggaaatgatcactccataatttctttctttgcagaaggagagaagtggttttctaagttgtattctgaagggatttatttctaaggaagtgtttcagtgtgacttaaaggcaagcaaggatacgctgtctccctctacagcagttaggcttcctgctgaactgctcagaaaaatcataggtctccattttgggataatcctcctcttttgggtgatagagtgaagttggcagctttcatcatgtgttactaaagacccccccaaaagaaaagatcagcatttttaaaggtcctgtgtccccagactggttttgatttataggactgacaatgtcaacttttcaatggctgcaactcagagcctcatgtgaagaaagatagattcaatttatctcctgagtccagatttgttcctatcctctgtggatccaaaatctccaaatgacagtgagggaacaactgcttctctatgctctaggtaatttactgtgttgtgaattagatgacctcttttcatgtagggaaaattaagtcttgtgtcatgtctgtatttgtactacttgctgctttatcacctttggcttttctctgttgccaccaataatttaaaaagggccacaggtaggtcaggactaacctgttctaagccaagaacagatttacattttcaattcttttcatcttactccatcactattcataagtattaggaggagctcaaagttcactatcaccctaatagctacaagtcagtcagtagtctaaattgaggaaaccaagatgagatggaccataaaggaaactttgaaatctcatccagaaacaaacatgaaaataaagctattaaagcggcgctgttgtctgaggtaatacccgacgtttgacatctcatgccaagaaaattaaggacacgggcacacacaaggagtgagtttagagccgaagtttaataggcaaaagaaagagaaagaacagctccctctcctgcaagagagaggaacattcaaatgggacttccggcttgtgttggagtacaccagattttatagacaggcttgaggaggcggtatctgatttacatggggcccaaagattggatagaccaggtgtgacgtttacataactcgtggggaagctggctggaccaccctaatattatgcaaatgaggtctttgcctggccagcaccaccctgttgtctgcttcttgctgtacacgtggctggcaaagagaagggacgatggagccactattttaaacatgcctagtcccaggtagtcttttcctattggcacagctgccagcattcacccatgcacgcttccagcttgctttgtctatgtctgcagctcgattttacaagctgctctttgttagaaaagaaaatgatttaggggctgcttttcgttaaaaggaaaacctgggccgggcgcggtggctcacgcctgtagtaccagcactttggcaggccgaggcaggcagatcacgaggtcaggagatcgagaccatcctggctaacacagtgaaaccccgtctctactaaaaatacaaaaaattagccgggcgtggtggcgggcgcctgtagtcccagctactcgggaggctgaggcgggagaatggcgtgaacccaggagttggagcttgcagtgagccgagatcgcagcactgcactccagcctgggcgacagagcgagactccgtctcaaaaaacaaaaaaaggaaaaccttaccgaggactcccgtaccctcactatctgcctaaataatttctccttaactcctgtatcactatccttggactggatttaggtactatattcatgaaaaaaaaaaagaatgtaatattagtggaaaaaccgtttttctaagttggtagaagatccaaatggaaaggaagaaaatatctaagtatttatattgagttgcatttcaaatttttccttgagctagccaaatttgtaccccaaggccgaatgctagctttatagcttatttctggcttataaaaatcccataaaacattggccgagtgtggtggctcactcctggcatctgagcacttcgggaggctgaggccctcggatcacttgaggtcagaagtttcagaccagcctggcctacatggtgaaaccccatctctactaaaaatacaaaatattagctagacgtgggggtacatgcctagctatcagggaggctgaggcgagagaatcgcatgtacccaggagttggaagttgcagtgagccgagatcgtaccactgcactccagcctgggtgacacagcaagactctgtctcaaaaaacaaaaaaatcacataaaacacattaaaagcaacaggtcaaattgtatacttagcctttatatgcagaaaaatatagccaaaattatgtgatacagctgtgtatgaagaaatgtcaggtgcttttttcttcatattcggaactgtgtggttattcttccattatagatagcattcgtcaatcttctaccgaaaagttctatcaaggcagtcatcacggaatcatcttcagaatccattccttccattctacttttactaccaccgtcacctgaacaagttcagcaatttcttggaaagattgcactcttcctgttgtcagggctgaaaactcaatttctaacatcttatattattggcttatataactggggcgtccaaggtgttgacttccaccgtggacagaaatgggctcaaaaatgtcataaggtctctgcttctctttctctctctctttctcttgggctctgtttgtctttggatggcttccttaaggcatgctttctctatatggtaggcaaaataattgccaacaattctagattcccatcttccaaatttagcaatcccagcagaaagagattgttttctcaaagagctcctggttttgatggcatgcttctacacccatcactatagacaagagaatagggtctcctgactggccaggtctgggtccctgcccatctttatacctagatagtttgtcaaacagctttcccattgaaaacagtaatgctcattttactgtgtgcttatagaaatgtgtatgttattgtatggaacacattggcattatttctagatatataatcatcaaaagtaatgatttattatgagcttgagaacaaaaacaataattttcacatcactaaaaaaaatagcacaaagcttgccgggcgcagtggctcacgcctgtaatcccagcactttgggaggcgaggcgggcggatcacgaggtcaggagatcgagaccatcctggcgaacacggtgaaaacctgtctctactaaaaatacaaaaaattagccgggcatggtggcgggtgcctgtagtcccagctactcgggaggctgagacaggagaatggtatgaaccctggaggtggagcttgcagtgagccgagatcgcagcactgcactccagcctgggtgacagagcgagactccatctcaaaaaaaaaaaaaaaaaaaaaaaaaaaaaaaaaaaaaaaaaagcacaaagcctaatatataggaggtatttagtaaagaactatgaataaatgggttcaatatatcatcccccttctgtgtctatttggtgtcacccatatgctttgtgaggcatcataatgtgttgtaggacttcagagtggcagaactactcagcagttgtcttagtcttaacagaatcctttgtaattgcttgaaacagtgggtccaggaaggcacagagcttcacttaatagaacatgtggctaactctggtctattcatgagtgtctcactgacatatgcccaagcacctgtcccgcctggtgtattttacatgtcaggcatcgttctaagcaccgcacatcttaacaacaactctatgagatgtatatagttacttttattatcccatttttacaaacaaggaagctgagttacagagagattaactttcccaaagtcacacaacttctaagtagtagaagcatgatttgagcctagacagtttagttccagagtttatgttcttagttactacactatattgctgtataaaaaagtggttgagtttctccaaagaatagtttatcaaacttcatattacccccacatttggataatagtaagaataagcggtcacagcaatatgttgtgatttaatgaagactactgaaaattaccccttctacaaatgatctccctcactgtctttctctcatctggaattctaacagttagggtcttacctctcttacttacctctttgcaaataacagtgggagagttgagaccctaaaccaatatcaggcactgaaatatttaaaatgaatagtataatagtttataaaaattattttgtaatttcacaaggcccataggaaattggatagggaaactctgaggacaaggggcaaagagagccttctactacgactgtgaaaagctagctggcttttatgcaatgcagataccaaaagcaggaagcaggatggaaatgatggtggggaaaacatttgaagagtgtgaagcactttaagttaacgaaattttcacctatcttatctcattatagaagaagggattttaaaaactgaattagaccagcagttctcaaatggggtgattttgacccccagggtatctttgacaatctctggagacatttttgattgtcatgacgtggggaagggttagagctatgggagtccagtgggtataggccagggatggtgcccattatcccccccaggacaaagaattgttcagtccaaaatgtcgtcagtgccaaggttgggaaactctgtctcagagcttgcataagtaacttggctatgccatatacttgacaagtttcagagtcaaggctagaatccaagtaatctgatgacaagtcctttgcttgtttccgtattcatttccttcagcatgtcagagtttgatacaggcgatggctttaggtttttggaatgatcgtgatactgtttttaatggtataagttattaataggtgtttttgcttttaaagagtcatctcacccctcagaatgtttaatatgctccaagccagtgttacctcatgaaagataagtctgtacataaaacacaaatgtcaccttacatattgaattctcatatgccagtgtttcacaatttctagcaaattattttataaatggaatgtgactaactcctttaaagctatttttgttattattgaggtaattaagatttgttcaccactctgtttttgtcagtgcatctgctccttggcaaatgaggtatcagatggtctttactgagcaactgttatatgcgtagctgtgatgtgaatgaacaaaaggccttcttgtctgtgtcttttttttagccagagcttggatttagcttacgctaaattatttttttaattgtagatttgagatgttttattatgagaagttggtaatcatctgtgtaaactaataagaactgaaaattcatcatacatttacttatttttttaccttgatcttctagtaaatgtttagcttcatagatttaggctgctatgtaagaacattctcctttatctgagtgatgtgatttaacagagtaatttgtttatgagcatctcttattctttctttattggcaggaggacttgcacctctgcttctcattttgtcactttgggttcagacacctctgtaatagccatcactgggggcagatttcagtagactttgaaaaacttgttttccctgaggctccatatgcttcctggtttgcaaaatataatgacccgcaaatccttcaacaacagcaatggttaggcctagcagttaccacctcactggccatggctccagctcggctcccttgcctccaccagaagcatgggtcaccccagcccaaaggccaagacctccaacgccaggcctctaccagaaagcaacataggcaccgccagcaggtacaaactgcccaaccacaggtgcccttgtgccttgtctgcctcttgtaccttgattcgggatgactcagttaatttgcatattgatttcaaattgtcagaagtaacagtcaaaatacaaacagaaggcagaaggctgatgtaattactatattaaaagaaaatatattaaaatgatgttgtccaatttttcctatatatacaaatgaccaaataagagaatactttttttttttttttttttcgagacagggtctcgctctgtctcctaggctggagtgtagtggtgccatctcggctcactgcaacctccacctcctagattcaagccatcctcccacctcagccccccaagtagctgggactataggctcaagccagcacacctggctaatttttgtgttttttgtagagacagggttttgccatgttgcccagactggtctcaaactcctgagctcaagtgatcctcctgcctcagccccctaaagtgctagaattacaggcatgagccgccacacccagcctcgcaaacacaattttaaagatgaaagagaaccactgcctagtaaatatcaggaaacctctaggaaccttactgaccctatcttacctaattcttgctatcaatctataagatggacattgttagttctgtttcatagaagaggaagtaaaaactgagaaagttaagtaagttgtctttagtggtacagctagaacccacagctctggaatgtgaactcccatccctctgattccaaaattctttgtagaattcttccaccttcataccctctcatcagactgagtcatagatctggaccgggtcttcaggaagactgtagcttctccatctgtaagagccttcaaaaaagtatatgcagcatttgcaacccagcgcatttacatcttcacctgtgtttttataatgcttgctcaaaagttctatgaagtgaggctctgcccatcctagacccctgtttcagatatttgaaaggactctgttaagtatagcactagtgccaagtggttcaaccactctgaattcctacaacgtattaccgatttttcccttaggttatttatttattcatgtatttactcggccacttaagaaatatttctagtatccactacacgccatcctgtgtactagacccaggaggttcagtcgtaagacagacaccatcccttccctcagagatgctaccattccatgtgataagacaactaagaagcaaacaaataaaatttcctgattgaatttagtgggaagaaataaagtggctgcaggaaaacagggagacagggagaaccaccgtaaacagtgagttgggagagatctatcaggaaaagctacctctacactgagatcctgaaggtgagaaggtgacagctatgtccagatacagggaaatgtgttcaaagcaagcagaagagcaagtgcaaaggccctgaagtgggaaggatttcaaatactctggaatatgcagaaggccagtgtgactagagttcatcgaagggtagaaagattagaacaaaacagtaagcaagagaggctttttaaaaagctagatccattaggcttcataataaggctccagcaagaaattttttcagaatgcaatggcagagccaaggatatagctttaagccaggagagtgatataatcggatttaaattttaaaagatcatctggccactgactgaagaatggatttgagggacaagggtagaaataggcaggccaattaggaggctgttttgatagactaggtgagaaggagggcgtgaaagggatggaaagatgtgagcagatctgaaataaaagagaaatttaacagacatttaccttgagtgagctatctgtgtacattttttacttctctgacaagcctctaagccaagctgtgtgtcttattcatctttgtattttcctacttctcttctggtagtcatgatgaaaacagagttcttcaaaattcttcctcttccagattttgcatctgtcaacaaaaacattttcttccctgcagaaagtagatgtttgtctctaattgtggggcctgaggtttgccatccacatttgctcttctgccaaagtcacgctgagtcgtggaatattttaattttttttaagttcagtttttacatctcattaaaaatgtgttggctgacatatttcagaaataaatatgcttaataatacctcatttaatttaaggctctcatttagaaaaaaacactttcaatgaaaagacttaaattgattaatcaagggattttttcgtattccttattagcagttataagactaatggtgatctaccgtaagccttccctttgcctaatgtggttagagctaccaaagagaaatcgttacaacctgtctaatatttataatggctattccaactgactgttgagaccattttagcaagaaaagaattaaaaacactaaacaagtcacatgtctcaattatgtttatgtatatgtggacaaataccctaaataaagatgaggctgtcatctttactacaaataatgtagcaatgatttatggtttgaacaatgacagaatgacagaactaatttgcaataggtcatatgagataaatttcaccatttttggttcatttactttgatttcagaattaccatttctgaagatggaaacctcagaatcatcaacgttactaaatcagacgctgggagttatacctgtatagccactaaccattttggaactgctagcagtactggaaacttggtagtgaaaggtaatggctaacccaaagaattcgaatatttatatatgtgtcctcgtgtctaataatgtaatctaccgaagtggcatcattcatattaatatgtacagataccactgtattgctaaattaattcatcacggcaaacatgatatgattaataattcttagaaaactgctggtaatgaatatgattgaaaggctatcttatttcagaatcatccaatacaattttgagaattatagccattgtatctcttatagtattgtaacgaatgttatcttcaatcctttaattaaatttctttcaagtctctatagatttgaaattcatgtctaggaacactattccaacaaattaaaaactcaagactcatgtactatttttagaaaacattgtttaaacaatgacattggtaatttttaagatagctgtcccatttattcagagatatggatatggcttattatactaatagaaggctttgatcacctctatgctttgccttagtcacccagccaaccttgtcagttttaaggaaataaaattcccatataccatagcctgggtgctttataatttttgtagcagaaagtcctttatgctcttagcaaagcacgtgagtgaaactatttcaatattagcttcatggcatgggctggaagtgctaagtaaccattgaaaaggagaaaatcttaatttacatttcatttgcatttctttcactttatatattgccctgtcataggatttttgagttgaagggatcttgacaatgatttgactgaagaagatgaggctcaggttggtggttctctcaaggtcacgagtagcaggagacctgaacccagatcctgattctgagttcttcttggtcctttatgctgcaccaggaaacaggaagcctttcctgtttctgagtaatttatacagatgggtcatatcatattatttccttcttgcccatttgtagttcccttggtgaagacagatgaaggcaaataaaaatatcaaaaaaaacaatttgcctttaatttaaagaagaaagctaaaaattacctaattaaatattttagggtcattagaagttggaaatgtactactcttttgggaagtctttttatcattaacatacttgaccatgcagatagaaaattggaagtccaagagttagaactaaatatatgtttagattgattacaactatttcagtctattaattacttcctcagagcactagcatcagtgtatgactgactgcttgttcactctgtttcataggcaaaggaaaaagaggttagataatatttgtaaagtgcagttctagctagaggtttttgctaatgtatgactgtcttggctaaaggaagtttagtaatcatttaggaccaagagagatctcaatgtttcagagctggttagacacagagctgggatctgttatagattatttgtgaattatggagatataagagaatattaggttgacatcttaaatcatagttaaaagacagggattcaagtcagagtgatctggatttgagtctcatttctaccacttaccagctcttagacaagacacttagcctgtgtggggataatagcagtgccagtctcatggagtcgctttgataactgtgaaaatccatgttaagtgattagtgtggtgcctggcacctaggaaatattaatagttgttttgtttataaacatgttttcataaaatgaggttgttctgatgactgtggtaatccatgctaagcgattaacagggtgtctggcacctaagaaatattagtatttgttttgttgtttatatattttcaaatggatatgcgtgtattctaaatcctgttgaaatgaacatttatgatatttccaccccaatagaataattagcatagagaagtgagcctataataaagaaatgactaagaatatgaaagattcaaaacagctaagcatagaaaccatatatatggtgtctcatattgttaaaagtagggtattttcacaggtaggaacaaggtatgttctgtattttattatcatccttcttataagtattggcttccttggctctcccaagagttggcagaaaggagaggcctctatttcccatcagagtttgcatcccagtgataccacaagccccaggacaaaaccgttcccaaccaactgtgcagatccctgctgctcatcttacactgaatcacgatgcaaagcctacaaatatatcagggattaaatacgttatagttgcctcatttttgtgtggttataaatattgctaagatagtaatttctacctattctaacaaacaaaataatttatttcttgccttctagtaaaatgtgaacaagtattcacccaagtaagtataggatatagttttaggcagtttacagttacaattttttaaaattttattaactatttgtttctttcaaggtatattaggagaacactagttttccactaacggcaataataacaacaatatttcaaaataaatttacgtaaagaagtgagtcggtacaaagaaaagtactaaatatgcattgttataggaggatatgcaaaaaatcatgaagatggtatatgtgaatgtctaaaactaggaaacatgacttgaggacaatttccaggagagttttagtggacttatagatgcagaattagtatgtcctgcctatgctagccacatgattcgctgaaacatgcacaacactttaaaaactgaaatttcctaataggtgagagaacgaggagggactgaggtaggaagagcctggcccagtacaaaaagaggaaggcagggatgtgtaggtatgagccatgaggttaagggatgatgtgcccaggtagcctgattgacaggtagaattcatgtgtttccaagcagagttatttctggcagtggctcctggttctgagctgcagttagtttctccacagaggtcctctgattcttatattcttcttctaggtgaggtgggggaaaaaagttttatttggccaatatgttctcaggagttaacaatcctgttactttagataaggtcagaagagatttgggggatcatttatctcccagtgtggttggttctcactcccattagcattaatgggaagtacgtgtgtctgcagaggggccatccacagtgcgaggtctccaagaaggacattaacataaactgagaaatataatttaaaaatctgccccataaagcacgatataggcagagaaaaccattctgaactccgcatgaactgtgccaagtcctgaatcccacatcaaaatgcttgagccctgcacctttagtgcaagtgtaacagcttagcccgaaatatgactgagcgctgtattttaattcaattttgagatctacaaagggactaatttatcagagaaggtgttctgtaaccttaaaatgtgcttgtattctttccgatttcctcatgtgtctgggattaaaacaccgtgaaggtcgggcgtcagaacatatcttttctaacctttttacaatagttctatcattaaccatgctttcaaaatccaattctctttctccctacccttgcccccatgtttcggagagaggctgaagatagtgtcaaacacagggtcagcaggtaggggaggagagggaggtggcacatctattccaccagatacaggaggtttagaataaacctctgacaagcaatcatcacatgaataaatattcagattctgcatgagcaggctcccaaactgcagaattctgacaggtgcccagggggctcttgattatcatcccatcatctgaattcctaaattttactggttttgtttttcaggctagttataatatacttgggatttggtttgctgtttcattttaagcaagaacagttcttaagtcaaaccctcaaatactcacagaaagcataatgttagacctttaaacaaaaatgtgcttttgtgatcattgacatcattaagaactctacagagggcagggtacatttatatgcaatattgtacttactaaatcatgtttatctctacagcagagttaaaggggtggtggtgggtggggattttgcatgacacagtgcctctgctatacaggtttcatatgacagatatttttaagtagcagtcctagagaagagcaatttagagtatttgtttggatgtagttcaacaagataactatgttaatagcaaccctcactcctattgattatctccaggactcaaaatgtagggcagtatgctgtggatgctgttaacatagtcatcgtgctgaactacatccaaactgaccttgagcaattttgcaactggtggttccagactatactttgggaaacactgtcctacaccaaagaacttcgtacatgcatgccacctagcaagtgacagttcagtagagtgcatattagaagtgcagatctcctgggcctcactcctaccctaacaaatctaactcctagggaggaggcctggaaaaacctacatttaaaataaataccccaattgatccttatacacatcagagtttagaacattgcattttcaggggtttcacactatgctctgtgggccaaatccatacctgttttatataccccaggggctaagcatggttttcacatgttagctggttgagaaaaaaaccaaaagaacaataatatttttgggcatgaaacttttatgaaattcatcttttagtgtccataaataaagttttgttgtcacatagccatgtcatttttttacatattaactaaggttgctcttgccttacaacagcaaagttgagtaattatgacagagactgtgtaatttttttttttttttgagatggagtttccctgttgttgcccaggctagagtgcaatggtgagatctcagctcactgcaacctttgcctcccgggctcaagcgattctcctgcctcagtctccctagtagctgggattacaagcagatgccacgacgcccagctaatttttgtattttttagtagagacagggtttcaccatgttggtcaaggctggtttcgaactcctgacctcagatgatctgcccgcctcggcctcccaaagtgttgggattacaggcatgagccactgcgccccccgagactgtgtaatatataagtacctatataatatcctcaactttgccacttctgcaaaaccttaaatatttactagtaagtccttcacagaaaagaaaaatacttatcctctctttgataactttttctcttcctcagatcttcaaaattctgtccaaggtatagtctggccaagctatacacaacttttcttgtacccctgctgatcttgcatgctggaaatttccacatgtccttgagtctgattattagctggaagtggtagggagttttctttcccaggaccttagcctcaccccagtatccaaacagttgactttagaacttggatacgagttgaaaatccagaggagagataataaatcattgattgagagggaggaggaaaattacttggcagacactggaacaataattcaatttgattctccagcatgtggggaggattcacacagctggaaccagaatagtaagctaagaagaccctaaagtaagaagcacatgacctggtgtttttttaaaacacttctctcttcctaaacctcccaccgtcaccagcctaaatcagcagaactgttccacctttacctcataattctcagactgcatgttcttcctctaatagcaatttttttttattttgaaattgactatataaagttttaccctaattctgtctggattttaaaagagttcttttggcttttctgtttatttaaatgtctaaattcagtgcatagaattacttttataataagaaaaaataaatttatactttaagtagctttaatagaaaagaagtctttagtggaaattgactaagatcacagatacacgtaacaagaaattattttgtattttcattcttcaaccctacaagccgaaaaggttcctgtggtttagctgagcatttaacggattcctttattgccagaaagagtgctcattgttcaccccatagaaagtttatttatgtttaaatcaacagattttttcatatatatatatatatatatgtgtgtatatatatatttgtaccagcaccaaagagtatctacagcattactattgcgcactatataaaattcttctgttttaactgtaggacattgggaaatatcaacctttccatgcatagcataatagacgcaataaagtagagtcttttcagttggaactttattttgcaaatgagtttgaagcagcccaatcttctatgtaaaactgttcaaggctttatacagatttgacaggggatcaatcagaaatcagtaacatacaatgacggttggctgctaacacacaacaaaagcttttaacattggtcccttataactgaatacatttcaacccaattagatatcttccactggaaccaattatttctgggtgataattaagggtatttctaataggattaacacaaattgtgaccctaggcatctagagtaggaaggaaaagtttgtcattagaagtgctaaatgctaattatggtaggtccctcagtagaagaacatctggccagaacatttcaatactagatcctgttagatctgagatctgtcaccctggagttggtaccagctatggtaggagaatcttaaaagaagggtaggtaattgtgcatcttgttcttcctgtgttcacaaagcgtgtgacataacctggaaatctgatgaaacagggtgtgattatttcctctgacattcttatggacatgtgtgagagccacgtagattgagcaaataacatgcctttggcgatatcaatcatgagtagaatgattccccttttgtccaaatctctctgtaaaaaccttctctccttttgtaatgctgattgcataccatgacagtctgccctgactccagcctgcccatcacttctccatccttggtctagagggaagatgtaattccttaactgttacatttctctatgccaactctgtctttcgtagcaaagcctctatgctgaagacaggcctcgtatttttgcttttggcataaaagacactctgtgggtcaagaagcttgtgtggtaacatcacctcattaataatcagggaaaggcaatgtaagcatctgtgtggtgtgatttttttacatatgagactggcaaaagagaaacatctaacagtaccttttgttggtgactatgtgaggaaaatggtactcacacactctcagtagggatagaaattgcaatagatactgtggagagcaagtaaaattgagaaagtgcaatctccatggcccagcaattccattttctgggcatttaacctagtgggattcacacgtgttctgaggcagacttgcaaaggtgttccttgtgttgttgtttgtaatgaaaagaaaatacaaggaaattaaagaataatacatatggtatcattttatttaatatattgtatgattaaatataaaattagtaatataaaataataccttataatgtttgcatacagaatacacatgcggcataagccctaactcagtatttggagggaggatgcctggagtgagattatgtgaaaggactttagctgtattggtaatatctgtttgggtaaatttttaatatatattcatggggggaaaaaggctggaggtacatgaaaatgtgttaaagccttctaattctggaagagggaatatgagcacatattggtaaatttttgttgtagttttatatgtaaaatatttcaaattaaaaagaatacctcaggtcagaatcctacatggtcagatattgcaggcaaagccatccagacaggaggtctgttttttcagttctctctcagatattgtagaagagacaccttttacctggtgatatttaacccatcccatacaaataatttctttcttgtaaggaaaaaactctcctataaaatgaattaatgaattcttttgtaatgaatatttactaatcagaataaacaaaacaaacaaacaaaaaaggcaaacagaatatgactctttggcttcattatatgtgaagcacataattaatttcttttccagcaattcaaagagacttatgttatactgattcagtttaattgaacttattaccacaagaagataataagaaatatattgaagctatccatctggcttgcattgaaaacctcacatgtttcattcttcatgactgtcataggccatactaattgcctcatttcagctgttttataatcagtatgatttagctatgaatgcgataaaattcttactccagaggaagttgatattaaaaagcatagatctctcacctagctctgctaccacttctgaactcatcctcagcattattacagttatatatttttgaaatacataaataaaaatctatctttttctcgtgcatatctttttaaagtacatctgtcatcttccttctgtcatcctgccatagagctattcctttactgaaggaaagaaatggtttatgttaagcttttcagttcattaaatgtttaaatctcaaggtaggttgttttcaaactatggagtctttaaaaataatttccatagctgaaatggagtttaaatggctaattgtgtaataaataaagagaaaagaaaacttaggcacttttaccttctgtctctaaacatctgaacttcctgtggcttgagaatgatgctttgtcatgtagactggttttatgtgcacatgatctctcagaagaagacgagtttgtggtatgtctatgtgtatgttttaaatcatctgtctccttgtatgttagaggtggtcccatggggggagccaacagttggtcccaggtctgaaagggaaagcttggtttcttataaagcttgaatcagaaaggagacgtgtcagaataattcatgagtgactctccccttcctgttttggcatttgttttctgtgccagaggcaggaggagtataactctcaaagaggcagtcctaccaaatcacgactgaatttctttggctgtcgcaggcaatcaaatttaagaaaactgcccaaaagactttaggcctttaggttaaatacagaatctgaccaagatgaaagcaagttaattaacattttcatcatctctctctgatttactgtagaagatccatttctaaaaagttaaaatggttgtctcttttatgtatccatttgaggaggtgaaagtaggttcctggttatgggagaggaaatgtaagcagaacatttagagttaacagtggctttttgcttggccttctagcaggtctataatcagtgtgcaaaagtgcaagacataattaagtgaagattagcaacattgctttgaagatttcccaaactggaaaacataccaactgtcatcttattaactttttccccttttctctctcttcaaaagtagaactgcttataaatgtaagtaaagcttggattctacctagaagaggaggatccaaagggtcaaatcagaactgccttctcctccatgtatactttaataagcctggcccacatctctcctgatagaacatgtatctgcctccattggctttgtccacagcatgggtagaacacctggtcactgtgcaatttgtaccaacacttcaacttcttcatgtgtaagacaaaggaaattaaattataatgaccagtatagttgatgaagggacactctgatgcagtccaaatatgagggaatagtcaaaaggtacaaaagacaaaactgtctcctccctgtaggccattgtgagccgtagaccacaagcatcagaatcacgtaggagtttttaaataaatgcatattcctggaccctacctctgacctgcagaaccagaatctccagggatgagacccaggaattttcattttcaacaagttcttcagggaatgcctacactcaacaaagcctgcaaacttaggagctcaacctttaggagtagatactgataaacaaagacacagagctgtgttcaaagtacagaaggaacacaaagggaggcaaaactaactaagaggtaaaggtgacaattgaacagggaattgaaatatgagtaagagtctaccagattaaaaaaaaaagtcaaggtaatcccaggaaaaagaaatgtatctaatggccccagtacatgaaggctcctagcatattcagggaaaatacagtggaaaagtgaggggaacacacccatagctattgctcatatttcaggaactgtggaaaataggcaaatactttgattccctttttaatggaaataaaacagatttcatgaactgtagctaagtgacatgacgccaacttcagtagaaattttgcttcttctaagagacattagaatgaaaagtagttatcaccagcatatgattttttaaaattatgttgtaattatattatttgtagaaatattagcaaaaagataatctcatcattcagagagatccacataaatattttttatattttcttctagaattacatccaggctgtattcaatccatatctacatctgtatcttaactgtgtatgtatctgttctcagatctgtaaataaatatccttatcacaaaaagatcatactgtatacactgtttgtaacttcttttttcattagtatctttctaccagcatagattattttgaacaataaataaggactagcctggtttctttatgaatatgtttctatctcctgctcctcaaaatagcatcagcaaaacaaaacaaaaagaacaactcttgtaatatctatgtggggaagatagaagaatctgggggatgtttaggaggattgtttcacatgtttcaccctgaaagtgttggtttggggattgtcttagtccacttgtgctgctataataaaataccatagactgggtaacttgtgaacaatagcagcttctttctcatggctctcggggctgggaagtccaagatcaaggtgctggcaggtttggggtctagggaggggccaattgtcagttcctagatggcaccttgaatactgcatcttccagaggggaggaacactgtgtccagaggggaggaacatggctaatttgtcctgacatggcagagaggatggaacagcaaaagaagacaaactccccacacgaaggtcttttataatgacacctaacctcattcatgactcagtcacctcctaaaagccgtacttcttaatagtgttgcattaaggattatgtttcaacatgaattttggaagggacacaaacattcaaaccatagaagggatttatgtcaatgggggaatgaaatccctagccattctctgccctttcctcaaacttttcctattgaaatttcttatcagttgacacatgctgttactgataacatgctgagtacattctctgatcacatgaatcattagggaataaactaaatatcagaagtagtattcaaaattagtttgaaagataatcatgtgaaccaagtgtaacaagatacatcttaatagtgataaaatataaagatttgcatttttcttcaaaactcaggatgagagagccaaattttagtgtcaggttgtgataggtcttagatgactataacatcatttatgagtctacaatatatatactctttaaaaaaaaaattaaatctagaacataatagtgtccaaaacaagagaggggggaaatatagagatctactgataaaaatacaactggaagaggattgcttttaagatagacattaaaatttgaaatcaccttaaagagtgacaactgggatgataggaacagctgtagaaactgaggctgggtaatccaaggaagagaagacttatagagggtgggaggggaggggtggtcagtgttttcaaacatttaaagagatatcaaactctatgtgacatcagagggcagtaccataagagatgagcaggaactgctggagcagaggatattacttacgtttgataaaaggaaaattttcaaacaattaggccattggcctattatgtatgacattcatttccagactagacatctactctagggaaatatggcagaaagaattcatgtatcagatacaagtgtgtggtttgagtagcctgtagggtcattttctattcatcttagcgttctcagggtctgccctaagtaaatgttgactcatatatcccacccaactctgaaatgttatcattctctgattttatagcttggaaaacttacttctgccctaatgtgcttctactccagagcaaaagcatacccctaggttgaattctgtcacactgactttgttttcttactgtagagtctttctttctttcttttttttttttttttgctttcaatgtgaatttatccataatcagcaatgcagtatgggttgaaaaggttattccgctaattttgagtaatatattctcaagtaacctattctcaaaatagagtccaataaaagtatccgttttctatttaatcatatgttgggatttgaaggggttcaataaacagtaccttgttcagtgcctgagttttgaaacacttgagaagtaagttgaggcagttgggcagatgaaaatcaaatgtcagctttgctagtgataaaggggaatgtggctcagggacatagcaataatgggcttcctaacactgaactccaaattaagcagacttttaccgctacacaacctcaagtctctctcactacgaaaagaaaaataaggagtggaggatcaacgcaataggtgtacatccttcactcttccaggagaaagaatggcactgagccaagaattcctcattgttttttcccagatgcatcactggataaggagtgagtaagaggaaaaaagaggacaggcatgttaggaaacatcaggtgtgtttaaatgtcagctatagaccaagggttacaaactggtagctctcatggctaatttgacttgaacccacagacttgtattgtttggctgtcagagtgtttaaaccttttaaattagaatgcctttagacagggggcatgtattctctaaactgaccccagacctaattattccgtattatcttatagctctaaatcacatgcttaggatactgccacatcctctgtaagcatttgacacgcagtattaagtgggtctcattgctctatgaaaaaaagccagctcttgattatttccaatttttaaattattaagtagatgcaaattgaccatgatggggatttgagaagacgactactagagaagagaatgtttcaaatctttctatttataatgctgtacatgattctacactgaatctgcatttcactcccatatctataccagaaggttatcagtggaagagaaattcagttatctgaatggacatgatcttctcaggagcagtcagtggttaattgggacaagaaaacacaagtcattatcattgagaaatctgaagcaaattgaggcaggttgtcacctttcaccaggaaacaaattagccctgtctttaaaaagacttctttctctctctgctgactggggattcctgtcaactgccaatgaaatagggagagtgtagattaatggtactgtaacagtggccatgaaacaaccataaagccgttttctaatttttatgaatatttttaattgattcgaccagtgtgtttgaatgacaaaatttgtgctaagcttcagctccagaaaatcagggtgccatcttccagctgaaatcagtaggtgcaccagtctgtttggggaaagttctgtgtataaagaaaaagccataaaataccgacaaagtagctcttcctcttggctaatttaccttcatgaactccttgccaactagggacgaatataattcaggtttagctcaaaaaagagagaaacagagatagagagagagagaaataataaaatagtaggtaacatcctgagttataagggttgcaagtaggataaaacttgagatatgacctactttttctacaatttgtgaatatgggaatcattgcagtctaatgcaaagaacagtgaactgaggtcctgtacatctgggggctggttcccagattccagttttctcacctgtaaaatgaagagcctttaatcgagaaaatgaagtccccttctaattctaaagttctctgatttgatgaagaagaagttggaataaagcattaaaacattccaatttcaaatttatttgttaacagtaacaacaaatttatccagagatattctaactcaggcacccccaaaaatgagatgaaatttttcatgtgcaagagatttctattttatgaacatttattttacatgcatcaggttatggtcactcaaggaaagagaaaaattaccatttaaatcgtgtgggcagttttaccaaccagctcatccacgaatggtcatgcgatgaggacctgaaaggacattggactcggtttgcctcgatcttcatatacctgtcaaaatgtgatgatcttgccaggctgaatagaactgatgacattgattttacacagtatggccaccaaacacaagcaagccacttcaaatggctcatagagaaagggctagagagaaaactggttcatttgaacagcatattgattccaaggtggtgccttcctgggagacttctaagggcagttttcagtatataaaatgttttgttttagatactgactttaaaactgagccatgtgtagatgtatcagaaggcaaggaaaacttgtatacaaatgtccatagaagcattattcataatagccacagtgaaatcaacccaaatgcccatcagctgatgaatggataaaccaaatgtggtgtatccatacaatggactattattcagtcattaaaagaaatgaagtactgatacatgctattgatatgtggatgaaccttgaaaatatgatgctaagtgaaagaagccagacacaaaaggccacatactatatgattccatttctatgaaattcccagaataggaaaatttatagaaacagaaagtagattcgtagctgccaggggattcaaggaggcaagaattaggactgactcctaataagtacagggcttcttttggggataatggaaatattctggaattagatagtagtcatggttgcaccaaaaaaaaaaaaaaaaaaaaaaaaaaaaaacaaaaaaaccccactgaattgtatacttcttaaatgtttatttatttatttttgagacagagtcttgttctgtcacccaggctggagtgcagtagcatgatcatagctcactgcagccttgacctcctgggcacaagcaatccttccacctcagcccactaggtagctgggattacaggcgcacgccagcacgccaccaagccctactaatttttctgtattttttgtagagacagggtttcgccatattgcccaggctagtctagaactcctgggctcaagtgattctcccgtctcagcctcccaaagctgtaggattacaggtgtgagccaccatgcccggcctgaagcgtatactttaaaaaggtgaattttatgttatatgtattatatcttcaattataaaaggaaaaaataagtaatgatctattttgcacacttaaaaaaaaaaagaatgaatgaagacaaaaaggaagtaatgaagcaaattcatcagctgtgatctccagatgtcctagatgtcctagagcttgacatattcttaggggtcaccagcttttctcctctcagttactttggtgtttttcctgatccagcctctactctgataacagccctccactctattcctagaaaacactgttggagaatagtccccccatcagtcttccacccactgtagctctacaaaatctgggcacccttcctctctatttctgtgacaccgtacctgatatttaaggcagagttactggacagagaaggtctctgacagatccattacagtccatctgttcccttttcttctaatgtattatagagggaagaatataggctttgaagatagacaaatcaggttctaatctcgacattaccacctataagctgttgaaagtgcgtttgtaaaatttatataatagtacctatttcataggatagttgggaagactaaattagatgatgttttaaccttaatcagcacacaccagcactcaaatagttactctcttctcttgctgtactgttcacagcccaccaatgagaaccccagtgtctggccaaatggccgcattctgctaacatcttgtctatgccattgtgtacttggcttcacaataaagcctttcagacccactggggcagtggtcctgtacctgtagctcttcaggggtcagctgggtggctctatccccatgcctttgggtggaggctgcctggtcggtggaagcaagttgaagctccttcttttaaaattcaagaggcagccctgatgatctctgaatcacctttagcgtcattcttcccttgtcttggaaataagcacacattcactgccaaatagctttatagtcttctataaaatcgaaaaattctggtagcccttcttcagttcttcccatcttcttcctcttcagtttaaattggaagttttcctgctggggtggctgattaagtcagtgattcacaccgaggctaatctccttacccaaaaatcacttggccacatcctttgtattctcttcagaaagtgcttttccctttttatttttgtctttgcaatatggataggctgagatttttttcaaatgtttaatttctacttcctttttgcttactaattctgtcttctgatcatttctctcttctcacattttgctataagcagtcaggaggaaccaagctactccaaactttgcttagaaatctcttcagctaaatatccagtgtcatcacttgcaaattctccctgccagaaaacactagaacacaaacacaattcagccaaattatttgccactttttaacaaggatccccgtttccgcagcgtaagcagaaatttatttctcacagttctggaggccgtggtctagagagttcaagaccaaggcactggcagatccagggtctggctagggcctgcctcctggtttggaaatggtcatttaccactgtatccttacgtggcagtaagagaactagccggctttctttcctcttcttataagggcactaattccattcatgagggatctaccctcatgacctaattatttcccaaagaccccacctcctgataccatcacattgggattagagtttcaacattggaatttgggggttggggaaacaaacattagtcaattgcactctatctcagcacactgtgtagaattttttttttttttttgagacggattctcactgtgtcgcccaggctggagtgcagtggcacgatctcggctcactgccagctctgcctcccaggttcacgccattctcgtgcctcagcctcccaagtagctgggactacaggcgcccacccccacgctcggctaatttttttttgcatttttagtagagacggggtttcaggatggtcttgatctcctgaccttgtgatccgcccgcctcggcctcccaaggtgctgggattacaggcatgagccaccgcgcccagcccacgctgtgtagatttttaataatacttttgttatctaaacgtacttttggttttggttatttgaacttcatgtcaccctcatgggaacataaacttcacgatcagaacactcacgtatactcatagtctttgacacgtctggcccatattaggtgctctgtaacaatttattgaatggatggaagaatgaattaatgaaaggaccacatgaccaggtctccttttgcagtgcattggaatcatcctatctcagagttgattcataaattgccccaactagaaggtccctttgcgatttttgaaagagatagtgatcatctcttccagctcattctttttgcaaaggatactagaaagggaaaattttatattcaagctaaggcccaataattaggccttttactataccttattgtctcacagaggaacttagcaaattcttgttattcaagtaactactgagcaaattagtaagcagcagaccaaggaaaaacagaggtcgtcaatggggcatagtgaaagggacatgggctttggtgtctgccaggcccgatttcatatactaactccagacgttcttagcagctctataccatggaacaattaatctctagaagtttccgtttttcctccttaaaatgggaggtccaacctgttataagaattagaattttctctgtcaaacatctaagagctcctggtgttgagtgtgtacctttaactgataatcaatatcattgtgtttgtattccttttgctacctccccgcgccatcaactccactaccatttatccaagagcaatgtctccaagtgcttaactgtgtgtctcactgtgtagttccctgaaaacataccaaatcccagcagtgtttttgtagcagcactgaagtctgagaaattagtcactctcctcctagaaaaagtaaatcattactgtatatctacttcttatatttatgttgtttactattgtgcatgtattatagaacccacaaatcaatgctctcagcagacaaaactgttcaaatctgcagcacgtcttgttgtgtactaggtatttgacaaaacagtatatatctgtcctgaattctgttttctgaaggatggtggtgtgagcactggagtctgtgattgatttctgagtaacttgtactttatcaaggaatagatgtgatttctcatgtatctgattaaccctccctgtaagattaccatcatttctataatgccagtggattattctgtgcttggaaagatgtatatcagatcattttaatcaatagcctacaaaaggtgtcacctggctctgcctgtggttatctataatatctcacccaaagggtgttgtcatttttcaaataacctgtttaacttaaagcacctaggaaatgaagttgcctttattttgaaacagtatgcagaacaatatgttaggtgaataaaatgtatgcttgttttctgcacgttaccctattaaaaagagagaataccagtgtggtaaaatatccacttatccatctccatcacacaagactggcttggtaacccatagattggtatgggagcaagataaaagtagggtatgcaatagattctgtgctggcatagcaaaatgggagcaatgaggaagtgacactgggctatcatataatcttttatcccaattagaataaatggggtgctgcagataggctggaacaacagagataaacccaagaccatcctgggcaagcaaggacacatgtcaacaataaagtcataccctgttttgtaatttaggaaactttctcatgatgttgagtaactgggacatttgggattaatgatgtatctgtgatgtactcctctgttggattccctgagaaaaatcttttgagatataaactaatcattgcttactattcagccatgtagagaatgtgtgtttccatacttaagataatgagtcctactaagagagaagaggtattaattcttgggagggataattttatatcaagtttagacagttttcagtctgcactaagctccttttttatggccagtttaggaaaaatgctaatgcctcgtatccagacctgtttggagatagagcaagtcaagcagaaaaacgccattctcctaaatgagcgttaggccacagaacacgaaatctgtcaggcagcattttacctggcatggatccgccaaagaaaacaaacaaatcagagttggattttttaagactaaataacagcaagccaaagaaagagcatttacactgaaaaaactgtaaaggttgacaacatcctcaactcattaaatatgatggggaagagtaaaatatgtagcacttttgctccttagtgtgggcttttaagcctctccttcaatcgtgatttcactacttcgtctctaagctatagattctgcctttgcaaaaagagaatacccacctccctaagtcgttccgtgtctaagaaaggtaacattatgcagagcattaaacatgtaacctgacacagagacactctacataataataggtcatttcccttctcaaacgacccagatttctagaggcaactagctatagcttgatgcaaaagtgttgcagtttttaccattacttttaatgcaatttaaaacgcaactacttttgcaccaacctaatataataggaatagacaacagcagtagcaggcattcgggtttcccattgtcctcggcattctagggcaaaccaccaagatctaataagctgtgagattccaaaagaagggcgccaaaccttgggctgcacggcttcaaacttcgtcattacagaatcaccagcgtctttcttggtatgatctgcgggctagaggacaagcctggtgttattagcacagtgagcaagtggcaagagcaccacctccggagccacaattagggaagtaccatgccttgccctggcatgactggagagtaggggccaatgttagactataagagttgactaggattgattgccataaacagtgggccatggttactttcctcggagcattgcagagagcctctttctctgggaggccagcctacaggagatcagtcttagacaagttaacctttacctttcaattatcatggcttaaattttcaggaactctcttctagtatctgaatgttccttatttgtagcacccttttcttgtttatgcaaataaacaagaaacacccttttcttgctactgtcaattcaatatctaatatttctctgaaaataataatgacagaatttcttttttttttgagatggagtcttgctctgtcgcccaggctggagtgcagtggcgcgatctcagctcactgcaagctccgccccccgggttcccgccattctcctgcctcagcttcccgagtagctgggactacaggcgcccgccaccacgcccggctaattttttgtatttttagtagagacggggtttcaccgtgttagccaggatggtctcgatctcctgacctcgtgatctgccctcctcggcctcccatagtgctgggattacaggcgtgagccaccgcgcccggccagcatttctttttgcttgccttgaaattgatcttttgtgttagttgtcctcacatgtctattgactcacagttgttggcccatatttaagagtgtggcacgaaaaagcctatgtgaagccgtgaacatgtagatgaagttcattgactaagaactgggccatttccttgtggaactccccatacccacattaatatttcggtgtttccttttcggctgatcgctacctagagaaagaatatctagtacctagtctcatttggaagaacacagaactcaacagcagtgtcctgggagcctccttggggaaggagactgagaatctcagcttcactgtatgaacactcactaaatccctgctatcctcagttcaacctggtgtcctctggcccagagacctacctctgtattacctgctcagaaagtaaaatcccagaatacttctgggatggggagggttagtcacctggatgcatggaataagggagagcaaatagggacctaattgattttaaacagcatcttccagtgctctgttacctgacttcaagtaatacccgaattcccaaatctttgggcatttttctatagagtaagtcagactgtttcttgtctttccccactgccagtttaggattcagggtttcttatctgctaatcatccagttgctttccagtattttaacagtaatacctcccaaccattctctctgtctttataggcttatgccattaaaaaaaaaaaaaaaaaatccttgtactactgtttaaaaaagttttagaaggttcctaggactctaaaaggatcattgtgacgaagaaatggataatttaaggaagccagcacaatgcctgacacataattgtagtgattatttttgttattttgttaatattcaatccttgtaaaatcatccaagtttataaattatgtactatatagccaaacagcatggacgaggagggcgctgtgaaattaagacctacgtcgttcaccttcccagtggtgtcaggtcatctctacaaccatgagcttttagtatggttagttcccattccatttcatttagaataaccttgtaaaagaaacagggattgggtgtgagtgacacctaaccactaacatgataagcattctaaatctatgttcagcatcatgtaagtacaccctcattgaaatgcagatctccactactggtaattccacacactcctattgaagaaagaattgctcctctgaagtttgctaccccatcctctcacgtttatcacttctgcaaagtcatgcagcatgcctcaggtgaccctgtgaggtaagcaatcttgcactgtatgtgggcatttgcgctgatcttcccagaagcaacccttagtccttgcataatttctagcctcaggagaattataagatagaagacaagtgggggaagaaaaggtttaaaaagattctgtgttctttaaagccagatacttctcagctaagcttttctcagacctttcatgtccctcaataaagtatatttttggctatgccccataaactactccaataatccattaagatagctgtagaaatcagcatagcaaactatcagtgagctggtttagttattcaccggttattaatcttctcagctcagggtcatattgtcctgtcttcagcatttttcacagtgtctgatgatgttcagagagttaatggaggtcctgaaatgtggatacaacaagcatgataatcccttgacttgatgtcattctagggatcgttttcaaactttgtgtgttgccctggcaaatgagcaagaaggcacctgtgtcacttatctggatgtttgtacactgttctggcaaataaatgtctatgtacaatgataatttccttatgatactttcactagcaacaacttgttttgagcatttgttaccagttttagtagctgtcatttttgtttcttctttagcttccttgtaaagtcgaggcacattttgtcctgacttagagtcgcgatatttctttggagattcatgtgagcgtcttcctctcactaaattttcctctccccgccccagtctctgcatgtttggagaagttatcttcctctgaagcttcctgcacttaaaacagacccaggcacaagagacttccatgatgatgatggtgatgatgacagtgatgatgaggatgaggatgaggatggtaatgatatctttattcaaacactgaaaccattcatcatgttatatgcaaccacaggaatattacaagttaagaaacaaattaactgacttacaagtcaaataactttcccacaatcagtcaactagtaaggggcagagctaaaatttgcatccagatttttctgacttcaaaactcagtttcttagctacttccagtctgtaagagcagctttctgtctagaatctgtacaccctcaccacaagaatctagatagctggttttcctttggatctgcatggtacaggcatctatctttacacctggaagaggttcttttacttaggatgtctgtattcaacaaaatatcagttgagatcacgtagggcattcttgacctttgcaaggattttggcatttactctgaggtaaacgtggaggcatctttgtttctgtcacattcttagtaatagctagcattttttgagcactttttatgtagcaagctctattcttgtttgtttgatcggtttggttttttgtttttgtttttgtttttgagacacagtctcacactgttgcccgggctggagtgcaatggcgtgatctcggctcactgcaacctctgtctcctgggttcatgcagttctcctgcctcaacctcccaagtagctgggattacagatgcacaccaccacacccagctaattttttgtatttttagtagagacagggtttcactatgttggccagacttctattctcaaaactttgcattggctgggcgccgtggctcacgcctgtaatcccagcactttgggaggcggaggcgggcagatcacctgaggtcaggagtttgagatcagcctggccaatatggtaaaaccccatctctactaaaaatacaaaattagccaggcatggtggtgcatgcctgtaatcccagctactcaggaagctgaggcgagagaattgcttgaaactgggaggcagaagttgctgtgagccgagactgtgccgttgcactccagcccgggcaacaagagcgaaattccatctaaaaaataaaaaaataaaaaaaaccctttgtattaattcaccttagaacatcaccctcttcttactctcgaaataagtgtctctttttcctttcttccccgtgcaaatctttggcatcaatagtaatggtaataatagtatctcatactctgtagctctttatgttttatgaagcatgttaaaatccattaactcattttgaatttcatagtcatcctgggatgccaaataccatctcctccaaattatagataagaaaactacagctcagagacgtcgaatgacttgctggtggtttcatgcctaatcagtgctgtatggccaaacctagaaactaggcttttagacactaaattgagtgttttatatatttcatcatgatgacatgtttagcaaaagctaggttagtatcagagagtcagtaagagaaagtcctttactccctgagaagacatccagcaactatttctgagatgagctctagacctgggctgatttccagtgaacggagtcctgcttattactggtgctccagcattgtttgggagctcctgccatgggaaaatagcagggtatcctattgaccgccagggtgcccaagtgaacattgcatcctgcatgaaaagtgccctccgggattgtaaaaagtgtcaggtcctgttatggtaactaaatgcaagataacctttctgtggaaagcaagcatatgatggataagaaatgattttgtaaactatggaatgatctacaaatgcaaaataccatatgccttgtacatcttgcctgcttgagtaaatgaatgatttttcttatgtatctctctgtgaatattggtttattcgatgctgcagcagtttgcaaactctgttcactcttgcactgcagcccagagacacaccctagggagttggcatgtgtcatacaaataatgtgtacctatttgttataacctaggcttgggtcttgcctcactatctttcctaccaatactgagctattagattctaatggataatctaggaagtgaatacattcctgtaaactttaacaaattttattgaggaacagacatttaaatgtacacacacacacacacacacacacacacacacacacacacccctaggggttttgtttgttttaattcaagaaactaacacgtttgtggaatgaggaagtcattaatgttttttgactaaccaagacctagccaaaaatctatttctctttctgcccttaatctctttctgaagtatcctgccaatttttaatgctgaccgtttctcaatactttcagtctgtagtagtactagagtgcttcacttatcactgtggcaaaacctacttgtcattttagagaacagtaaatgtggatttggaaaatgtgggactttgggtcacgtcagaactctgacttaaatttcaggcaccctttagttggaagtggcaagatacagcttatctgcaaatgactgtaattacaaagatagagcttgcccaacaaagggtttctattttaatatcataaaaaccaaaaggtggaatggtgctccacaaaagactgccttttcactttctaaaaattcttttctggctctgtgtactccacttggtgtgaatgtcatttattagcatgtgatgtctttgtggagtagaggattctgccgctctctgcttgtctgtcttgctctgtttctctgcattttcatctccttttccttgtctcttggctttaacattctttccacctccattaccctttatattagattagatctaacttttaaattatttgatgtatctttaaattttgtgttccctgtacctaatttaaaagacatgaaaagttgtaaacatctctctgaaaataaactaaattaagttgctttatacttgcgtgaccctcgattggttttttttttttttttttctctttgggtcagcaactctcaatagaaaagtttccttatctctagtgtggaagattggactaaatgtccagtgaccttcaaacctgctccagagagtagttcttccttacaagagtgagttttccaatgatttgcctctttctctccaaaatgaaaaacagtaacaaagtcttaattcagggctcttcagattttcattctccctcctttaaatttcactgaatgtgtatataggtctcactatgaagcaagcaatgcagcaggaagaagagtctcttttagttaaactcataatgccttacctagctgcacacaaagggggcatttcaacaattgcaggggacctaatatctattaatagttgcccattctgaagggtttcaggaaaaagttcacttagaattacagacaagtcctcaaacaagctagtcagtggtggaccagactgttgggggtgggggagggaggattgtttaaggttttgttttgcagaaagcttcatcaatcaatcctatctacatcaaataaagagagggtagctaatattgtctaccaagatattaataccttctattttaagcttcatatgctcctcggtgacctcatctcaaatctataagcaaacaaagaagtactgctttagaatatgcgaattattgcttctttcccaagatgcagtccttaaacagaggaatctgaaaacatgtagaaaattgctgacaggagcaggttaaacagaaaaagagggacactctccttctgctgaggtttcagcaccatctactgtccagaatattaatccttccccacattgcactgtgtgtgaatggcacttggtttttcttttgcatgtaatcacaatggaaggcattgtctttggaattcattgtccttgcctcaaggtgtacatttcctttcttttatagtttaagtaaatattcgcttactttttatcagtagatgcagcccgatgcccagcagatgcaatcacacattcctttaatcagcaaagatcttattatgccattcttacacattgactatgatgaaatttactgtatttcactgatactaatgggattttggggggactcttttgctcagtgagtcataagggagagttacttatgtgcagtcactgaaataaacagaaaacattctaattattatttgatgaaaatgtttctccgtgggtaaaagatatctgtggttcccatttatgattcttttttatcttccatcacagtcaaaggcacgccatagagtgattttaattataccttgactcgaagatacaatgtatttaatttgtcattgacagtagtcttttcctagtcctttcagattgtcatttcttttgaatcgtaaagaaagcttcaaaaagaaaatgtgagagggcaaatttaacatataccccccttccctcttctgttattacttgctattttgcttgaggaagtattcttattcatagtgggaagcttaggcacctgcagaaaattctttgcatttagaaagacttcccagatgagaaaccctgctactgaagcatggcacaaatccagaccccggaggtttgctttccctggtcatgggtaaaaataaaaacaaacaagttgacggtgaatgactttaagacagattatatcttgcttattaaaaacaaagaaacaaaaacctccttattaatcgttgtgaccaagttagagacttgggaggcaaccaagagcattcgagcatcattagaaccgtcttcataattaaataggtgctttatgctacacattttgaccaggcagatctaataactttgattaccacctgactgattgtttcccaagtacctatacttggccaccctcaattggcttgtgcatagtagtttccatttgtggcagtcaagcttattaaacagctctgctttgcgattttcccccagtccttgaaaatagatcagtaagcattccactcaggggcgatttgtaaattgctttacacaaggctccagtttgtgctcacgccgactggggtcaaaatttgccttgtgttttcttctgatgtcatttgtcaagttgcacacgttgttccgagaaccaggtcacaatactatgtggctgtgcctctcggtatgaatcgatgaaaaaccttgacttgtgaacgtgccctatgctacttctgtgttttcttctgccacctaaaagggcagacttccttgtcttcagccaaaatacacttattgttctttttccaattggttcctcttcccttcttcttaaagcaaagtcacattttaattatgttaacaaaaagagaggtaagataaataggggtgctattgagagaactagcctatgttttaaaactgtaaaaattctcaattcacagacataattcctcaatggaaaacaaatcttagagaaaagtaaatgtgtctaaaagagatcaaatgtgtaaaggattttccaaagagcaaaattataagcaaagtagacacttaggaacaaactacatatatagatgtctgatattatgtgagtgatgataacctgaacagattttatttcatcaggatatttcggcagttaaagcttacccctaaaatcaggacttggagctgagctcccttccaggaacctggggcagacaaaaaaaattctacccagatttgagacctttaaaggacatttacctgtggccagaatgggcagcaaggccaccccccaaaaagagtcagacctgtacagtattgggtgcaatgtcctttattttgctatgccgtgaagtgcaaactgcacatttttcacataacctgatacaggcctttacagccacacaacagggagaagtgggtgctcacgaggaagaaaaaacttcgcttataagatgaactcccaaaccaaaattacaaagaccttgaggaagtctgccaccataagagacaatcagcaaatagaacaaatggcaccttcaaaagtagcaataacggaaccacctgaaaaggacttttagctaagtatatgtagatttctcaaggataacctcaccaaccccatccatcatttcctacttccctccttaccttcctaacagaatggatttgtttctgaaaagtaactcaggaggaacagaacaaactggaaactgtggtgtttccatttgtttgttttgatagctccttcaaaatgtagatcctaatgacccagcggagaatagtaattataaaattaatgtttctcccatttaaggatgaattattctctaaaaactaaatataattttaagtaatgtcttgctcctgacaataggtattttatgaaagtattaattcaggttttctccctggtgtgaaatgcagaaactcaatgtttaaattttagggaactgatacattttctttattcattcttctttttataagtagcataaaactttaatttttaaatggcatatgctctagaattagtattcgccatcttttttattttattgttctgtggagtattcattttaaatatttacattttaagtactaaagcaatctgagcaaccctccctttcctgtctggcacagaagagtaatcacagtgagtgaggatgcagaatggtgaggtaggttggagagctctatggagacatggctgtgggtgggtatagaggtggtgggcagaggagacagctggcaatgttggcagattggttatactgaacaaaatgtaagttgattaagcaaattaggaaatgttttcaggataagatacagaaatacttatagatgtgtaggtattatacatgtatacacacatagatatttcccagctctgttgctgagaaggcctaggatcaatgaccctcagtaacaatgagcacattgggtctccacctcttagttctcaaagccatcctccactaaaaagaaccagagctccctgacaaaatgactgattctgggactattgcaggaaaaaaagtataatgtgaaccttactggaccagaaagtaaagaaacacttaatgaataatagtaaaatgtaaaacatacgaagagcccaacttaaaaggactcccagtggccaaaatggggacaatttgagcatcagtgtaaataatgatagtaatgtattaccacctgtcaaaagaagccatgaatttatcctaatgtaagtaagtatataaataaatgggggagaggggaacactcttccttagagtagaatgtcagctgatatatgtagaaggaaagatagcaatggagaatcaccgtttgacaaccatcataaaagccactaattcaggaaggagtctttaatggattctaaggctggtgggtacaagtttgatgaccatcaggtactggtgtaatctttgaatacctccccacaaagtactcattatttatttatttattttagtttattattctttttcagacagagtctcactctgttgcccaggctggagtgcattggtgcgacactgcaacctccacctcctgagttcaagcacttctcttgcctcagcctcccgagtagctgggactacaggtgtaccacactcaactagtttttgtattttttttagtaaaggcaggatttgaccatgttggccaggctggtctggaactcctggcctcaagtgatctgcctgcctcagcctcccaaagtgctaggattacaggcatgagccatggtagccagccaaaatactcataagttacaagggtgtaaatggtaagaataagatggagaagccaggcaaacaccaccatatatatatatgtgtatatatgtatatgtgtgtgtctgtgtgtgtgtgtaggtgtatttgtgtgtatatggtagggagaaggggtgtgtgtgtgtgtacacaaatatatatatatatatatatatatatatatatacacatgcatatatatatacatatatatatttacacacatatattgtatatgggggagaagaaaataagcaaatacagtaaaatattagctactgaggagtgtatatgaaggtgaaagagttctttgtacttttctggcaaactttctgtaagtttgaaattatttcaaaataaattactttttaaaatcaagaaaaaagtacaaaatgtggccttataagaaaattcagcaataaacacagatgaagggccagtgcttgcatggtgagtgctgagttagccttcaggcagttcctttttaaaattccatattcgacataagtctggataaataataagaaatacttaatatagcttcctgatttatagtacttcaagattcaaggccttattttcatcagtctcccacagggccactcacagattgtccataagttatctttaaccaactctcatgagtaggaacagaactaggcaccagggacttataaaagtgtaagatctagtccgtgactcccagaaagctgatcagttacagggggagaagcagggcacgtgtaaaaaagacaaatgattttgcacaacaatgcactagcttaatgtcgaagaaagaaaaacagttaattccgatgagcttcatgaaaggataggatcaccagcgaacagggtggccaggaagggcatgtggggaggtggctcggattcataggctcttcaagacagtaggctttttccagcctggctggccactagcagaacttggcatcccctctctgagggcgcccacctccacctgaatacctccagaaatggagattcatgttcttctgtggcagcctatttccctgttggaaaggtcaaattagtagaaagttcttccttctacagagccagaatatgcctgtttgtagttactctttgctttctactttggggcaatgcaaaataaccttagcttatcttctgcctataagcccttcacatatttgaggactgttgtcatgtctctcctaatttacctttctcgtgccaaacactttcagttattttagctgctatggaattattagatctttcactaacccaggtatactaatgtattaatgaatccaaaacacgttcctagtaagctgtagtctgactaatgcaaaatacaaccagattattacctccctaaattggaacatcatgtgttatttatgcaacctaagatttcattccctttctttggcagctgcacagactccatgagcactgaaatgcttaggtattatccatgtgagctgccaatcccccagcatgtacttagtagctgattttttaagtgtagttttttgcctttatccctattaaagtttgcctaggtgaaaaggttggtcccacttgaaatcactatgaattttgattctcatctaatgtttagggtatgccttttagatgtgtgttttatgcagaattgatacagtttatcttgcactgatttttattgaaaaaatggtgccaactatagaatgttgaaattcatccgtagagatgctacctcaggattattgtcatcattaatcaacactctttgctgtggcatttaaatatgattaaaaataattctctgaccagtccccttatgtcatctgaggtttgcttgctgtctgctctttgaccagctccaggcctttgaagaatcccacttttaaattgtccctataaaaactaatttaaggaaaaaagatacaactctactgaaaggcatcatcaaaaccattagagtcaagaaatttgttaacaaaagggatgtgtctccttccacaaatgaagatggctgaaacacacattaaatactatcctgataggcaccaagtgaatatcttggcactgtaaatgaaagataaattatacactaaaatggaaggattggtagggtatcaggaaagcaacattgaaatggaattcgtatcctgtggacccaaaagcacttatttttgcagataataagaactatcagccaggtatggcggctcacgcctgtaatcccagcactttgggaggccaaggcgggaggatctcttgaggccaggagtctgagactgacctgagcagtatagcaagaccctgtgtctataaaacaaagaaataaataaaacattagccaggcaccagtggctcatgcctgtaatcctagcactttgggaggctgaggcaggcagattgcctgaactcaggagctcgagaccagccggagcaacatggcaaaaaccctgcctctaccaagaattcaaaaaaaaaaaaaaaaaaaagaattagttgggcatggtggtgtgcacctttggtctcagctactcaggaggttgaagtgggaggatcgtttgaacctgagatagggaggttgcagtgagccaagattgtgcctctgcactccaacctcagggacagaatgagaccccatctcaaaaataaaataaaaataaaatactagctggacatggtgttgcatgcctctagtcctaccttgatgggaggattgcttgagcgcaagaatttgaagttatggtgagctttgatcatgctgctgcactccagcttgggcaacagaacaagaccctgtcaaaaaatacaaaatataaaacagcgtagtgttttaaaaaatagaatccttatccaatggaccccaaaacacttcattttagagacaataaaagctataaatcagaaagtctttccaccagcagtgaaagtgagaatgtaataaggcttggataagtgttgtatttatacatctaattgtggatctgattattaattgagtagttaatattattaaaaataatggttaataattaactcttcctcatggttataatccttagaacaaagcagttagtttgccttttgtcatttatacgttatagaaaacactgtagaaagtaaaagaattttttttttaactctaggagaattaagcacttggtaaatatatagatttttaagcatcagtcctctggagttcagaatttatcattctacacagtatgaaccaaccacaagtaggaaagtttagggatgttgttggtcctatttattgttgctatttaattacatccaaatccagccgtcagttcacatcttcagttctaattgcctttgagagttctatgcacggaacaatagctgaagtgactcttcagaacagaagtcataaatataggttcttcctgatctcgatgaattaaaaccaaaggagaggagacagtttgttttgcaggaagccatctgtttgtttgtatacagggtttgtattcaaattttaggaaattaatcaagtaaaaaacatcaaaattcacaacacagaaaacaagagtactgaacaaacatacactttgagaaaaccaagtcgctaatgagattttgaacctctttagtttaatcttttcttgtccctaggagacctctctggtatgtgtacagtgcatgacgttgcattgattcttgctgctttaaggctcagaacatgaatcggcgacaagtgctgagttaatgaatcagcagctgtcagcacaacaactgcaccaacataatccttgactcagggaacttctctggtccttgcttaaaagacagctaagtttaccaataataaaaatctgtcccagatccctacatgtgcataaagaggtgaacgtttctttaggaaagaaatgtcattcagaaacgtgagccagaatttcaaatggctctaggctttggggtatgtgccaactccttgctgctagcccaaaagttgtcaggagataggaagacaagacagttttagggactggagcctgggcatttgactccacactcataagtctgatgtgtaggcttagagctagagccaccattttaggcataaaatcatcactgcttgttacctgtctaaggcagtaactacctgacacgtgcagtgaagccctctgcaaccatctgcaccccatggcagaaattctctgaattcctcctgcgtttgaatatcttcagttgactacacataggagtgtaaattgctgtattatgcccttagacttattcctgcatgatttgcatgtggacatcgtgttttcagtgaaaagaaaggcagaatcgcacaacagacaatatcttaatgactcttagacatcagtctgctcatttgttaaatagggatgataatagtacctatttgttaggaataaatgaaataatccatgtaaagtgcttaacagtgctaagggactcagttattatgaatgttcttattccttcagcctctgttatatgtgttatccatgtaaacacaatccatgcttggcggataaatcaagaaataaatgaattaaaatgaaaatctaaattgcagaatcagtgggcagctgtttaaagtagaactaggcaacatctttatcaaataaaacccatagaggtatatcattttagcctgggatctgtttcagtcttcattttttcttgaggaaaatgtaaatttaaaaacgtcaaatgacatgttaagtcaaaatggggctattccttgatgtttgcttagagtaagatttgtacttacctcttttcctcattaaaaaaaaaaaaaaaaaaaaaaaacaacttcatcactatctattcctgatggtaagtgaatcaatatagcggatttttattatgtagtcctcaaaagcctcggtctttcaaatcaggggttttctatcccattacctctttgctggcagtacctgttgttcacttctcatttcatggacatcactcatttaacagtgactaaaagcacattaatctacttatcatgatcttttcctatttttagaaaacaacaaaagtatatcccactactagattataacctatttagaacagagatttcccttttgtaactgagagattttctttctgtagttggataaaaggatagaaaaaatgttttaaatactctctttaaagaggaaattttagcatgggttatcagcaagtaagactcacaaaaattctcctgtcagatataattacaaaattcccagcggatattttaatcccagaggttccctgaataaatatttatgtacctcacagcctgaaatgcaatcccgcgactatgggagaggattagtcagtgttcttttattatttggtttggttttggtttgtcttctttgtaattgtttgattggctcggtttggtttagtatgtagaaatttctggaatatggcctaattcagaattttattctttaggcatgtatgcggcctttacattgaattcaaactgcttctcactagtgtactctctgacaccatttatgaaatcatgttgcagaaaaataaggcactatgggtgtgaatgtagttttggagttcataaactgtctcagctaagcaagcccattctattcccagtttaaactataatgtaaagggtgaattttaaagcgaattgatggtccttatttttaaaaagtaatatacctgtatcattttgtcagtgatgttcattacagcattatttattatttctaattataaatattagaaaaatgtctaataaaatttgctaaaatgccaactagtttcaaaatggttaaaactgtaagcttaaagcagattataaaattatgttgacaaaggaataaacatgcctatacaatattgaggagaaaaaggaaaatcgtatttgtctcatttttataatggtgtaaaacaaaacaactgaaaaactgtgaaccaaaaagactgggggaaattataccaccatgaaaatagatgttttatctgggtaggatttgtttttctattccttcttttaattttcctgaatttcctaaattacctgtgctaaaacatttattacttttacaatagaaaaaaagagcctaacaaacttcaaatcaacatggatttttcctgtttgcactcagctgaaatgtagctttctagtgaaactggagagagacgaaaaccttttcaaagaggcaattcagagcaggctgccagaaagtaagcccttccacgagcatctttagagatctcacctccatgctccctggctgagttctgttgctctgagaaggttcacataatgagtgttttcatcttttcatattaaaaatgacctcctggcctgagtctgagcttcccagatgactgaggtttgctggtcacagcctcagaaaaaataaagcaaaattacttagtatttcatcctgctcttggagtctacattgtatttccacacaagctcacagactttgttgttgttattgtttgttttgttttaactctccagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggaggggtaagtattaatagcaaaaactgactcaaactaacttgtttagaccaacttaacaatatatttaaagttactattttagaattttgttcaagtaatcttatggcaagaaactcttggttaattcctgctcctttttgcacaataaatgtggcatcactcattgaacaactctatatggcaggactgctccctaactggcaccaatcctacaggttaattattcattcctgtgtatggattagaaactaaggctcacaggcattggatgacttgccttggcctcatagctactgaattgtggaactcagcttaaaacttcaaatcccaaactctgtgtcacatatcatatcatatatcctagaatctgaccaagaaaatagcttaaggatagtttccttctgtttttaggctgctaattaaactccctttgaccttgtagaaggcacgtcattgtgaatttagggttttctttcttgaatttgaaagtctgatggggttatttactatctccaggtaatttgaattcaaaatgattggattttcaaaatgccttcctttccataacggtatattatcattgaacacataacaagaagaggttaaatctgggaacaattcctatcaatcacaatcattgtcaaaaaatttttttctgctctaacgcacctctgtgatcccattgacaataaagatggactccggctgccatttttatgatggagtccagccaaaacatagcggaatacaaaaatggggccctgacttgaaaagctctccccacttcctaggctgctataaaaatctgtccaccccctttacgttgagaataagtggcctaaagtcatccatgtgatatagtgagagcatattttccacccaactacagtactagccctgttcatcacagtcttactacctttatcaaacagggtttttgcagttgagtcacagaatgcccaaaacaatttcaatgactgttgtctcagttctatgccaagagtggtatctgattggtacaactttagatggcacaggaaagaagttaattcgttacatcagtggatgcctgggttcactagggattatctcttgggaccctgactgagaaaggctggatgaaattgccagcgtaaaccattctggacctctttcacatggttcagcttaataactttggctaagtgaaagaaatattaactacttcacaaagacattggagatattgaatatcctgaggtctaggaaagtacatagcccaatgtctaccacaaaagaagtacttgataaactttaatggtggtattaattgaaggaagggtaacattgattgtaataacaggaaagtgtaaatcgagaacattcttcataaattaagcagaatgttctcacattaaaaccaatttcttgggcaggagagatattaaaaatgctaaatctcagaatggcgcaagcaccaaccaatgaaaacagatgcccgaccaatcgaagtggacgtcctaccattcagacacatgtagcctttatgccagaatggtgccagggctaaggcagaaacagggacacctaatgaagtcaaacactgatgactaccttttgtaaagacagctgtccgtagagctgctcacattcatctttcatatggaaaatgtctatctcccctgttaaactagtgctaacaccaatcaacttctgctgagaaatacatagaaaattaaggacagcacaaccacatgtgagatctaagtgtactagccactaggatcattaatgtctgtggagtcaggacttgacaatagaagagataagcaagcgcaattttgaagtcaagcctatttcagcttcgacttcctgggtcagcatggtggaaatgatgcttggtatagagttaacctattgaggttttataaaagttattatttcattgtcctctgatacaccccatccccaccgagtattctgtcaggaacacaacagactgcggtggtggaaaataagcagatgctgttgttttctttggtaggaacataaaaaatgtagatcttagttaatagttgggtctgggtgacttcaaagggaaagagaaagttattgtggtctgctttgatgagactcttacctcactcctcactctatttttttctttgtttcagttttactttaaaaacacaaatccagtcaaaatgtgtaaataactacagtacttctgaatcgcaaaatcaaaattttctattaataggttgctgtgctctgaaatatccaggctgcaagtttctttgacatttaagcccttcatgaataaagtgaattagatagatggtataggcatttccctaaggccaatgtggcttcccaccttccctgcacgcatcccctggggcatattttttatttaaacctgtattcgaagtccccatatgtgaaatttcttaggtaaagtatcaataatcttaataatgatgatgataatagtgataattcctgatacttgcaaagtgcctaatcatttatcgggtactttcttatatacacttgacccttgaacaacacaggtttgagctgtatgggtctacttatatgtggattttttttctaccacactcagattgcaaatacaatattcgtgggatgtgaaataacccacatatatggaagactgacttgtcatatactcgggttccagagggctgactgcaggacttgagtatgtgtggattttagtgtactacggtcctgagtcctgagtccaatcccctgtgtctaccaaaggatgactgtaatagctccttaatcctcacagaaatcttgtcaaataggttaacaattattttcccattttattgagcaattataagacttgatccgtaaacagtggcatctggatgagaagccaagtgttacaaacaaaagacgttttgggttaaaataccatagcttttcctgaattagatttaacatcttggacatgtctgtttcacaaaaaaatggatcatggctgtcagtaataccagtttagagttaatctacgcttcaaggtttcagaagattttcacataacacagataatctcatttgattttcacaacctagcatgaaggtcaataaaggtcttttgaaagtcagtaaatcaaggccaagagagattaagagatttagatgaaatcacacagcaggaatcagcccaagacaactaagcaccaaaactgtagctcttccttcactccatgctttggcatctcttctaatcgtatttctaattggcaattctatctcttccattatcctgtgaatgtgacactctgtactgaaacgatggagataaccaaatacatattaattttgaaatagaatgaggatatggtctttccggatgctagtctagtgttactgttaagaacagggactatatgggttcaaatcctggctctgccattttctagctacgtgactttaggcaagactcctaacctctttgtgctggaatttcctcatctgtaaaataaggataacaagaatacctgcctcagaggacatgtgagtatttagtgagtttaatataggtaaagtacttggaagctgcctgtcatatagtaaataccattaaacatcatccattactattgtcattggagaaatagcaacacaagagtctgtgtcaatttcctgttgtatagtttggaatgggaaaatgaaggagggccaatataccctaaattatcttgtcatccattacgggtttagaatgaagtgtactttttcaaatctggcctctagggtggtctcttcatcaagcagctattctccaaactttggattaacagggctatgaaccaaactccaaggtgtagcagtgttcttcaggtaaagtgctgcctttgtgatagcctgtggaatcatctcctcacatttattaaaagtactgtgctggcgaatgctggagaaatatttctggggcgcatagacatccaaaccaggatgtaattagtcccattcttctgctaatcaaacatgcatttggcatttggaaaccaaatgagcactgttccacactaggtgatgcgagatttccttggagaatctggtcttcctaatcctttcattccaacctgggagcaataacaatgctggctctaagaaagggttgagcaataaaatgcagatacttccaaatgtgggcttgcttccgttttccaaatacagagttctaaagtatccgaacgccaaccaaggccataggctgagggcatttctgaagaaactcacaaaactagatcgagagccaccgtagtacgtaggacttatgtagcatgtaacttacgtccttccgacatgggtgccaaactgctccagagactcagagaagccagacacctgaggtcttgtcgaagatgtgttctgaaaacgtcggtgttcccatctctcaggcaggctcacatatttttaacaggccatggtttgcatcactaatgctttcatcagccagtgtaaaataaatccattagtcaccgtgtccttcatgtgataatgatatttagagctcattaaaaagtaattgcagccactttcccctactttatcagcaggattcagctggtgatttgatgatccgaaacatccaactgaagcatgctgggaaatatgtctgcatggtccaaacaagtgtggacaggctatctgctgctgcagacctgattgtaagaggtactggattttgttgttattgttgttcttgaaatattttcatgatatctactgtagcgcagagttccagaaacctcagtggtttagaattatgggaaaaagtcaggcagaagctgaacattgtaaacagtggctaacagtccacagaagtttctggttcatatacagttcctcagtgcggcttgtcagaaaatgcaccgaacacatccagtaactttacactagaaggataattgagtaaatcgagtacccgattacggctgttggagttgatatgaccttctagaacaaatttaggtgaacaaaagcagatagtttaaagagggattaaactgtccctttttatgtttcatctgggccaaactgaattagtatcctaggccactggtataacagcagcttaagtaaagtcatcatcaggtttatccgagtttccttttttccctaaacttcacagtgctgttcggttcctaaaatagggttttgggagaggacacttcctgactgcctgggatgtagtaaatgagctgagagttgatgtaaatactaacatttttgagattctcttgaatattatcagcatgacctaatttggacctaagagctatgacccccccggctgagcaacaccaactgagtacattccaagcctcaccaaaccggttggcaaaggaactgtaaatggacttttaagaaatatttttaaatgaaaattaaaatcttcactaaccagtgtacataccagaatccaacctatgcatgctcaggggttttctatagcattaaaatagaggccaatccagacatcaaaataatatcttagctagaatctccttcatcagaatccctgactgttggtgttcaggcatctttggccggctggcagagcgcatggcaaaacttcgaacgcaagaaaataaaaatttagggtatgagcgttggaggcagggttaatctgcatgcacagagaacaaggtattattggaagccataaagagtgttgctgtatcctctaggcataatgtaaggggggaaatgtgtgggagttaccaacttaaactgattgtgaagagagggttcaagagaaatagcaattccaatgtgtctgctttgttcccctttcaattgcctttaaaaaaactttcagcaacagtgcagacaagggctggaaatgagaaaaaactttcaaccgaggtagatctgcccacagaataacttatagaaatgtgtttatttccatttgaaaatacaccaggctggtctgccctccccttgggaacaaaagaattctgttgctgaaaatttatcctctatttaattaggataatgttcagatcagcagttaaaacaccaataaattagactaataaatatttaaatcagcaatacttgaagttcttaaatgatattgtatacttcatttcacagaaaataacattaaataccaggaggaatttgcaaacgcagtctaaaagaaaatctagtctaatcagttaataaggccaataaattaatgtgccatttaaaaccataatctttcattttatctccttctgctctgcccttgcagcttttcttgcacattacagagggggaggcaggaatgtatttcaccaccctgaaagacattttcatatttgaaacgtatagcagctttgagtcttggctccagattctttgattttctgaggcctgttctatttaacctatagcactgtaatggcagccagaaaggccacccttcctgagggagaagcagaccccagaatcaaactaatcttccctttgccattgcctgaaacaaaatcttctacatgcccctgagtgtgttatcattttgttcagaggacaaacatttgtacatttttcattttgaaagagggagtccacttccctaaaacaaagttggtaaacattctgtaaggtcgtagctatgcatcggtaggagagggtggcaggaagataaaaaaaagaacaaacaaatccaggaaactaccatcttctctccagtgtccaaactcataccagcccttcattttcttcctatagagaggccaacaatggactcagatatttcctatcgatttaattctttgaagagttcagagggaaacacttttctatttgtggtacttagattttaaaggacatcagtgcagcatccattaaaaaaaatggtggggaatgctaggatgagaaaactagtgaaaaaaattatattgtcttctagactttatctggttaaaaggggtcccaagaccaaaggttacatcagctctatctaggtgacattagactgacatgctgaaatgtcaccatggaaaattaatcagttccagcatacagatttccagacatttcattcaggagtgggagggagaagataaatttagtctcacctgtgggtctataaaagtgatttttaaaaaaggaaagggaatttagggcatcacgtaaacggtgaaggagtgaatcctagaacaaaggctaacttcaggaaattgctgttaattttgcactgctctgtgagaggtttcttttttccctgtccctgtgacatggcctgatagtatttgggtagtacatttgattgctagactggggattagcaaatccttcctaggaacatctccttatgcccgtctaatgggcatgaggtttgtcattatgtcccctcaccatcaccttccctcctgaggtggtcaattgtaccttgttaaaaatgcatttaactgcctggtaagagattttcatgttggaaagtgggatagctgcgggtctttgctctggctctgttgatattttgtctttacctgccagctgctttccatccctctatttctttattagtttcaagccttcatttaaatctgatttcctcccctttccatggtttaagtacatggacagaaacaacgaacatcaggaagagaagtagaaaaatacgggtatgagttgcagaaactacagatgagggtctttagtatctagcctaattttgaaattgctttgaagaagggagcgccttgactcttgcgcaccggccattttcacagcagttcccttgcacgcaagtgtgtgctcacgtgggaagcagggttggatgtgaagagagtgctagtaattacagtgcagcagaatgtgcagagcaacactgtaaccttcaaagttttaaagccatttgtgcttaaatctatattctcagtggtagaaataaccatttccagcagactatactctttatgaaatcaggagcaatatctatcttttctcactaccgtatcctcaaataacactgtctgacccatattaggaacctataaataaataatgaattaatgaatgtgggctcttatggtaccccaatactctctattaacattaagtattcagttgtaattatttgtttacctattagtttttcatattaaactgtgggcccctagaaggaaggggctgtgtttcattcacctctgtggtttccaagcccaggaaagttccaagcacgtagtaggagttcaaaaaggatttgacaagtgatgaatctgtgaatgggtagataaatgaatgggtcaatgccccattcaagtatgtggctcctttacttgggtgtttgaatacactgctccaattctgggggtcttgctctttcccaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacaggtaccatattggatgcttggctcagagacattgggaactcagcatactggacacagcactgtggcaaggaacgtctaagttctcattcagacactactacaaatgatatattatggcagtgtttcctaaacctcggccaactgtactatcattaatatttttctttatatcaaatcacagttgggtttttttaaactcatcctaagcaatagtatctgtgaaatggtaatgtccaggccagatttggtggctcacgcctgcaatcccagcactgtgggaggtagagttggatggatcgcgtgagcccaggagttccagaccagcctgggcaacatggcaaaaccccctctctacaaaatatacaaaaattagcctggcatggtggtgcgtgcctgcagtcctagcaactcaggaggctgaggtgggaggattgcttgagcccaggaggtagaggttgcagtgagccaagatcacaccactgaactccagcctgggtgacagtgagactccgtctcaaaaaaaaaaaaaaaaaaagtctgttgtgctggttgtatatgtattttccgtaacacacattaaaaatatattagttataaaaataaaatgcatcaatctgtattacctaaaatcatctgtgtagcactgtggttcactttggaaagcagcggattctgcctgactatagtcacttaatagtcacagacttcataaagtttacacagtgctctcaaaaaccaataacagaggattatagggagcctcttcacttgctgctgtgttttttgagacagggtctcactctgtcacccaggctggagtgcagtggtacaatcacagcacactgcagcctcgacctcctgggctcaagcaatcttcccacctcagcctgttgagtagctgagaccacaggcgcaggcccccacacccagctaattctctaaaattttttgtagagacaggtcttgctatgttgcttaggctggtctcaaactcctgcgctcaagcaattctccatcagcctcccaaattgctgggatttcaggcgtgagccactgtgtccagccccatttttttagatggataaatttggggataaaaagacatgagatttctttttaaccaattttacaaattcttaaaaaaaaaaaaaacattgttagcagcaacacttccatcctgtttccctttattacatgtatacagcacttcctattttttaaaagtttcacagttatttctctttgcatgtaaaagaattcttataccaaccccactctgtcagtacctccaaattgactcattttcttatttagatttcatttaaggataaattggatgaacaagtagttattacaaacaaagatacacactcctctagacagcaaaagtaggctatatggccttgatgttttgaaggagaatatgcccagtgttgagcaattcatataaatcttgttgattttaacccatttgtttttttcactttagtttactaatccttagaaatgggtttctgtgtttccttctgtaatcactgagtcacaggtgtgctttaagaaggaaatatgagaaaaatatagaagttaggagatgaattctagacctgactgctaatcagctgatctctatacatcttcattttcctcttctgttaaatgggcacaataagaattgtttaagaatgaatataggccaggcgcagtggctcacaactgtcatcccagcactttgataggccaaggcgggtggatcgcttgagcccaggagtttgagagcagtctgggaaatgaggcgaaatcccgtctctactaaaaatacaaaaaaaaaatagacaggcatagtggcatgcacctgtagtccctgctactcaggaggctgaggcacaagaattgcatgagtctgggaggtggaggttgcagtgagccgagattgtgccactgcactctaccctgggcatcagagagagagagagagagaccctgtctcaaaaaaagaaaaaaaaaaagaaaagaaaaaaagaatataatacttttacctttctcagaggatagttgaaatagtgtgtctggcactatacaataaatgcggaaacacatgtgaaggggtgatagtaatgattgagtcaggtagtttggggtcttgtggactgtgtgtcttttatgatgtcatctgctggtatctgattagagtgtgttagtttaacatacagagatagttctgagattacctcactgaaacaactgttgatgcagctaatatcagaacacctacactgccctgaatacaataatgatgaggatggatggatgttcctatcttcctaacgtaatctctgcatttgttttctgagaacctatgaaacagcccccaccttttgttgtctttcagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctcgtgagtagcacccgagattcagatcatctgttctgccagctgctgttccttaggaaaagcgtttgaattcttgctgctcttcagcgctcatgcggctctgtgttagctcacccttccctttaaatgtttataatgatagaaatcaggccaggagaagcccagctgaacacgcaacgggtttcaatcaagagttgttttcttcattaggtccacttgtacagcaagagacacacggtgcttagtcctctcaaaagccagccctttcttcattggttcatttgtcaccaagattctaacagaatttcaaaaaaaaatcccacatttcaaataaaattatctcacataagtaactaatggcaaagaataatttgtgactgctctggacacagccaccatggggtaatcctgtttagaatagaaataaaaaataatttcttcagaaatgttcacttagattatctttcttagggtataaaccattcccagaaacgaagattcagaacatcgtgctcattcgaacaagaccagtcagcaattcagtatggccctctgcatatgcagcttgaatgagcacggggagagaagaacaagttcatcagggtcagccgtacttttacttagctggtgtaaagcaagaggcctacatgtgccgtcttttatagagttcccgcctgtagagaggccagtgtgttgaaggaataataaggtccctacacaaataggagttctgaccctactctcagaaaagcaaaaactcatctagatctatttgattggctttaaccaaggagacatacccagtcaccagccacataccccagtgagacctttttaaatgtggcccggagcctttcagttacgtgatgacaatatagctagtcccctgctttcttttccccttccaaaaccataattgaattaattcccctcagcaatcctgaggtggaagctcgcataatttcctctcttttatagagaaaactggtgatcaaagaggttaagctcagtgagccgggggtcaacttctgtctgccacttccttcaacactcagatcaaaactcttcctcccagaagccattcgcccaccccagctctgagcagggcgctactccggaacgccccccgcttctccatgctgactgttccttaccctggttgtcgaccttgctctaactggtgcaggcgctcctccactccaaccagcttgtaagctctgcctgggcagagcttgtactcttccctttgtgtatctccacgtggctcataaacgcataaccaaacattaggaccagacttcagtcctttcctcccttcgggaacccctcggcctctagggatggagctgaacaattggtcagacgtgtcagataacacgtgtgccttgttgaatgggaaacaggtaattaatagcagtctccttggtacatttcacttcctcgagcggtcgccgtgggccccttgacaatgctgttgctgatctccagagacaaaggggcgtgcctcagagtactcactgaaagtgagtcacctctgccaggcaaccttcctggccctcattcgcctttgccgcctgacataacttgttttttgtctccttgtgcagtccccgaagtcacaccagcgaatgtcagtggtggcggaggcagcaaatctgaactggttataacctgggaggtaaatgaatcacagaataaaaggaacgtacacgcatcgaagctattttattattttcctccatgttagacatagctgggaagtttcctcctctgtttttaacagtgaaaattcatttgggttcagacactccctctcacgtagctaatggctagcaggaaggacggcacttgcccatccattgttgaggcaagttttaattcaatccatcacagtaaaaacaattatgaagggaagacaacacacgttacaaaaaaaaataaagaaggctgtttcagagaaaactagtttttcttttcttcctgaattgctgcatggccaattgatttaaaacgtctgccagcaatagattcagtgcaccagcacaatttcctggcaattggctttgcttctagaaggggccctcttttaggaggtattttttaaaacaacctggaggaaagttagtcaccaatttattaaaaattggctttgagagaagaggtgggagctttagaaagggttcttcatgtttttgaaagattctaaacagccccagaaattaaaatctctcatttacccaaagcacagcagtgaaagaaatcactcatccctccagctgaactcttccctctgagagggaggatcttcagccaagatggtttttcttccttcagtgagatcttttgtctatttggcaatggaagaagattagtattagaggatacgtgttggaaatgtggtttttcaggagaccgatgtccagtgtttttttttttacaatcatttccaaccatttcagagctgggtctgccccatcaaagagcaagctctggactgcagatcctcattacgttttcaaccctgtccagtacatcataactgtttaagatagactgactgcaagccctaaatttaaaagactgttaacaaaacgccaaataagatgggtggagaaggatgtagacaagaatgttacaagggaaacaaaaacgatttttgcatttgagtgaaactactgtgatttctgaagaccaccttccttctttcccagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaaggtatcgtttatgctgcctagatcattgactgttaatatttcttcaattctaaaatgtggattgtagcacgtacaatcaatttcgcatggtacatgtatcttgaaggcatacctgatttgagaagaggataatgtaaacaatttggttcgctgtccaccatgaatctcttgaaaagatagcgactgctctgtatatgaaaacacttggctgtccattattgattccattgctaaggaccagaattgcaaataccatataagatcttcatatctatctatatgttatcattactttcaaaagaattttatttttgcctttaagtgaatatcaaaatataatttgcattttcttaccacttgtattttcataaagcatatggtacttgtggctcacacctgtaatcccaacacttttgggaggccaaggcgggtggatcacctgaggttgggagttcgggaccagcctgaccaatatggagaaaacccatctctactaaaaatataaaattagccagttgtagtggcacatccctgtaatcccagctactcaggaggctgagacaggagaatcacttgaacccaggaggcggaggttgcggtgagccgagatcgcaccactgcactccagcctgggcaacaagagcaaaactccatctcaaaaaaaaaaaaaaatctcacttattaaagaaaagagtaagtcatgaagcagtgtgattgcgctcactgtcatccacaccatcattatgtttaacatttctcacacattattatcacctccatgctatccctgctctcgggatgcctctcacacagtcttcgttacctttggagttcgtctatgttgttttaaagatgatgctcagaatgggaccatgttaaaacatctgaaaggtgaatcattgatttagagtcagtgaagatgcaataacttattcccaatcagagagatcatccccttagactcagtagccctccatgatctagctgctgcctctctgtctgcctcagctgctgatgcctttccctgcatatttcatgttccaaccattgccaaaggatttacaattattcaaacaagcttcagcccttttcatagccttcaacttctcttagataatagttcatgtctctggattatgaaaatgagaggaaaaggggaaaaggacagtcagctgacttgactaagattcaagagagctggatgacacttcaggttcacactgcaatctgtatgatcttggataactcaggtatactctgtgggcctcagcatctttggctgcaaaggagaggctagactgactgtttcccaaatttcagttatttttgccagatttctgccatagctgtgtaccatttgtatatgttcacatttttctttcaatagtcttccttaaaaaaaatttagtgggcaagcacagtggctcatgcctgtaatcccagcactttgggagggggatgtgggaggatagcatgagcctaggagtttgagaccaacctgggcaacatagcaagatccaagtctttacaaaaaaacattagccaggcgtgttggcacatgtgtgtgtggtcccagctacttgggaggctgaggcgggaggatggcttgagctcaggaggtcaggctgcagtgagccatgattgtgccactacattccagcctaggtgacagagtgagaccctatttcaaaaaagaaaaagagaagcagtttagccatgtcgtaagcaataacatttgtgagatgctaattaagaaggatctgtgttaagggaattgctggctatgaaaacttggtgcttaaacttaagtggttcttctcttctacccacacctaaattcagaacccaaacactggacaaatattcactaccaccaactccagctattaatcactgcccctctgcaaaatgagggtttggcttacaatcattaaggacgattctataaccatgaattattttaccttataatgctagtatctacaatcctgtcctaatatagctgatagagtaataactatctccatattcatctacagaacccaccaaaccaccagccagtatctttgccagaagtctttctgccacagatattgaagttttctgggcctccccactggagaagaatagaggacgaatacaaggttatgaggtaggcaagacatatgtgccttgggtctgaaagagagtctatgccccttgataagtcctccaagtcacattcttataggaagagacccacattcccactaagaggcattggttttaggcctggcttccagctgaacattaatggaagcattgaatactcagctgtgagactaccctttttctatgttatattctagaggtatttttcgaattatatgcaaatctaagcatttacgggatggttggcaaaatgagctttgacttctgatatgcccaggatcactttgactcaaaacaaacatgggaaaaaagaaaataatgaacgacggttgtgtcaatgtaccgtctcactaggaagctaaggacaaaaaagggacccttcttactttggataatttctcaggatatacagagtcctttgtcctgatagctctgctcatgatgtagtatagaaaactaactccatcataagaatctgcgtacaaaattacctgatgacattgcaaatatccccattgggtatggtttccaaggtctttctgtttatcttcttaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccacgtaagaacagacttgctcagaaatattttggggattcatcacacatatcccaagtttattccttatccccacctcccaatgatcatttgcatactaattagtagcatgtggattcaaatttccctcagcattttaactgaacctttccgtataccacgcaaaattcattgctgtggaggacagaaagataaatgtttttctcctcactgggaagggctacttcttttagctataaatgttaggcgaccaactgaatctttttccatttgcaatgctgtatctcatcagattttagtgaccttgaagacacatattagtgcaatagcccattaaattgcctccactctcgaattctagtaaggagatattcctcagaatccattgagacttaataatctgtgacttcgtatatcttaatttttttatagcaccaagtcaaccccccggaaacatcatatggaattcatcagactccaaaattatcctgaattgggatcaagtgaaggccctggataatgagtcggaagtaaaaggatacaaagtaggtaatttcttttttgcaaaggcacctaatcgtgctgtgagtgggggcagtctcctccatgaattatacagttgtctgcattgtcagtttccctggtgatgctctcctaccctctaggaatcgctgcctccaacacggtttgatctgagttgtataaatagtctatggcaattggtcaggatttagacaatcaccttaactttagtctcaggcagcatcaatcagaaatggataaagaccctgtgtttgggtctccaaaaataccctgaagaaccactttttaaacattcctactgtcagcttcgttttgctcctgtctcggtttatatatattttttagtcaacttagtagcctcctgatattaccaatgattaatcatttttgttcgtatgtttctatagtcaagagttatataaagaaaaagagaaaagagagaaaaagcaggaaaagtggagaaaatgtttgcctgaccccataaatgttggcttgtctttaatgagaaaatgaaaagaacatgtctgtagccttcttgcagcaatcaaaaagggttataaatatcttgcaacgtttccagctacctatttgctacctaacaaaccaacctgaagctaggggctaaaacagcaacagtgtatcattttttatgactttgcaatgtggatagggccagaatggacagattttagggctggaataactaagatgcttcttcacacacttttggcttcttggatgggataggtgggaaagctgaggctggccagtgatcatgctctctatgaggcctttccccacggataacctgggcttcctcacagtatggtgacctcagagtagtcggatttcttacatagttgtcagcttcaagaggaagaaagcagaagctgccagcccttttaaaagctaaggatggacgtgggcagttccaagatggccaaataggaacagctccagtctatagctcccagcgtgagcaacgcagtagactggtgatttctacatttccaactgaggtactgggttcatctcaatggggcttgtcggacagtgggcgcaggacagtgggggaagtgcaccgagcataagctgaagcagggcgaggcatcgcctcacctgggaagggcaaagggtcaaggaattccctttcctagccaagcaaagctgtgacagacagcacctggaagatcagggcactcccaccctaatactaatactgcgcttttccaatggtcttagcaaacggcacaccaggagattatatcccatgcatggctcagagggtcccatgcccggctcagagggtcccatgcccacagagccttgctcgttgctagcacagcagtctgagatcgaactgcaaggcagcagtgaggctgggggagggggcgcctgccattgctgaggcttgagtaggtaaatagcggcctggaagctcaaactgggtggagcccactgcagctcaaggaggcctgcctgcctccttgccctctgggggcagggcatagccaaacaaaaggcagcagaaacctctgcagacttaaatgtccctgtctgacagctttgaagagaatagtgtttcccccagcacggagtttgagatctgagaatggacagactccctcctcaagtggttccctgacccccgagtagcctaactgggaggtaccccccagtaggggcagactgacacctcacacagccaggtacccctctgagacaaaacttccagaggaacgatcaggcagcaacatttgctgttcagcaatatttgctgttttgcagcctccgctgctgaaacccaggcaaacagggtctggagtggacctccagcaaactccagcagacctgcagctgagggtcctgactgttagaaggaacactaacaaacagaaaggacatccacaccaaaaccccatctgtacgtcaccatcatcaaagaccaaaggtagataaaaccacagatatggggaaaaaatagagcagaaaaactgaaaattctaaaaatcagagcacctctcctcctccaaaggaacgcacctcctcaccagcaatggaaaaagctggatggagaatgactttgatgagttgagagaagaaggcttcagatgaccaaacttctccgagctaaaggaggaagttcgaacccatcccaaagaagttgaaaaccttgaaaaaaggttagacaaatggctaactagactaaccaatgtagagaagtccttaaatgacctgatggagctgaaaaccatggcacgagaactacatgacgaaggcacaagcttcagtagccaattcgatcagctggaagaaagggtacctgtgatggaagatcaaatgaatgaaatgaagcaagaagagaagtttagagaaaaaagaatgaaaagaaacgaacaaagcctccaagaaataagggactatgtgaaaagaccaaatctacgtctgattggtgtacctgaaagtgacggggagaatggaaccaagttggaaaacactctgcaggatattatccaggagaacttccccagcctagcaaggcaggccaacattcaaattcaggaaatacagagaatgccacaaagatagtcctcgagaagagcaactccaagacacataattgtcagattcaccaaagtcgaaatgaaggaaaaaatgttaagggcagccagagagaaaggtcaggttacccacaaagggaagcccatcagactaatagcggatctcttggcagaaactctacaagccagaagagagtgggggccaatattcaacattcttaaagaaaagaattttcaatccagaacttcatatccagccaaactaagcttcatcagtgaaggagaaataaaatcctttacagacaagcaaatgctgagagattttgtcaccaccaggcctgccctaaaagtgctcctgaaggaagcactaaacatggaaaggaacagccagtaccagcctctgcaaaaacatgccaaattgtaaagaccattgatgctaggaagaaactgcatcaactaccgagcaaaataaccagctaacatcataatgacaggatcaaattcacacataacaatattaaccttaaatgtaaatgggctaaatgctccaattaaaagacacagatggcaaattggatagagtcaagacccatcagtgtgctgtattcaggaaacctgtctcacgtgcagggacacacataggctcaaaataaagggatggaggaagatctaccaaggaaatggaaaacaaaaaaaaggcaggggttgcaatcctagtctctgataaaacagactttaaaccaacaaagatcaaaagagacaaagaaggccattacataatggtaaagggatcaattcaacaagaagagctaactatcctaaaaatatatgcacccaatacaggagcacccagattcataaagcaagtcctgagtgacctgcaaagagacttagactcccacacaataatgacgggagactttaacaccccactgtcaacatcagacagatcaacgagacagaaagttaacaaggatatccaggaattgaactcagctctgcaccaagcagacctaatagacatctacagaactctccaccccaaatcaacagaatatacattcttctcagcaccacatcgcacttattccataattgacctcataggtggaagtaaagcactcctcagcaaatgtaaaagaatagaaattacaacaaactgtctctcagaccacagtgcgatcaaactagaactcaggattaagaaactcactcaaaaccgctcaactacatggcaactgaacaacccgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggagatagagacacaaaaaaccattcaaaaaatcagtgaatccaggagctggttttttgaaaagatcaacaaaattgatagactgctagcaagactaataaagaagaaaagagagaagaatcaaatagatgcaataaaaaatgatcaaggggatatcaccacccttgagagtgggtaacagggttagaccagatggtaggaaaggacactttctgagttcttcttaatttccagctcagtcactcccccttctttttaggagtggtactggaagagccagacaccctacacctcctcaactacaccccaaggaaggtcactgtaactggctatacattttgaattgctacatatacatgtgaatgtttagagatacataatttaaagctacaggtatccacaggttccatactctcaaatgtggatcaaaaatattcaggaaaaaaaacacacaaaaaaatacaatgaaaatgacacagattttaaaaacaatacagtataacaactatttacataccatttacattatattaggtattatgagtaatctaaagttgatttaaagtatacggaaagatatgcttaggttatacacaaattctataccattgtatatccaggacttgagtatccacagattttggtattttagggaggtcctgaagccagttccctgaattaccaaggtaccaatgaataactctctctctttctctctctctctctgtgtgtgtgtgtgtgtgtgtgtgtgtgtatttgtgtgtgtgtatgtgtggtacctcccgtgatatctcacgtcccatgatagctcaggaaactctccctagtgtcacttttagggtgagattagaggctgaataaaaagcggatctgattgcaacggaagagttgacctttgctagagaatttgacccattaaatatggctattgtttatctcagactgaccctttccaaaattaagttttcctcccaaatactgaacatgttggggtgtgggtttattttcccttcttcactaagttgtctgaattctttagatctcagcttaggtagacagtctcaacaagaagctgactttagaaagtttaaggccccaaatattttgtcaacacaaatccttaagctactttatggcattagagctaaaaggagagcatctggttttagtatcacaaattaaactacctgcagggccaggcagataacataaatgagttctgttcagtccattcagaaactactactaatacgtctactaagcactgttccaattcatcttaactttatattttattttgttgtattttgagacagagtctccctctgtcacgcaaggtggagtgtagtggtacaatcttggctcactgcaacctccgcctccagggttcaagcagttctcctgcctcagcctcccaagtagctgagactacaggcgcccaccaccacgactggctgatttttgtatttttagtagagatggagtttcaccatgttggccaggctggtcttaaactcctgacctcaggtgatccgcctgcctcagcctcccaaagtgctgggattacaggcatgagccaccatgcctggcctcatcttaactgtataataaccatgaagataggtacagttattattgctagttttacggatgaagagctgtggcatagagtttagtcacttgcctttcacacagctggtatgttgaagacctgggatccgaatacagcagtatggatcctgagttctacatttagccacttggtgcttctgcctaccagccataaataaatagaataagtgataacaaagtactgcagagaaaaagaggctagagtgaggggaatagagaaagccatggagtggacaggagagatgtattattttatagaaaggccaaggaaagccacttttaagtggtgagatttcagttgggccttggcacctctctgggaatgtcccaagtactgcaaaaaaggaagtgcaaaggtccagaggtaggcatgtgacaatgtagcaacattggaagtgttgggactatcaccaactgcagagtttgtgattgttcagaatgagacttctcaactccaaccagttgttggcagacaggaatatagatcactggcttagtctattttattctggatcgcacttttgtagagtcttactcaggaacagaatacctgagactgggcaattaatatgaacagaagtttattgacacccagtgctgggagggagagggatagagagctgactcgcccttttacaacagtgctaattccatctgtgagggtgagcctaatcacctcatggcctaattatctcttcaaggttcacctgttaatacagttaaaatggcgaatttcaacatgagttttggagaggacaagcatccaaagcatagcaaccagtgtggccatatcttccagtttttcagtagaacccacaaatttttaatgtctaatttctcggtttttaaatgttcatgtctaactcaaaaaaaataacactatgacagccaaacaaataatatatgcaggctggttatgacccatgggccactagttttttgctgtctaactcccttggtttgtgttcccaaagacagatgccagagagggaaagcaatttgcccagagccctacaggtggtagccaaggtagtcttcgttaaaaatccaggttctgaggccgggcacggtggctcacacctgtaatcccagcactttgggaggccgaggtgggtggatcacctgaggtcaggagtttgagaccagcctgaccaacatggtgaaaccccgtctctgctaaaaatataaaatcagcagggcatggtggcgcatgcctgtaatgttagctacttgggaggctgaggcagaagaattgcttgaacccgggaggcggaggttgtagtgagctgaggtcacaccatcgcactctagcctgggcaataagagtgaaactccgtctcaaaaaaaaaaaaaaaaaaaatccaggctctggagccagactgcctaggtttgaatgcaggatccgccacttaccagtcatgagaccgggcaattgcttcacatctccacatctcaagttctcatctttgaaatcagaataataacattgccttccttaagaggttatccacataagcatttagaacaagcttgtacagcccacagcccacaggctacatgtggcccaagatggctttgaatgtggcccaacacaaattcataaactttcttaaaacatcgtaagatgttttttgcaattttttaaaagttcatcagctatcattagtgttagtgtattttatgtgtggcccaagacaatttttcttcttccagtgtggtccagggaagccaaaagattggacacccctgatttagaacacacagtgttcagacattaaatagtggaagtagtctataatatttgctattatcattattcccacaaatccattctttccccttgtcttccaccctagattatatcaaatgcaagcacagccttcaatcagctcaagcaagtgtttggtgtaaataaaggctttacaggactttatttgggttctgctgcagtccataatactgcaagactgataagcagtgctgataaaagtgctgctttttcctggaagtgtttcttttggatttatatttgaaacaagttgaatcctctgagctcttgcaaggaccagaggtaaatcaaagcagcaatttattcctcaaagccagatgtgaccttgcatcccatcagcccattctcctggagggccgtgatgagaagctttgacactcctgaatgtgcctgaggatttatctgtgcctaatcatcagcaaggggatgctgggtctgatacaactgatgctgcggagaagaaggggacacttatgaatctttctaccttaaggaaattgtgttttccaccttgtgttagagagatataaattaaggtgatgaaatgccagggaacagatgggttctaaaccattctaaaggaattttatgaatttcacttgtgtctggttttgtcttgagacacaagagtgaccttatgtctgtagcctcagcagatcagaatttataagggatcttagggaaggatgagctaatctcgtgcttctcaacgcatgatccctggaccatcagcactggcattagctgggaacttgtcagaaatgcagattttcaggtcccatcccagaactaatcacaaactccaggaatggggcccagcaatttgtgttctaacaagttctccaggtgattctgttcacgcttgaatttgagaactacgcgtctaattcatctaatcatgatgcctatcccatattaacatctcctgatgatcttttagaaaacaactacagcatggatcccacctctgtgcagtcttaggcaggctagagtggaactggagcggggttactgacctcctcacagtcaacactttgagctagagagttctttgttgcggggctgctctgtgcattgtagactgttcagcagcatccctggtctctctatccactacaacaggaggacatgttttgacaaacatgtctgcagacattgccagatacctccctgtgaggcaaaattgctcccctgcccctcccaccctgttgaaaaccactgagctacagcataagtattttacaagcaccccaatggttctaacatgcagccaggaccaaaaaccactgacctcatccaaccctatctttttgtcaggggaaactacagaggatgagctttagtggttctataggtaaaggcacactttcccagacctgtatattttgttcctgattggagtaaatccaatcacagcaggcaatcccaggtaagtgaatgtgtttttaggaggctagttggccacctcatcaaatgaatccacctccaaactcagaacccatggggggcccaagatgaaaacaggactgttgcaagctgcagatatgtccagggtgacaatggttgcctcttggctacctagccccataaagtggggttccagaggaaaggaatgggaggttactactcttgcctttccgatatcttctccctgtgctgaaatgtcctgtctctaagagtcgtgatcataacttattgtgcctggcttgtgctctaacctttgccatgtatgttctctgattatctttaagccttcagagatactatttcttacatgcttcctctaagctaggccatcaccagattcaaaccttgtgcaatcttttgtatttttatatttttgagacagtcttgctctgtcacccaggctggagtgcagtggcttgatctcggctcactgcaacgtctgcctcccgggtgcaagcaattctcctgcctcagcctctggagtagctgggattacaggtgtgtgccatcatgtctggctaatttttgtattttttgtagagacagggtttcgccatgttggtcaggctggtctcaaactcctggcctcaagtgagtcacccaccttggcctcccaaagtgctgacactataggcatgggccactgcacccagcctccttgtgcaatcttgaaaacacactccagaagactgggtattattgtcccccttttacagatgactgaagtgaggctctgaaaggtgaagtggcctgtgatcccacagtggccaagtttattctgatgccaaagcaccgatgtgtaactgagcactgtacatccttaaggagctactcatattttccactttcccaagagtgtcaactgagcctccgagaggctaggcagtaggtagaatcacgttgctgatgcccctgatataatatcctttcagctctttccttggaataaaatggtagctgcagtcatggccctcactgcaaatgagccttccaaatgcaagtgggcagccagacaacctctacatccctgcattttgctcgtgcccagaggtgaaaacaaatgaatgctccatatttgggacctttgtgaagacggcaggtgacacctgttctttctgtattggcaggtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaagtgagaatgcctttttttctcccttttctcctgcctgtcttatcttatcagccttccagatgagtcagggcttgaaagacattcagcctgcaaaagcagacttaaaatagaaatggagaacactaccccccttctccagatgtttgctggccataggcagtttcatgcaaaaatcagtttgcccgtgttgactgatctactcagttgctaatcaaaaatcagattaaagcagacccgaattagtcactaaggtttttccgtgtcaacctgtgtagtttgcattgcatctattgtagccccagaattacagtttagaaagtgaaaagcattgactcagtcagaaggaacaaggacaagcattgttaagtatgccgtagcagtttttctccagtgaaacagtgtatgcagttcagtatcttggaaatatttggaatttactacttattttcaatgggtatatgcaacatgtgcatcaatgtgtatgtctctctatagtcaagattatcttcactttcaaatgttgttgaatagcatgggagaatagcatattctttttgagcaaatacattcaattctgtttttacaaataccatgtttgtaagtatcttaagagcatgatttttttgttgttgtgtgtgatctcatttatttaaagaaaaaaaacaaaatagccaaatccgtggagacagaagtgaggctagtgattggcagtggctggtcagtggggaatgggggtttaggcactgggtcttcatttggggtgacacaaaagttatggagcttgagagtggtgctggttgcacaacactggagtatacttagtaccactgatttgtacattttaaatgagttaaaatgctaattttgttatgtgtattttacagcaataaaaaaaagactgtggttagatatctaagtgtagactttcacaggctttcagatttcagtctggagattaggggagcagtgaaggctggaggtataaattttcaagacattggtaaaaagatgatattttaaattatggacaaaatcctcaccaccatcctgacttttagccatgtgacatccctctgctaaggggtgatatgccagtgtttctggatggagtttatatttactgcatcttttttgcatacaaacacaaaaggcatttttgtcttaaaagggggacaattggattatactttatcaaacaaagcctctaacttctatcgaaagggagctagatttttggtgagatgtggaagtaaaatctccaggccacaaaaatacaagattggggcttatctcgcttcattaaaaatctgactttatacttcatactttcttatcattgcagggattgacatttttagatagactgatgattcctggttttattcattacaaaaacatatattaagcaattatattggtgtaattattagataacaaggaagtgactgtgaaccaaacatgatctgtttcaagagatttttcatcatgttggtcaaagagaccttacaagattgaagaacccccgaatgacagttgatagcttcttactatgaaaagtgtaagacccataagaaaatttaaaaaaggattgaggctattttgtttgcagaaaaggggtagatttagacagacatgggtttgaaccccagtttagccatttactagctgggtgatcttagataagttactttatttctctgggcgcaaattaccgccatctgttaagcgaggtaataataatacctggccttcatccagtttttgcaagatttaagtgtcatattcatctgtgcccagcagaaagatagagttcaaaagggagcagcaattttcattttgttgaatcatcgacatagcatgctgtttatcagtattgttactagtaatattgaagtttcttctcacattagataggaacctccttactttacaaatgctttgacagaggtacagggctgtcctataccctactcccaggtttgtagcttggtagtcatagaactgatatttaaaagccattaagaccttgatcatcatttccagtagaatccatgcagttctgctgtttcaaaaagccccgtggcccctcttccctttgaagccgggatggggctgttttgagtgaatttgttctctcttttcagatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttctttaggaatggcattatacagtacttcctcaaagcaaatctagctttgtctgaagtttctttggaaactctgcaatgcactgaagacatctgtaatatgatgttaccaaagcagtttacatatgtccttatatgcatattttttattatatatttagtgttttatagaattttttaaagttaacatataatgtagatattaattttttcctcggctgtaaaatgctatgggcaacacaatcatgcaattataatttgaaaatatttcctttaaagacagagtttgaaactcatcttggtaaataaattgcaaattactcgtacagttttacaaggatctcatggcagaacagcggaagacttggtccgtaactcaaggctgttgtatgcaaactactcttctagtggttaatgcacttgacatgtacagtatgtttcccatgccgttgtgattttgacatgtacagtatgttttcatgccgttgtgaattttgttgttcaacccaacttgagatggtttcaggaatggctgcaatctcaaaagctcaatgtactgcccaagaggcaccttgtgcaatattcccatccctgaatttagcattgtacaggaagattttcttttcactcaactgagttagcattgtctttgtggtagcattatcttagacattaaatttgaagtaacatatatcctgtagtaacatagacccaaagttactatagtcaaccaagtctttcaaaggataaaagatcattttattatctttaactgtatctattttgaatgtaaatttaaaaaaagtaattctctgtcaatggattcgtaatttctttacaaaatttcttatatataatatgtgtatctctgtaataatagagcccttcttttgaatcaaaattacatatggactttggaagattgctcctatttcaacaaatagttgctgcaagaatttttaatatgactctataaaagctctttagtacaattgtatggtttcttgatgattctgttttgcaataggtagcctagttgctttatatgctttaccttctaggtcttaaaatcacacattggaaaatgacaatatcaacaaaactgtattcttatgaaaagaactatttgttacaatgagaaaggttttgtgagtaaaccctactggacagtgacataaaaggcaatggaattttctataaacattttctcatgtaaacatgctgccaccttttcttctttctcagagaactcaaatttgctatagtttgtcatttttgcttacaaataatataacttttcaaccttctagttatatttatccaataaagtcataatcgggattccatttgtgtaaaaactagggtggtaaccggaaaaaaatattgtcagtatttcaagctgtgttcctttcttagtttgatatggttacttctatgttgaaataaaatttaaaatcacatgcaaaaaaaaaatcagcaaaataataaaatgaacgaaaaaaaatgacacccagggagttcccaaccccagtgtaaatgatatttaccagtgatctagcatatgtaatcttttttaaaggtattgttaataaatattctgtcatttgtaaaga
